United States Patent 9,567,581 (SELECTIVE REACTIVATION OF GENES ON THE INACTIVE X CHROMOSOME) - sequence listing, part 43

SEQ ID NO: 4483 - DNA, 2804 bp, human
tgctgccggcccctcttccccgacggctaataataaacccgggttcctgtttcccggccgcggccactccagattcggggctgaggggctcactctgcaaccaaggcacgtgcattctggtcatcccacgcggggagcgcgcgcaaggcccgcccagcccccacatgccagccccaccctccagtcggtccggacgccgacgcctttttgaccctcgctgtgcccggccctcctcatctggcctgcccagggcttggtgctggcggggtccagctgctccaatccctcctcctctgctctgccctgccctgccctggcctgccccggcgccctccctcagcccgggtatcaggcgagaggcggagctggcccggcgcgccccgcccccgctgtagaaagggccgggcgagtgttactcgcggtcatcccggcctgggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggtgggtgcccacgccccatcgctgccccggccagcttggttgcttgagctcaggcttttcggagggagaagttgtggtggtggggggacacccttctccccgcggccgtaggtgggcgaggaggtgggactgcccagccgcggggagccacccaggcgccgtcccggacgagctgtagccagagaagggggtgcgcgcgggcaagggcgccaggccccctagcagggtgaataatctaatctgttctttcgtctccgtgtatcaaacaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtcaactaaattggacaagcgtctggtcctcattaatctgccaatgaatggtttcgtcattaaataaaaatcaatttaattgatttactagcaaaagtaaa

SEQ ID NO: 4484 - DNA, 2315 bp, human
ggccttgcgcgcgctccccgcgtgggatgaccagaatgcacgtgccttggttgcagagtgagcccctcagccccgaatctggagtggccgcggccgggaaacaggaacccgggtttattattagccgtcggggaagaggggccggcagcaggtacaactccatcctgggactcttacgtaataaagggtgaccgggcatgctgggtgcacgtggacgcgcggtgctcccgcagtggccctggccttggtcagctatggggggaggggagcgtcagaggcttttgcctccctcctggcggggtgggatctttcccaatctttcctttaacagtggttgccggggatgaagaggggcacactatcagatctgctgattctttgaagagatctgcaagtggcaatggggagaagtccatttttgtccaagtcggctacacagtgatgctggagagcctgggccatgtggccttttggctgccaagaggccaggagagggtgacagtagttaggtctagtcttgggtgtctttcaccatttaacagagaaatggggaggtgtctaattatttttgagggtgcttgtgtgaagtgttcctttcaaaagatagttcttaaagcactgggtcatttaatagggcctaagctatgtaccgaatcgctggatttaacttttaagagccttgcaccttgaatttcactttgagacttccaaaccacagcctatttaatttttcccatctcatgtcccttgccatattcctcatccaccagtcctctctggcagtcctacaattatgttcaataagattcaagcttctcattttaaatcccttttctcggcctgaaacggtggctcacgcctgtaatcccagcactttgggaggccgaggcgggcggatcacaaagtcaggggttccagactagcctggccaacatggtgaaacccggtctctactaaaaatacaaaaattagccgggcgtggtggccagcgcctgtaatcccagctactcgggaggatgaagcaggagaattgcttgaacccaggaggcggagttgcagtgagccgagatcgtgccactgcactccagcctgggcgacagagcaagactctgtctcaaataaaaaaaaaaaagatcccttttctctaaaacttaacagaggtctctgtccctagtacagttttttcccacgggacaaaaaatgcctaaggaagggagaacataataaaggggtttctttctctccctctttctttcacattaagacctacacttaaatattttccatagaaaaccatcttcctaattgtcttttgaatgaaattctgacttggtgccacaaggactaatctgttgacaaaaaacaaacaaaacaaaacaaagtcagtgacccttggagacagacctaagtctgaggacccactaccccaaaacgtattagctctacatcacagcccatgttttcttacttgcaaaactgggatagacctatcagggttttgaaggaagatcaatggaaagaaaaatacagggaggcaggaagcattatataactttgaagcattaaaataatttcaccttccttctctgcacacatagaaacttttctagcctcagtttctttatcaaaaaaatggagcttgttccatgggccgtgccaaggactttgattaagtttaaatatgataatgtaaataaaaatcactatgtaaattgtaaagtacaaagattaattgtacttgatacaggacctcatcatagtgagaggtgtttatgtgaagagtcagaaaccttaaaagtgtggaaattgcctatgatgagccacagatccttccacccaacccccagtgcttaagcaggaaaataatataaaatatgtccaatgagattgaaagagcactgcaagaagaaaactcgagaaaaacagatatacagtttctagtagctgatcttctcataaattaaagcgtactttgtcccccttcctggacccatttggtattttaagtacgtatgcacccggatgaaaactcggtattcagacttaacttactaaatgccaaaatcttgcctctttttctcttcttcccagttccaacagtgtgataacacacggaaaacggaaatccaagggatctagcaaaaggattccacccagcaaaaacgccagcttgggagagggcccctacctaactccttccttctggcctccacccctcccctgatacgtttccttccgtctagtctcgagataacccttcatcccccagtttcttgactctggccgctgttcttgaacatttcttaaacactttc

SEQ ID NO: 4485 - DNA, 4979 bp, human
ggaccttttccttctggagtttccccggcgggtgtgagttgttgcggggtctgggggagctgggaggcccggtttgggaagttttgcaggcaggtgcatgagccatctttctctgaaagtgtttaagaaatgttcaagaacagcggccagagtcaagaaactgggggatgaagggttatctcgagactagacggaaggaaacgtatcaggggaggggtggaggccagaaggaaggagttaggtaggggccctctcccaagctggcgtttttgctgggtggaatccttttgctagatcccttggatttccgttttccgtgtgttatcacactgttggaactgggaagaagagaaaaagaggcaagattttggcatttagtaagttaagtctgaataccgagttttcatccgggtgcatacgtacttaaaataccaaatgggtccaggaagggggacaaagtacgctttaatttatgagaagatcagctactagaaactgtatatctgtttttctcgagttttcttcttgcagtgctctttcaatctcattggacatattttatattattttcctgcttaagcactgggggttgggtggaaggatctgtggctcatcataggcaatttccacacttttaaggtttctgactcttcacataaacacctctcactatgatgaggtcctgtatcaagtacaattaatctttgtactttacaatttacatagtgatttttatttacattatcatatttaaacttaatcaaagtccttggcacggcccatggaacaagctccatttttttgataaagaaactgaggctagaaaagtttctatgtgtgcagagaaggaaggtgaaattattttaatgcttcaaagttatataatgcttcctgcctccctgtatttttctttccattgatcttccttcaaaaccctgataggtctatcccagttttgcaagtaagaaaacatgggctgtgatgtagagctaatacgttttggggtagtgggtcctcagacttaggtctgtctccaagggtcactgactttgttttgttttgtttgttttttgtcaacagattagtccttgtggcaccaagtcagaatttcattcaaaagacaattaggaagatggttttctatggaaaatatttaagtgtaggtcttaatgtgaaagaaagagggagagaaagaaacccctttattatgttctcccttccttaggcattttttgtcccgtgggaaaaaactgtactagggacagagacctctgttaagttttagagaaaagggatcttttttttttttatttgagacagagtcttgctctgtcgcccaggctggagtgcagtggcacgatctcggctcactgcaactccgcctcctgggttcaagcaattctcctgcttcatcctcccgagtagctgggattacaggcgctggccaccacgcccggctaatttttgtatttttagtagagaccgggtttcaccatgttggccaggctagtctggaacccctgactttgtgatccgcccgcctcggcctcccaaagtgctgggattacaggcgtgagccaccgtttcaggccgagaaaagggatttaaaatgagaagcttgaatcttattgaacataattgtaggactgccagagaggactggtggatgaggaatatggcaagggacatgagatgggaaaaattaaataggctgtggtttggaagtctcaaagtgaaattcaaggtgcaaggctcttaaaagttaaatccagcgattcggtacatagcttaggccctattaaatgacccagtgctttaagaactatcttttgaaaggaacacttcacacaagcaccctcaaaaataattagacacctccccatttctctgttaaatggtgaaagacacccaagactagacctaactactgtcaccctctcctggcctcttggcagccaaaaggccacatggcccaggctctccagcatcactgtgtagccgacttggacaaaaatggacttctccccattgccacttgcagatctcttcaaagaatcagcagatctgatagtgtgcccctcttcatccccggcaaccactgttaaaggaaagattgggaaagatcccaccccgccaggagggaggcaaaagcctctgacgctcccctccccccatagctgaccaaggccagggccactgcgggagcaccgcgcgtccacgtgcacccagcatgcccggtcaccctttattacgtaagagtcccaggatggagttgtacctgctgccggcccctcttccccgacggctaataataaacccgggttcctgtttcccggccgcggccactccagattcggggctgaggggctcactctgcaaccaaggcacgtgcattctggtcatcccacgcggggagcgcgcgcaaggcccgcccagcccccacatgccagccccaccctccagtcggtccggacgccgacgcctttttgaccctcgctgtgcccggccctcctcatctggcctgcccagggcttggtgctggcggggtccagctgctccaatccctcctcctctgctctgccctgccctgccctggcctgccccggcgccctccctcagcccgggtatcaggcgagaggcggagctggcccggcgcgccccgcccccgctgtagaaagggccgggcgagtgttactcgcggtcatcccggcctgggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggtgggtgcccacgccccatcgctgccccggccagcttggttgcttgagctcaggcttttcggagggagaagttgtggtggtggggggacacccttctccccgcggccgtaggtgggcgaggaggtgggactgcccagccgcggggagccacccaggcgccgtcccggacgagctgtagccagagaagggggtgcgcgcgggcaagggcgccaggccccctagcagggtgaataatctaatctgttctttcgtctccgtgtatcaaacaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaa

SEQ ID NO: 4486 - DNA, 126081 bp, human
ggtatttccgaagctggccaggccctctgctgctgaccctggaaatcgggtcacactagacaaggctgcatgtgcggggagaaggcgggggggctcctttgcacgcggctgctcgcgtttccccaaggcctccaaatagtctaaaaactcacctcggaggaggagaaagagcgtgaagtggctctttcgatctgagacaccccctcccggagaactcgccccctcccccccagcccagagcggagtgaaatcttagaagccgtggctgctgggtttgaacggaatgctggagtcagtggaagacggagctggtcggcccgaaggtcagcgagttgttttgagttctcctacccggaaggtagggggtggggtggggtggggagcagggagtagaggacgccagggcccccgagagaccccgcgtcagagcaaaaattgtttgtgccccggaacaggcagctcagcggaagccgcgacgggggcgggtcacgtgcggcggtggcggcgcagctggcgggggagccgggctgggacaagggccgggccgggcgggggtggcgcggggcggcggctctcgcagccgaaggtggaaccggctgactctgggcgctgggagcgagcggctccccgagcccggagcgagggaggagcgcgagttatggagggaccggtgtgggagccagggcgcgcggagctccgcgtggtgcggcacgggccggacgaggaatcgttggggggcgggggcagggacacggaagcgggctcccggggcgagagcggaaccgacgcggaggctgcgagggcgtctgaaccccaagaatggagtcgccgctcttgtagtcgccggccttgttttcttcttgcacgcaaatcccggaacgaccggaaccgccatccccgcctgcgtcccaggggcgccccattacgcatggcgggggggcccgcggggctactccgggaggggatccgtgaggccgaggccggggagggctgcgaggtggctcgcgggggtgcaagccggagcggggctacacaccacacaaacagcctccctttcccccggaagagcgggcgagggaagacgcgggctagctctgggggctccccaggactgtgggagccaggcgaggaccgcaaggcggaagggagtgctgcagacaaaccatcggccccacctggaagacattggtggcctcgtggccggtggtgaacggtctcacgcttccccaaagtggcgtgcgctactctagcgtgggagggaaaggacacaaacttggccatctgccagaacccttgaagacgcctgtctttggtgtccctccgccccccgcagtggcccgaaatgtactctccctcccgtagtccacgaggttcaggtccgaaacctggaaaagtagggtagcgtggtctggcctcggacgggaaacccacccacgttcttctgaggtgccacgcggggaaggcgcggaacagtcttcttgcaaagtttcccgcccctcaccccagtcgagtaagggcggctcttccggaggtgggggcggggaacggtctcgtagcggggagtggtgctagttcctcttccctgcgaccgctcgggccgcctgcgcgttcgcgtccccagacgctgcaccccagtttgctgcaacgtctgcttggagtcgcggtagcgggtgctgcgcggagtctaggacgacgcgagacgccatttgcatcccccctccctcctgcaggttggcgagggcggcggtgtcgcccgccgcggaagcgtattcctggcagtgacactgattagatgctgtgtcgatacgtgcacagaatcggggtgggccttcacctctcgtgtgcgcacacactttctgttggaaaagttgcgatattttttctccccctctcgccgcacagctgctgtctcccgggcggaattaggcgaccacgtttgctcaacccgaaggagagaggatcgcgcgggcgctgggcggccgccgggcccgggccgcgaaaatccagccctggctttgcgtcgagctgctgagtgccgcgcttacgcgcgcggggccagccggggcctggtttccatctgccccttttgcctccgtgttaagttcgccggggaaaacccaacgatccgtgctgagcccctcggaggagagcccccgccccaccccacccccagcccgatcccgaccgatggaaaaaatgacagtataggtcagaacaggctgcccgcgagtattaatatggacggcctccgttcctggtgcttggggaggatgggcgcttcgccaggaaaccgccgaaggaggcgccatgagggccgcctgccccttctcgggctagaaaacgtggattctcagagggaccagacaaatgtggtcagatagctgcaggaacttaccccatctaaatacaggttgcccgtgtatattccaaccaagatcatttttgtttcaatctaatacacgttgaatcaattagaaatactgtgagaaactgtggtcaaacggtagataggaaacttgctctttgcctaacattaaatgtatgctcaggaggtgcggggctgagcactatcggcgcagccagtctgtgtcctaagaagacagggtcccctttgcgttccaccttccaggaccttaatagaacgcgaagagaggaattattttagttgtagtttctattagagggttgcttactccttgcaaactcccgcctggggttgtcggtagttagtagtagatggttctgcgttttggcttttacagtccacgtttttctcttggctttttcttttcctgcgtacacgctgctgggtacggggagggggctgcccagacgtgtgctgccgccgccctcgggctctttcttgcgcaccacgcggcctcggaggaggggaaatgtgaactctccgggtggcgctcgagaactggaattctgatttagggctgcgggtttgttccggaggctggctgggagcgtcttgtaggggccggaggctgtgaaggggaagccccagaggtgaccctgaggcctcagaagcaaacctggaggcgcccgtgttctttgtctttctcggggctggcagcttggcacgcacagttccgataaggatctactgagagctagagcgcactgccagcacatttcagtgattaggcaaacgccggtagccacttaaggcaaaggccatttgcgttgtgtttgaaaaggaaaaggcagcctcacctaatgaattatgggtgaccctggagaggccaagcaggggaggccgaggcctccctaggctcttatttgccgcaactcctcccctttttgccagagtcgccatttcaaaggtaatgggaagccttttgaaattagaagtctgaccgattctgtctacagaagtggtatttgcatctgtgcaccagtaaaatgtggcccgccagcggcccagggacaaggcctgccatacgccagccctgcaccagtgttagaccaaagtacatcccagaggacatggcttttggccaactcctccgagaactgatttaaagaggtggccttcagccatcaaaaaaggtgtcctggaagagtaggctggaggtcctggaaaccagcgctcttccccagggctgcagggagagagtgggtaatggtgcctgagccctgacggaacttgctattaatccagtctaaatgagcaccattaaaaaggactctccctcctatccaccaccacacacacacaagcctttatgggacggtctagtggagacctagacagtttgagggcatttggccttcacttttcagtggccatacaatagtgccctttccaccctgccaagaccactggctccatgtaaacttccaggaactttaacccggaactttgtactccctacccatccaaagggagtgccagatcatagtaacaaacacacgtagcattgtactggaggcagcgttctaagcaccttatgtatggaggcatgttatcctcagaacaaccctacgaggtagataatagtattggtcttattttacagatgaggactccgaggtttcgaactgttaagcggtttgcccaaagccgcacagcttgggataatagggcctggattgaccagagggagagatagggcctggattgaccagagagagaaatagggctgtgttgcctctctagcgttttgtaatgaaagtgatctgtttgggggttgtttcgagaggactgcctggaccccaaccttccaaaggaaaatatgaagagactagaaggcccaacatttggcctttattttgcaaaagaaagttctggagagtcgtacagaggcatcttactgtggctcctccgcggcaaggaaggggtcagggaaggcaatgcaaaggcccccctggcccacctagctgcatagcatccggcggtcacgtccgccggaggtgactggggactggggacagccgattgccgaggaactccttatcgcccagtgtcagtgctcccgggtgccggagctaaacgtccgcctgcgggggcggctagttcacaccagtcccctggctcccgacgcgcccccgggcttctcccgcggagctggctagatgcccggcggcggctccgaagctccgggctccccgccgcttgtcccgccagcccgaggcatggagccccacggcccaggactggagagcccagttcgtcagtccaggttgggactgctggttccgggttgctcacgatcactctcccctcaacacccgtccggccagggcgcgcgcgcagacacataaacacacacggcttccaagcgcgcagcccgcctcccgggcctccgcttttccttcctcctccccgctcgggcgcttcggaagcccgtggcggttgtgtgctgcgccagggaagagtccgggtcggggagaccgcgctgccctctttccccccaaggtctgcgcgcacgctagtatccttaggaagcacagtcaggcttgtgggttcccatcttcccgggaaatgacggctgctggcgaggacctgttcgctccgtgtttcgcaatggcccggggatcagaggagaggaccgggcggtggggcctgcgcgtggatgagggtggcggtaaatcccctctcccgcgaaggtggctgagcctccggccaccgctagtagtagtctaccctgctcgtcttgcattggccgcagcttgactcccctgcgtgccgcgggtcggtgtgggtgtccccactccctcaagcctttactttcagctcgcgaaaccccatggatccgcggctgggctgggcagcgcagacgcccagctgccctcgccaaccccaggcccagagggggccaggctggcctgggggctgggcggcccggctgcacttgccggcgttgagagaggctctgtgagccggagccggccgccgagccgagggagagagcgcatcagcccgcgcgccttaaggcagaacacacgcctttcccggaaccttgaaacccaggggagccgctgccatcttcgcgtgacgagcagcgagacgccggtgattaagtgtttctttccggctccctctccgggttgcggctctcctcctttccacagggctggaagaataaaaacctggggaaaaaccacacacaactgcgctctggtctcgctcgccatgtccgcactggtttcttagggtgcgcccacgcggggcaccccctgctcccctactccacgcctggccggggtcgagggctgcgtgcctcggtttccatccgctctagcgcaaatctcggagtttaatggggagggggcacacattgctgaagccacccgacccccattctccttacgccccccccccatggggattaaacctaaacacatgaatcccccacccatacccgggactaatccagccgcgcctcctgggattaactcggctcacaggtccataaaacacttccggcgcggccagagggtctgtctgcagaaacactttaaaattgtcctcccgggcctggagtcggaattgactgggtggagggaagtgagtaaacagacagttgtaagagacaatccgtgaggtttgcaggctgtgaaaagagctgcttaaaatatgggctgtcggggttgcctccagcaggagggtggcccgggtcctagcagacagatccaagaaaaggatgcaatatattctaaatgacattgacctggaggaaggagggtgtaggcaggagcaggctggcttcacatggcttctggctccagttcagtgaggaagactagcttccagaaatttgtgggggcgagtggccagtctcttcatgtgtaaaatcagaacagtaacacctactctgtccccctcggatgggtttctgaggaccaaaatgtgaaggcactttgtaaatgcggctcaacccttctgcttcactgtggttaatgttcagtctctcttaggtagaaaaaccagtgacttgctgattagaaaacaaagtagaaatcagccctttctcaaatctacgcaacaatgttcgagataaagggaacccaaaagcaacctaatattttgaacctccttttacatcatttcgagataagtttctgaagtaatgagagaatctttggaatgttctaagaaaatctgtcaaaaactggaggttaatggggaagaaagggaggctttaaattgggtcaaatcacattttaagaaggctgggcgcggtggctcacgcttgtaatcctagcactttgggaggcgagatgggtggatcacgtgaggtcaggagttcgagaccagcctggccaacatggcgaaaccccgtctctagtaaaaatacaaaaaattagccgggcaaggtggcgggcgcctgtaatcccagctactggggaggctgaggcagaattgcttgaacccggtaggcagaggttgcagtgagccgagatcgtgccacttcactccagcctgggcaaaagagcgaaactccgtctcaaaaaaaaaaaaaccaaaaccaaaacaaaaccggaagaagaatataaatttatagtagcttcctggctatatccccttctgttagtctgcagaagagatgcccgttggtagccattcccccagccccaggaccgaaggacgtcttgactcaggcttggtctgctaggtgcaaggtgttgttggcgtctggggtggggacagtgaagaaaggcgatcattttgctttaaatgaacatcagaagacccaggcctgctactgcgtcttgaaggcctggagttgttaaaactctgtgggagggggtgcctcgtgacctccttcctcgcagatgggctcaggcagcgtgaccggccccaggtggtgcccaggcgcgctggggatggaggcccaggctgcgcgttcaccctgcctcgcagatagcgagtaggggcctccggctggaccgcccaccggccttactctcccttccctggccttggggccttggaccagggttaaccctggtcccgtctccacctcattgccccccgtgcagcgccgtccccgccctggctcccggcccagatcccgaggcctccctcgcccagcagtctcggttcttccccctcgtgattcatttagcagcggtgcagaaagcctgtttacctccgcagccctgggcgactcgatctgcgtaaaaagccccaacgccagctccgaccagtaggggggggattgtcctatagattatttctcctcctggtttttgtttttgtttttttttaaaccagaaggcttggttgaagagggggtggggtggcgtgttgctgctgttttttaaaacaccgtatttgaaagagaaacaaaagccacacaaaagccgtttaggaggtaccaagactgtttttacatataaaaagtgcagcgaataccaaggggcccccaacagtgataaactaaatggttggccgatttcgacaattaacagttaatctgttatctgcgatcagcaaacaagttttgaggctcgaaggacaccgaattcctgttccagtcgatagcgttgtactcgaatctgttgagcacatcagatgctccctgtttctcctagagcgaatccagctttagcaaacatgggtttcccaggttgaaggaccgacttgagccagagaaaattctcttgtgcagctgaggagcctctgtctgcatcgcccctcgagcccgagctcatctgtttggtttagatttctccaaattggttttcaccccgatttcgcggacctcctaattttgcacgtaataggcctccgataaatgtgtactgaatggcagaaactaaagtgaggccctcggcctggaagacggcctgacgcacggcctcgcccttggaaccccactcgggttcccagagcccccaggccgctgcagcctgcgcgcagcttcgccctgcgccggccagggcgggcgggcgggggaggccaggaggcacgaagcgcctggagcctgcacgatgataaatattgcgcagacagcccataaataatttgcattatgttcagctgacaacgcggggcgattaattttaatagctacatatttgcctgggctgctgctttcgtaggccccgtaatgaaaggcgagaggccgccctggctccgtgctcgcggtccaggaaggcagccgggggtgcgggaaggcccgatgtggcgtctcctccaggcagccccccggggagccccagccccttggcccccctctcgccctccgtgccttgtggaggtgaggtgtgcgcgcaccgccggagcacccccgaggcctcgagcaacaggagccaccataatgacactgcacatttgtctgtgtggggagagccacttgtggactgggagaccctccacgtagctttgtgccccacccggaccaagtccggagtttcaggttccacttaggctaggaggggggtgtttgccgccgccaattcgccagtgggccccagctcggccgaggcttctccgccctcccggcagaggcaagagacaaaacaaagcccggctgtccccgcgtcctctccgcgcgtgtagggtcctgagttctgcctcccaggagctgtccggcgctccgcggaaggcccccctaaaatgcttcctgagctccttgatgcaaaaggaccgcacacataaaggacggaagaaaagaaagggtctggaggagctctttaaaagagggggcagggaaggaagcgcagcgaggaaggacgcggctgccgcggtcccgtggtggccgggtgcgcgcgtgtgcgtgtctgtgtgtgcgttccgatgacaaagccccgccgccgccagcaagctcctggctgccagagctctggtgggggaggggaaagggaggagaggagccagcgctagcgtaggtagcggggaatcgaagcttcccaggagaaagagttcattcatgagctgtaggaggcctcgcggcccggccaggtggagcctcctgaagccaacacctgtgtattttcctttttggaaacaggcgagcccatcgatcattaccatattttaattgcctttcgcaaaggtcatctctaattatgggttgcgaggagggttggtcaggagtccgtggccctttattatctgtgtgggtgtgtgtgtgtcgccgcagagacaatgcgcccagctcttatagaaatgccaatccgagggtgtccgtgcgcgcctgcgaggcggtcacgacgtgctggatccacgcagaccaggctgcgtgcacaataaaagccgagcaggcggctgagggccgcgcagacccacgggttttctttttagaaacagtggtgcgaagagacttgacaataataacacgcagcaggattaaatcagggcgggaataaggaaatgtattttcgtttctagaaccgcggactgtgtttaacccatccgatcctcccctccccagagcattttgtgcacacgtggagttccgcgcagggacaggcgccgggcacagagtggcttgggactgcccgatgacgttccagggcagccacgttacgttcatattaatctcttcccttaattcggcatggttgtcagttacagtgacgtgaaacagccttaacgatgtctgttttatgggaaacaatacctggctagttgaaaaagagaaagcaaacgttgaggttttttaacttttgaaagtttgcatttccttagtttttatcactgtcagaaacccttgtggcaaaagcctattttaacttcctccgagggagaagagcagtggagaaggtagatggagggtcaggggttcttgggaggatattttggagatggagggaggtggagatcagtgaagagctgtgagtcaggggtggtcagcagccactctgaacttgattttctcaaaggagcctggcacttctgagccccgatgctgtttctggtagtccagcctgacaaagtcagaggctggggtcaggagcctcagagagttggagagttttgtactggtcctgcttcctgcctgcccccacacctggcctcctggcctcaccagcagccagctctgccctgaggaaggcagagccagatgactggtccaaccccccagagaccgcctggctttctcctcccctgtaatcataaccagatgcacttaagcgcctttcatcagaggaagcccaaagccctttaacaggcttcaataaaagccttttgagggcctaccagcctgctcagcgttggggcccctgtgcccactttccacctgagccagcctggggctgcagtcagggtctagcctctcccctggggccccagaagccaaggaagtttactcaactaaggcaacctctccaagcaggtagggtgccaagattcctgccaggtgtgtgggttcagacctcattaacaggaggaaagaaaggcatgggagggaagccagcagctagtgtctgtcttaaggaaggacaagaaggagcagcctatgagaaggaaccagaggggctaggaaatagagccggggtgaaggggcagtgatgatggagatgttcacaaagactcccatggtacttccaccaacccgaattcagaggtcagagctgctgtcccactgtgttgcagtctgtctcccttactaaactgtgaactccctaaggggagggactgtcttattcacctttgcaggcccggcccgggacctggcacaaaataagtaatcaagatgggagatcacaagctacgatggaaaactctggatcaagatgcatacgggcttaagatgggagctctgcccccagtggttgtgtagcctatctgagcctcagtttccttatctacaaaatgggtatgagaatgcctacatcaaaaaattggagaaagatccgatgaagtagttgcaggtgaagcaccaggaagatgataataaagtttttaataaatactgtgccctagctgggtgtggtggctcaggcctgtaatcctagctactcgggaggcagaggtgggaggatcacttgagcccaggaggtcaaggctgcagtgagctgagattgtgccactaagtgacagagtgagactctctcaaacaaagcaaaactagatagatagatagatagatagataatctcatgcccttgctcttgaaggagtgaagagaggatttggactgatattgtttgaattgtaagtaggaaggtttgtgttacaccctagctaggcacaggtctctctggcctgggatttggatcagaagaaggaattgtttctaaactgtgtgaattggagccacaggaccccactgcactgtccaacagggcaagcagctccaaagctgtgaacttgggaagccaagccagccttggtctcaggctctggggaaggggcaggtcctagacccttggactctcctgcacagggctggttgtggctggggcctagttgtgcactgcggaccaggctgctggagatgagtggctggcagataatcccagttggtgctggctttctgtggtcaagaggagaactgccccttcagctttgacctctgctccagtaatcatggctgtattttatttttggcgggttcatcctctggcatttggcagggcggggaggggaagcggggttgcctgcgtctctttgctattccttctggtctgctcagtagctccccacctctcatcccccaccccaccccacacaatgtggcctggttttctccccattgcaagctgctttatcatttttgcctgttccctggctgctctgcttgtttgagagtgggggtaagacctgggctctccccattcccctcctcggtccatcacattccagatgtctttcagcccctcctcccatctccctgagcttggcacttccccaggagggcagcctgagggtcagggtccatgggccgcctgggcatcaggggcctgtgagtgcctggctcagagaaggaggaaatggtgggggacagaggccagctgcactgctgcacattcctagctttgtgaatggaagctcatggcatttggtgtgtgacacaagtctggtagtcggggtcagaatgaaaaggtgtgggatttgtaggggaattgggaagaaaatgaagtaagctaacacttcttgcataattcatccctccctatccctgagatgagcaccctccaggagaggcaagaaaaacaagagagaagagaagagaagggagagcaaaaccagcctggtggaaatgctttgcccctctcccttcctgcctagggaactggctcccttgtgcagccaatgtaggtcaggaggggacaatagttagggtcctttacccagatcctctagggaaaatgtgagatcagatttgaggaagacacaggtcactgtcctacagggatttcagaaagaataagacactgcgttatcaaaggtgggggatttgggttatgatcagaaatttccttaaaaaaaatttcctgcctgtcacacttttgtttttaacccagttcaccttcttccatggatttagcaataagttatgaaattgatctcttcccctatagcatgtcagctacaagggagctcagaagcaatttaattctgctcctggaatctgtgggtccagaatttggtggactcaacagctggaggctggaagcatccggaggggtctttactttatgtctggctgttggctgggacctcagctgtgtcccatagcatgagcacagggctctctatgtggcatgggcttcctcacagtatggtgccttgagggtaataggactttaagttacaaatcggcagctcagggctccagaaaaccagcattgcagtaaataaggctgaagctgcatcaccttttttttttttttttctgagatggagtcttgctctgtcgcccaggctggagtgcagtggcaccatctcggctcaccgcaacctccgccttccaggttcaagagattctcctgcctcaacctcctgagtagctggaattacaggcatgcaccaccatgctcggctaatttttgtattcttagtagagacggggttttagcatgttggtcaggctgttctcaaactcctgacctcaggtgatctgcctgcctcggcctcccaaagtgctgggattacaggcgtgagccaccgtgcctggcccgctgcatcaccttttctaatccacccttgaagtctatattcattggttgcgattgtggtcacaaacccatccagattcaaggggaagggacagagatcctacttccacttgggaggagtgtcaaagaacttgtggccatggtggggtgggggtgggggtgggaaggtggtaggggaagccataccaggcacctttgagagctaagcttaattagcagtagctctaaacagactagtctacattgtaataggggtttctaccctcaagaggcctcataaattatatgggggcagggggactcagagagctaaaattaggccagggtaaaagaaatagagcctataaagcaaatatggattttaggaaaaatagaaaatatatcaagacagctgtctctatgatcttgtccaatgtgggaaggactgagggagaactgagtggtgggatcagatgggttttaggctcttctgcattgaaagggaagcaggtaaaagattagcattctatctgccgccatccttagcctactgtcttggggaagatctagtaacccttcatcgctcccaacaacattattttcactattgccttataagtcaccgccccctctaccaccagtatacagctatctttatatggtacaaagctaggaatgtagtcaatgcatttcctgtagtgtgtatggaaaaacaattaatacttactatttgtgccctccctgaggtgtggttttaaatatccagcatggatagtgttgtgactgaaagggcctgggtacatctctagggccccaggttcccattatccttgtctctaacccctgaatggagagtttgacttctaatttcatgctagaggtttcacgggcataattgtatttgcctctgcctttgatctgctatttgatctgctagtttattgtgggttcgactaggagacacagatagaaacgtggtggaaaacatgattttgttttgcttgggaattggcagttattattttctatggctcccttaacatgacacatcttccctaaatccaaaatctaatcattttcccatttttgaaaatccaaaaggcatgtgtaccctctggcctgctttcctctcccctcctgaagatttcattttcagtaagactttggaggcatgacgttcagattttagacctcagtgcagattggagccccgaattagtgtaatacacctgggtgaactctgccacacctgcccctttcctgacctcaccacggcttcccaggatgtatctggttcaccctagcctcccttgaggtgattttgggtctgcagggccaactcctatcctgagacccaaacaaagaaacccagattcagcaggtgggtcagaactaagcgacattcaggggatggcccttgaaataagctggcttctcaggcagggtcactgtattacattgtacagtttgtgtactgcacaaaggtccccagccaaaacacagaataggctactggcagctctgttctcagggcaaaggagaaagagattatgtctctgatccagaagaaaagagaaggtgacacaggacagatagaggtcaaaagggtttcttgggagcacactggatcagcctaagactggaccaagccagtgttgacccagcatgttggcgcggtaggcctatatacactctctttgttttgttacctctcatctgcaggcactggttcgtaagttattgggtccctcctaggccttatttggagtgtgggtgggagaaggacaggagtgtcaccctacttatgtgtcttgtttagccagcaagatgggatttgtttcttgggcagagggagtttctttggtttatgaatatgaagattttaaggcatattgttcactgcagaccgttatgtacttgatgtaggtgtttgagtgcaagaccctaacagggctaggcgcggtggctcatgcctgtaatcccagcactttgggaggccgaggcgggcggatcacgaggtcaggagatccagaccatccaggctaacacggtgaaaccccatctctactaaaaatacaaaaaattagctgggcgtgatggcgggcgcctgtagtcccagctacccgggaggctggggcaggagaatggcgtgaacccaggaggcggagcttgcagtgagcccagattgcaccactgcactctccagcctgggctacagagcgagactcagtctcaaaaaaaaaaaaaaaaaaaaaaaggggagaatcggcctggtttctggctcacacctgtaatcccagcactttgggaggccgaggcgggcggatcacgaggtcaggggtttgagactagcctgaccaacgtggtgaaaccccttctctactaaaaatacaaaaattagccgggcatggtggcgctaatcccagctactcaggaggctgaggcaggagaatcgcttgaacctggcaggcggaggttgcagtgagccaagatcgcgccacttcactccagcctgggcgacagagtgagacgacgtctcaaaaaaacccaaaaaacaaaaaaaaaccccaaaaaacaaaaaaacaaaaattagccgggcatggtggcatgaacctgtagtcccagctactctggaggctgaggtgggagaatcgctccagcccgagagccagaggtcaaggctgcagtgagcccagatcgcaccactgcacttcgacctgggcaacagagacagaccctgtctcaaaaaatatgtaaataaataaaaattaaaaaaaaaaaataaaaaaggccgagttcggtgactcacgcctgtaatcccaacactttaggaggccgaggtgggcagattgcctgagctcaggagttcgcgaccagcctgggcaacatggtgaaaccccgtctctactaaaatacaaaaaaaaaaaaaaaaattagccgggcgtggcggagtgtgcctgtagtcccagctactgaggaggctgaggcaggagaattgtttgaacctgggaggtggaggttgcagtaagccgagattgtgccactgcactccagcctgggcgagagagcgagacaccatctaaaaaaaaaaaaaaaaaaaaaaagtagaggatcatctgaagaaagaaattccaatcaaaattaaacaactccaaaaaggaacttttctagtgtcagtaatgggctggttgaggaggtctttgggagccttctttttattgattgactgattttttttttttttttttgagacagggtctcgctctgtcgcgccgctgcactccagcccagcctgggtgacagagtgagactacatctcaaagaaaaaaaagaaaaagtaatccggccgggcgtggtggctcatgcctgtaatcccagcactctgggaggccgaggcgggtggatcacgaggtcaggagatggagaccatcctggctaacacagtgaaaccctgtctctactaaaaaaaaaatacacaaaattagccgggtgtagtggcgggcgcctgtagtcccagctactcgagaggctgaggcaggagaatggcgtgaatccgggaggcggagcttgcagtgagccgagatcgcgccactgcgctccagcactccagcctgggcgacagagccagactccgtctcaaaaaaaaaaaaaagtaatccatgtcaaccatctgatggtggagggggatttcagatctctgtaccatactttcccttctccattcttaccatagcactagagcacaatgccttactaaattcatatccagtgtttactttgtaaccacatatatatcattcattgctgagccaaatgagcttcagtgattgcagttcctttcttgtaagatttttttttcctggagttaataattgcctcatttttatatttgcctaattttctttgacctatgactacttttcccatactttccaacctctgtacaattaatctgaggacaattttctgcatgtccaaatcttgaagaccatctgcaaatgggctgatctttttttgctttgtgtttctttttttaatccctattttctttaaatctgaaaactttttcaaaaagtttccaatcttccatttagttttattttctaaaacttttggccgggcgcggtggctcacgcctgtaatcccagcaatttgggaggccgaggcgggtggatcacgaggtcaggagatcgagaccatcctggctaacacggtgaaaccccgtctctactaaaaatacaaaaaaaaaattagccgggcgcgttggcaggcgcctgtagtcccagctactcgggaggccgaggcaggaaaatggcgtgaacctgggagccagagcttgcagtgagcggagatcgcgccagtgcactccaacctggacgacagagcgagactctgtctcaaaaaacaaaaaacaaacaaaaaaaacacttttatgaaatgcggtgggagtttttactgatttcaaatggggtattgtgttttggtgggaaattgtgtctgtcccacccagctaatgtcaagagctgagaaattaatccagagtttctgatatttgatattttgcttggttgaaataaactttcatcatttttcctaaacaacaacttttcagaagtaatgactgttagccccgggaaccgtggaaatattcagtattagtaaatctttaccctcccctcccccccgaactgattctacatttttagaaataaagattatttttaaaataattggcctttacccaggccatttactgcaagattcatgccctttatttacgttcacctcacggtgccttttatttgtgttcagtcatttacaagtctgcctttccaactagattgtaaattacttgagggggccaaaggtgtcttttaaaaattcacttctgtacttttggatccccctaggtcctaacacagcgcctcgcccttagcaagcgctccataaatgcatgttaaattcaaaaagtggacaaataaagttccagtgttctccaatcaggagccctaaaccgtggtaactctcaaatcctctctggcctcaacagcgccctgtgaacggtgggtaggcctcgccccccacccccagctgcctcggcaggttgcctctggggacagagttctggggtgcgcgggagaagcgataacacgttgaccatcgcgggagtccgggaaccagaggtcgtttctcaggattaaaatccgctccagcgtttcgaggaggggcgacactacaggccacgctttcaccagggacggccgccccatcgtccccgacctgggtcagcgtggcccgcagcggggaggggggcctcgggagggagcgccccccggcagcccgggaacgcccgcgcggcagccccggcccagcctgcggctccgcggtcctaccgccgggggcagcgccgcctgcgcagccgggccaagatggcggccggtgcgcagccgcccgcgtccgggggagaagcggcgacagccccgtgtcagccggggcgcgcgctgtcccagggcgcgaagccgctcctcctttacccacggggaccccgagggccagtcctgccacttcgtcctgacaggccccctgcccggagccctacctggacgggccccggctgggatcgggacggccaggaggatggccgcctggctagacatggtggacaggggaccagcggggaccactgggtgccagccccacacccaagccatttcttccagccctgggacacctctggtgcgcaattcgacattagtaaccgcaggtagggcttcatgccccgtaaaaacacagggctcaaagcacttgaaatcaggaatgtcttggaaaatctgctacttctggttgtgaaatccacggtattctctagtaaaggcagtaaaggctacagaatatgtgcggttcctcacatttgctgtgacatcggtatgcgcgcagtgtaggctgcctgcctcctaggacactccaaaacctgaggtccaatttaccagaaatggcattgatgaatgcggtgcattctgagtgatctcccgctgggctcaggttgggaggtcagaagggcccccaaagggagcagctaatgcaggtagaatcacaatggtagaaacagagaagtacccagaaacggttccccattaccctttgtaaactgggttgacacctcccactggttcaaggttccaaccaaagtttgcatgttgtttatcagctcagcttgagaggcagaatgtgaactttttggttttgttttggtgaaatagtctttctgcataacatttgcaccggcttgttattcttatggaaaacacttcctccacctaccctgggcagcagccacaccagcctttacttccttctgcaggccctcttaattacctctctcttgctccagtttaggcagcccccggcactttgttcaagtacagcaataaacccaagactgggcctaatcctctgtggtcctgaccttccccacagcgggcctggagtctggagggcctggagtctggagggccttcctgctcccctgattagggccaaggacgcagcttgatgtgttttgtgttttctcccctctgcacacttggtacttttcagagtgcttcactaaaaaatcagatacaagaaaaagttcacatcagccctttggagccaggcctccgtgagctggggtcaccccaccaccaagccaaccattcgacttctaaactgtagccagggccaatgggttaccgctgaccttttgcacaccgaattcctctcctagcgttagctcgggtggccagggagcctcagctgcacccacctcctgcccggtccagtcccgatgcccctcgcgggaagcgcggtaaccttaaacggcacgacaggcggctggccgagctggttcggtgacgactccctggagacagcggcttcgagcagcaggccccatctgcagcgcagctgaacgagttaagctgccccaggcgtgagcgtaccaggctggggcctggacaggagagaaccggcggggggccccggggcgcctaagccctaggatttccaagttgcagggggaaaggtgaacctgactcccctcccgaagggctgcgtggggggctcagaagactcctgtcaggggttggggaggcgcctcgaagcggggcccagagtgaggctgctgaaagggggcctggggggtaggcggtgcgccctcgaggccacctggtcagtaaaggcgcttctgtgctgtacaagcaagacagcagttgtagcacccgaccctcgggctccagtggcccacggtgcaggcgggcaggggaagagtggctctgcgcgcagccccgggtgccctaaggtcacctcctcatcccctgccgctgctgtgccgccccagccctacccccgccccgaaaaaacccggccgcgcgggccagagcctaagctgcacgggctcctgaccccggctcgccaggctcagcccagtccgaccccgcctcggcttcacaaaggccacgtgcggccagggccgacaaggaacgaccacgactctcagatctttaattacgctaggagtccctacccttccccccaacccatcgccggcttccagccctttaatcaatttcacgatattaaatattaatttcctgccagccacggtttctcggaggagggggaggggatgggcagggcagctccgaggctggaatggctttgcagggtgtgaccacgacagcagggcgcggaggacgcgcggattcctaagtgagctgtgcccagaactcggagccactgggttttcgctctgtagctggggaacttggagagttatgagcgcctgggtgcaggcctccaggaggggcagcgaggtgcgcggagagtccgggtgtgctgggcgaccgcctcctgctccgcgcgccccccctccccaccccagccgcgagtcagcctcacgcgggcccgcggcgcgctgcgatgatggatcgcgcctggcgggggtgatttggtgttgatcgcacattatcactggcaggttggactggttgctgatggacgacttctagcggcggcggcagcagcgtcttcagacaccgcgctgggactcgctcgctcggcgagggtctttcccccccccacaccccctccctacttccaggcgccaggagggcctgagagtccgagtggggtctcctcgcgtccaaggccgcccgctcccgtctgggtccgggtgtgggctgttggctgggtgaggagaggagccaggacgcctctcccacttcctcccactcctccttcccttgccgcctgctccccacccccttcctgcttccccaccgaaacccggaggccctgggtcactccgcgggtgatatccacgccgcctgaccctggccgcgggggtgcggactcctctgctccgcagcccccgaccctctcccccggtcgcagcagccgcggcactgcggtgcgccccttctcgcctctttttctaaagtgcctgcagatacaaaagcggtttcgtaatgccttccgtctgcgagagccggaggaccttggctgacctttcggaaactgattgcaactgcctgttaacagcccgtactgaccgcactgagcggagcggaggacaatcatttaagtgacagacggcgaggtggccccggctcagtcgagcggcctggttaagcccgccccgcccctcccccgaccccctcccctcccgcagctactcccccagccccgggcgcactgcgggccgcggcgggcgctcgggcaggcggagaggacgcgcgcgcgcgtgcgtgtgtgtgtgtgcgcgcgtgtccacgattaccggccgacgggttaaccctttgccgagcagccggtccctttgaggccgggtgctgccggattaatctgccatctgcaaaagaggaataacagggccgtctccgccgactttccctaatgggtaaactgtaccctgttagcgtgacccacgctgcgtccctgctgctgccagggaaagatccggacccttggctcttctgccgcggccctgggtcccctccctgcactgcccttcctctgcacagacacagacacaaggaacagcacgaggggtccaaaggctcccaggggctcgcggtgcagtggacgtgggtgttcccggtgttttctattttggaaactggagaaaggtggggtgggggggacgtagagaaaagccgaggtgggggaggggaggctggtgacagggcacctcgggcttcgctcgctccctctctcgggagagatcgccagctgctctccaacaggcagcgccctgaaatctatttaaagagagggaaaggggaggagaacaaagggggaggagggggacggcgagcggagcctgggcgagagcgagcgagcagggaggatccgccgctccgcgggcacatcaagcgctcacatctgtacactccgcgatcgatggggagaatggataatatttgtcagctgcagacctttctcttcccggttcctggggaggggagggggcgaggagggggaggggcgggcaggccaggcgagagaggccgcctcaaggacagcgcgcttcccgctgcagccacacggaaacccagagccatgaaagccgggggatttttctcttattatcattattaattattttttattattccagagcagccagcgaacgctcggtggcgcccctcccccgccgcctccctttgttgattctcagctgctagagcggcgggcccgagccgccaccgccgcagagcacgatctgctcttgcgccctcggtcgcagctgcggcccaggaagccggggctgcgtccccgccccctgccccccacggcgcggcagccctcgcaccccctcctcgcctcccgccacgaggccagccctgcctctccactgcctctcgctgcggctccgagtccccaacgcagagcagaggcactggctgctgcggccccgagcctccggccgcgcgggggcctttgccaccccctaacccccgcggctgcactctgatgccgccgtcctcacacatggtcttcattttgcacactagcggcgtgcttcctctcagctcctctcctcggggcttttcggagcgaggagggaggtttagaggaagttagaaacccagcgagcccaggggaaagggggaaaaccctcgctcttagtctcagcttccgaggcagagggagcgccccgcggggggtggggcagagtctgggtgccctccccttccttggatgcaggaaaggttaagtgaggggtggcggtcggaggagcgacagatttgcttttgctcatccacatgcctgctcagaccggcctgggtatcactgacccggcactctcggaacggcagaacccggatgggagcagatccgccaagcggtcatcaaacaagaccaaagacatttcagctgtcccccaccctcgggccttgggcgagggtgggggtgccccctgggtctttgcttcctcgcgcaccccaaggttggaaggccaaagccgacgcctcacagaccgggggtccgggccccctctctagggcggaggtgtgcagaaagctctagtgcgagtttacttgcggcctggctaccccctccccccgccgctgtcctgcgattccgggccagcctgcggcggcgtccccgactgctccgcggtcctgggcagggcaggaagctggcacggccgacggctgggcaggcgccacttggccgggcaggctgctcgctggaactcgcgcggcaccttcgcgccgaatcgggttcctgggtctccagcccggtcaccctgagcggtttcaccccccactttgaccatcggcctcccgcggaagtctccctgtctcctcccgccctctcggcttttcccttcctcattctgtctcgggagctccttaatgcagtcaaccgcctttcccgagattcaaaaagaagttttgtgtttccccgggggcagccgcctaatgcttcccttgttttccggaacaaagcagacattcagtgaggagggggcaggcgctgactccctcccctccccgcagcaccccgcactcctgcagattcagaacgctggctccggggcccgggtggcctgggggtggggtggggacccccttcccctaggcttggccacaaaagcctcgcccggtagccggagagaaagcggcgtggtgtttgggtgaggttcccagcccgggcggggagggcgtgcacgcggctgtttacagtgtgcctgtgctgctggaagctcacccgccgccgcttgacagcgtggggcacccgctggctgccagctcagaggagatgcgcagcggcgagccctccagcactccacccgaggcctccgcagcgccagggccagggcgcgctgggaagctccaggtctccaaccccgagttccttcggcccacatacccctccccgtaacaatggcctagatccggtagtatatcaaagggacggggtggggaggggtgaagagcgcacaaggggcgctcagggctgtcgaagcgcctgggttctgagcatatccccgccgccgcctgtccccttgcaggactaaattccccggcccgagtgagcgaaagacaaatactctagtgacttggaggtgtttctctctccggatacccccctgcaaccccaccaacccctacccaccgtgcccagtgaacttctctccaccccaccccgtggggaccgctgcactagctgtgcccacgagcgccaggccttctcgtcggcgcagcgctgccttagatcccgctccacctcttcccctctcctgggcctgtggccggcccctggcgcctccagcgcggcctgaaacttgatctcacgtcgaaaggacagtgtgtaaacaccaggcgcgctccgagaacccacgggaggggccgagcgagggccgccggggcagctcgaggccccgcgcccccgcctgcctgctcgcccgggacacgatcggcggggccgccgtctcgctctctgcctccccagttggctcagctaattggagccgccgccgccgccaccgctgcggcctcttgttgaattttctagatcgcaaccgttcagtcgtggctgcctgtcgctcccctcccccttccacagctgttacctctgccggcaacttggtggtggtggggacccgtccccccgctgaccctggcctcaggctccgagttcaccccagcagttccagggggtgtttttcttcgagacgtgggaagggaggtaaagccttatcggaactgtgaggcttcgtgccagaatccaaggctcgggtactagccagaggatcctcccggcagaaggccatggtcctccctgtcttacaccaggaggtagtgacagtcccggagggaggggctccaggaacaactctgctggcgacttctgttcattccaggaaaacattacagaagggtgaggtgatgggaggcagaaagatcccccctccctcctgcttgccccaatccctgtcagcacttgggcatttgggacttggtgtgtaggttccttctgcagcagagctcacctgcgccttgggcctaatccacccacatgccacaaggatgcttttcctcttggtttggagtacctggtgggtccaggggggaagtgccacccttagtgggttctggaggtacaactcccccatgctgggtcagttctatgcttgtaccaggaggccctcctgggccttggtccttcccagccatccccagccttagcctcctttccccttggccagctgtctcatgccttaaccacacatctgtgctagctgcaaaaggtcccgcctgtatggatctgtaagaggcccagagctcggccccatggttgaggtgggaagatgtgaagcagtttgctagtgcaggaatcatgaagatattgttgatgatggcagagcagttcctggtctccagcattgccttagaatggcttttcctcgtggtagaactttcgctagtgggtttcacaggctcagggcccaatcttgtgaaagtagctacactccccagcccggaaacacataaatacacataggcaaactcccaggaggctgggtgtaggaaccaccaccggggggatctgcagcagccagagaatgtctgcttttcctgtgatggttctgagaagggcgcctgttccctccctttgatggttctctgacaactgttaggtaacaaagagtggaggccacaggctcattaactgtcattttccacctctttcctccgcttctaacttttacccaaattactactttggagttttcctgaggtgttctctccatctatttataactagagcaagatttccaactcaatccttattgatttaaactatgataaaaatgaatccataaaattattattataatttggtgtctaagatgacatttcactaggtcaagttcacacagtttttggcatctaaaatcccccaggcctttccaatcagataacctaagtgtgtttcccactgtcagtttctcttccctttccgtagtggaaaaaaactgaatcctctcaaagatgtttattctccttcactcctaccccatcagtctgtgagaaccttgtttctgtttagggtaaggtatatttctatgttttgataaagaagagagtaatacatgttcctcttcaggcctgaaaagataattatgcatcctgggagcttgctcttctcctggctgtttaacggacaatctggattctggctctggagcaggaatgcttcgatgtcccagtctccttctcgtcccctttcctctgtcaccactcagccatcaccaggcctttaggcgggtcacacggcctgaggatttctgttctgaaggctcagagtgcctcagaagattgcagctcagagcctggtatcatgcattcacatttcttttactgtgcaaagcatattcggagccattgggattcctgttccatctctctgaaagcttatgccaagagctccccatggggcctatggtgatggatgtcatgaggcccaggaaggagccatcatggtgggaagagttgagagcctgcatgtaagactcagactcgaaccaaacctaagtgcaaataacaaggaaaaaaagcaactccgcgcacctggctggtaccctgcttggaaacaaaccgtacctccccaccctcccatctcaaagctagtagagcctaggggcacaccattcctttggcttccctttagcttgacctgggaatggcgcagttaagcatatcaggaagctgagatgcatccactactcctcacttcccctggcgctgggctcagcttggctgaacttgccgttcctgtctttttagaagagctggttgtgttcccgaagcaggatcgcactgtgccgcctccccaggggtccccagctattgatttttaatatccgtattcaatattgtgtattaaacattgaatccatgcacaagaggatgtgatgcaaatcaccagccgtgcctgagactttaatagttgttttattgcccggaaaccacagttggacgcaaggcatcctgcagccgaggctgggggtggggatgacaggctgagaagagagctgagcggagcggagcagagcagaggatacgagatctctgaaatccgcactactgaaggcacagccaggcactaacagctccccccaggcaggctggtggggggccggctccaggctgttgtggaaagagcaggggctgttgtgtgagacccgggcagaggaagaggtgtggggctgtgttcttccttcctggacttccctaactggactgtgcattcctgtccggcagtccttcccctccatgcagatgctcacccagaaacacatacacaacgatggaacaggaaagttaactttggggcaggaaaccccaggcctcgggcctcttccaccactcttcgcgctgtgaccttagcacagacctctctcaacccgctgggccccatttccctcctttgccaatgggggtgatgctatctgtcctacttccctcacagcgctggtggtgaggctgccgcggcacatgagataatattcggggaaaaggcttttgtaaattgtcaggccccacgtaggcaggctgagggattagtgctggctttccctttatactccctctctcctgcaggctgtgtctcctggctgccttctttctcagacatgggcctcctcccccatgaagggccctctcttctgtttcctcggccacctctgcttgatctctcaggcttcctgctctgcctggactctgcattcaggctaggcaatccggtttggaggaggcccagcagggagaaaggaagggtgagaacgactgagtgtgtggtgggggtgagtgcagcaagtgtgtttaaagccaacagcctcgggagggaggagaagcacactcggtagctgcggccctgggttgcggagcccgcgggggtggggccgtgggtggggggcgttgatccgccccgtgtgcggacaagcgggagaagggttgagggaaacctgagtctaggagtgtcttcacgttacactgttgctggttatgggaagtccagcttgaatcccgattgctggaaggctagggtgtgggcagtgccttcagggtattgcaattgcgaaggccaaatggaaatgcggtggaaagtggcagccctccagcgccgccaagtcagataaaaagttgcccgaggccctgagagtggaggcaccagctctctgatggccttgtagacgccctgagaacagtccgagctcctcaaacccgctacctttgtcctgggctcaaggagggggcggaaaccagaggggcccggattcttgaagacctcccctggggaccccactgtctgctgggaaggcctcagccaactgtaggcccaagccctacagagaccagctctggcaggaagtcatgccaagagtctgtgtccgcgtccttaggcgtgagaatggggctatgccaggctgggcctggctgcgcacgcctccgcttcgggactcgggcggctgctgctgccttcgttttcgggtcttcgaccgagcctccctggctctctactcccgctttgtcttgctgtcagcttctcgcctgtcctcgccagtctcctaggtcggcgggtcgcgctctgcctctccgagtgcgtctttgcgcacatgtggcggtcttcctgcaacctgggtcagctcggcctcttcccgcggggtacttggctttgcctttggatcgctgcgagtgtccacttcttgcgctctccttctccccacctcgccttaggcagacgcatcccgggcttggcggtcccccaaacagaaatatccccgggtttctggtttagctccaccaaaacaaactcgagggattggggtatccttcacttgcgtttcccgcttctctcagccctaggccgaaactggagggtttttttgttttgttttgttttaatgagacctactttgcagagttgacggggaacatttctgcggcagacttcgaggtctgtggcgctctcccaactttcaagactgtaagccgccaagaaagagaatttgggtacatgattttgccgctgatgtgggctgggacgagggtatccagagtgcacgtgcatgtgcggatcgcagggactctcggtggattagccgccaaaagctggggagcgccgcgtatggacgctagggctgggggccagcggggacctacaaacaccccaggcggccgagcaggtgaaggaaacgttccgagcccgccccctcctcccgggcccgcacgccgccggcctttgcggcggaaacacggtccaactccttgaaagtaaacttgccgccaggggctaggggcgcgaagaaaggagggggctgacagcggtgtctgcgtcggggaggccaggaaggcttgtgtcaaatttcagcccccaatgacactcggtggcgaggtgccaaggccctgggaacggcggcgggggttctgggtgagagtgatcgcgccgcagggcccagcttgcgaaccccgaggcgcccgcagggcctagggaggccacgggggcgggcgcggcgggcggggagggggcgctcctagagcctcctgagcggagcggacgcaggcatcttccgcaatccattcatgcactgaagcgcgtgcagagctgctgatcgctgccattgttactcgcgggcggtgtgggagctgagcctccactctggcgagagataaatggcctctgacagcccctcctcgccaagagagctcctcggatttcaccgcgcggcggctctcaggtctgtgcctcgctcgcttcccggtgagaacctttaaatcagcctctcggccctccctcctcccggacactgtcccccgcccgctcaggccccggcagggccccgggcgcgctgtgtgcagtctcggggtcctctccccacctgggggttaaacagagtgggggcgcagggaggacctcagggccgtggggggaggcaccgggctccccagccccggctccgcgcctccgcgggagcggagccccgcgccccgcctccgcgcccacgagatggatcaggctaccgtgcggagagcgggctgtaaatatttaaaaagtctctcgcgcgccggcagtaatggctttcgcagtcggaatgtgtgctaggggaagaggaagggcgacgtgtactgtgttgcagggtggggaattgttcctacgcttccccttaggtccggggtgggctgcatgttcaggcttcccgatttcccgccctccgcctctccgccgccgcgtcccacgatagcatcgagaacgccagtcgacagggaacttgagcatagccgggcaacagaggcccggtcgaggtgaccccggagccaccctccccaccggggtctcccaagctcgtgggttgcgaatggtcccagacccctaatccgggtccgcttctcgctgctgcacaggggagggcgggaaacgcacagattggagccccctgagtttgggtggtcgcaaaagcctgggccggggtttctgcagagggggcctggaccctgtttgtgcctttgctaccctccccagccgctcttaaaccttgatccgctctccaggagacccccacccctatctgaatctgaaagtagctttgtggctgctgggaccgaaacctgggaggaggcagcacggagagtttggggcggggagggggtagcctccaggcttagtggaggtcacacgtggacctgaacggggactcttttgcctttctggtgagtgtgggcctgggatctttaaggccaagccctgccggatggtagaggtgggggagggggattcagccttctcggcttggctgggagagacttaatgggcccaccacagggtgtgtgtcgggtgaggttgtcccctttgccagcggccactccctagcggggcggaggggctgagttgcccagagctggggcgggccgggcgccgcgggttcgcgcggaaggttccaggggtgtgggcccagtccggagctgttcgcctgcgccccgccggctctgggacctgccaaagtgtgggtgctggcggcgtgtcaggacgcgccaggctgctctccgcgttcgagcgctgggagctcccgactcctggcagctccgtgcagtcctcttccaggggcttgtgttgcgcccttctcgcttgtttgtctcgtgtgagcctcgtaaaccgccttgatttattacccagactaaatgcttaatttgtgaatatgaaacagattaaaaggggcggggggaggggggttgaggtcggcatattttagcaatcagaccaaagcagctcggcagatgtttcaaatttgtcgacattttcaggctcatgtggaaagccagccagagtggtcaagaggtcctttctccttccttcaacctgagaacttggcagtgatcaaaaggaggtgattagtagctacagagaaaaaacaccagcaggcaaggagttaacagagactgagccgttcacctccaggattgggatttggcggggagggggggcggtcacaaaggcaagaggaatcctggctaaacaggcgcaagtcgtggaagccaactctgaagaacaaagtggagggtccgttaaaagttaattcagtaaataaacttcattggtgataaaacaaataagaaagatggaaactccaacttaaaatagccaaaagataagaaaaataaatcgcttttatgtggcctgaacatgtgcatgtgtctttggtcaggtccccgcaatgatccacctaacaaaggcctctcctgagtaccctctccctttgaataccccacatgtatagccagtgttttttggcgtttgtcattttggggcaacttcacacatcaaaggcgagcaccgttttcttttcagctccctggttccagccacccagtgaagcagatacaatttctataaattggccttcttctccaggtttcgattgatcatcaccatatgagattactgaaagtctaatgtcttatttcactttctccaaggagtgaggaggggaacagtttattgaaagtcaggccacgtgaagactctggtgttgtgcaatagtaatttccattagcctggatttatcagcctcctgatactgccacctgatactgcagtctcctgcaggttccttgtaccaccttccctcttcccctccaggtctcagcatctgtccccatgaacaggtagagttcaaaccggagccttcctattggtaaggagaaaatggctgatgaccaaaaattaggaaacaaaagatttgttgttgtttctcaggacggagtcttgctcttttgcccaggctggagtgcaatggcccgatctcgactcactgcaacctctgcctcctgggttcaagcgattctcctgtgtcagcctcccgagtagctgggattaccaggcacgcgccaccaggcccggctaattttttgtatttttagtagagacggggtttcaccacattggccaggctggtctcaaactcctgacctcgtgatccacccgcctcggcctcccaaagtgctgggattaccggcgtgagccaccacgcctggccaaaagatttgttttttaacatatttgttataacttaagaatcccctctttggcttttgtttcctactccaaagttttttgttcccctttggccttgataccatctttcgttttattaaagttgattatggttcctctgtcttgtccctagccagacaaaggcttaggagaagtcaaaggacgtgttaattatgtttcttgtaaactgacttttcatttccccctaacacatttagttggcttggtgtttagtttaacaatcaattgctacaaatatgctgcttaaaaatgctgcttttattaaaacaaataaatgaattcaaagacctttctaatttcaactcgtgtgggctagaaacagaagagaaaatcgaaagcaagagagagggaaaggcggcagggaggggagagaaaggagaccaggaaacacacacagacacacacacacacacacagacacacagcattcctgctgccatccctccggaagccatgttaaactggtccatacaattgtccctggctgccccctgcagctcgccagtccttctggattttccatcacttggcgcctaaggcgatcattagctgagaatggacaacctcctctacctgccggcagctcagctcgtcatttaccagccaggggaggctggccccatttgctcaacccgagaggggtccttggtttttgcccctgggtgcattggtgcctaattaaactctatccagggcaacgtgcactaaatatacgtaggctgagaggaagctgggaggaaaaagcagtcattacctaggaagagaaagtgaatcttccgagagagaggaggaaggacccctgcgatggtgctttctgtttaccctcagcagagccttggagtgcatgttcacttgggtgctgaaatcaaggagaaatggaaatcgggaaaaaaatccatagcccacacatacctgaacagggcctatgtcaccacagagcaggagggaggtctgctgtagctccagacagtgttggctgcagaaaaatgactcaggtgcccttgtggcatcggagttattgctcatgtgccacggccccctcacgcacaggagctggagctgtataaatggccgtggggacagaaaggaacagatgtgtcaagagtccaaggactaggtgtgtgttgtaaagccaaacagatggtggaggagcaggggagaaccttcagctgaaggctaaagaccctactagcacctgggcccaggcaggatcgaagtgacccaacctgaagctaaaatgacagccggcaaacaagaatgtatgcagatgtcatacaagagccaccagggctttaattgagctctgtttaacccagtggaggaaatcagttgagagggtgaaaacactagctcagggtgacatgtttgtggcaaaagagaccagaacccagagctcccagcttcagaaaacagccagaggaggaaagtgactgctggttagagaaagatccagagtgctcttggtcactgaagaggcctggtattttagtcatttggcatttattaagcacttgctgtgtgcaaagcactatgctggcatcaaagggggctaccagcactatgagccctcaaaggactgagcagggaagactctcccctttatatgtgcctggtgacaaaggccatgaaagacagtgggtgaaggggctggggaatgggaggaggaagccaaccactctgggttccactcttgaagatagcagtttacaggtgggcatcgaggccagagggcaacctgtagcaatggacccctctatggcctccctgagccaaaccctacctggctaagcacctgcgcctgtaagattgtcctcccagtggtgggagtgcgagagaggccatcttcacttccccttccttggagggcctgactttgttgccctaggcaggccaggaaacttattctaatgccaacgaaggaggcaacttttctagctagaaaagcacacgctacagctctctctcttgccctgaacaagcagaagagcacagcttatccccaaaagctcctggacaaatgtaggctctctgggggagctggtaagggaatactgcctcccttaacaaaacaaacctgagaatctccaaggtttagcactgcacacggagtctcccagcagagaagggggctagcttaagtgccccatgcattccacctgccccttggggcgctctcagtgtgatcacaggtgcccttcctcaagccatctggcctgggcccagcctctgctcttggtttccctaagcagaggcgaaacacgctggaaccttcaaagcacattcctaaacactaagagagagctgtggggaagtgaaaacaaagaggccaaggagcgctggagcagttcagcttccagagtctgtgggccaacagggctggctcaagttcagtcagacttactggccctgggccaaccagagctggcagcgtgccctcttcagcccactgctcaggccccgtcgccccccaaaaacctgggcacaccccagagcaagcccaagccccaggaagccctgctgccccttggcagccctctcagaccaccccctcccccttctagttgtgggttgctagttccagagccagggaatggcttccaaaatcccttcacccagagcttcccaagagtgagtgggttgccaatgggtcaagacggggatcccccagcccctcagagtgaaccaggggtgacccaattccttggctggcagcttcaggccatgttgggcaattgtggacactcggtcactgtttaactttgtgcaacagaaaaatatcacattctgtgctgagaatcactgctcacttgtcataagtgtggcatccatgctccaagagttacccacacatacgaataggaaggatattggaccacatggtccttcgtggatggtgaacacagcatagtcagtgattcaactagcattcgttcaagcctctcttgtctgtcctgcactgtgcttgtggctgttggggtggctcggggaaacccccggttaacaagacccaggcccctccttagagaacataaagtctccccaagagagataagccccatggagctgaaaacttcattgtgcttacactaaaaccaggagaaagagcaatccctggtattactcctcaggcatagttttttggtttttttgtttgtttgtttgtttgttttaaatggggtctccatctatctcttgctgaggctgtagtgcagtgaggtgatcacagctcactgcatcctcgacctcccaggctcaagtgcttctcctgcctcagcctcccgagtaggtgggactacaggcatgtgccaccacagctggatcatttttcttttttttttttttgtagagactgggtctcaccatgttgcccaggctggtctcgaactcctgggctcaagtgatcctcccgcctcggcctcccaaagtgctgggattacagccgtgagccactgcaccccgcttaggtatatatatattttttaagccaaaggtctgatggtgtgtttctgcccactttacacataaagctgggaaactaaagactccctcatactcccagcagctgacctgctgaatgggacttgggagctgggaattccgtgctttctctccaaagggtccgcccaggtgacatcaagttcatggcagatgttatgggtaacacctgcacttggcagaaaattctaaggctataaaaggatgtttggtgcctctcccacccgcatttctcagtcactcagtttgcctctctgaaggcaaccagtgctcccagtttattgcttactcttcccaagatagtctattaaggctgattttttttttttttttgagacagtctcgctctgtcacccaggctggagcgcagtggcacgatcttggctcaccgcaatctctgcctacctggttcaagcgattctcctgcctcagccttccgagtagctgggattacaggcgtgtgccacgacgctgggctaattttttgtatttttagtagagacagggtttcaccgtgttagctaggatggtctctatctcctgacctcgtgatccacccaccttggcctcccaaagtgctgggattataggcgtcagccactgcgcctggcctattaaggctgatgcttaaaaaaaaaaaaaaatatatatatatatatatatatatatatatatatatatatatgtatatatattatatatatatatatatatatgtatatatattatatatatatatatatatatgtatatatattatatatatatatatattttaaattttattttgaaaaaaatcccaaacccacagaaaacttgaaagagcagtacaatgaacacccatatatgaaggcaggttttcaaaagcattatatttattcaacacgcctacccttggaaagaattcaaaaccccttcaaaggtctgaattagtttaactttatcttaaactgttacttaggagtacttttccctcatagacatgttgcctgcttgttcatccccctcctcccagcccccagcaccttattagtgtgcctcgtgcatagtgggcatttcctaaagcttgcaggattaaatagcgaagactatgtcgtagttagtatgggggagccagactgtctgggttcaaaacctggctctacaacttgaccagctgtgtgacctgaggcagttactctcgccaccttacttcccccatctgtgaaatggagggtagtgatacaatatatttaatgatgttgggaggattagttgatggacataaagcatgtaaaatagtgcctgggccagacacggtgtctcacgcctgtaatcctagcactttgggaggccaaggcgagcagatcacctgaggtaaggagttcaacagcagcctgaccaacatggcgaaaccccgtctctactaaaaatacaaaaattaggcaggcgtggtggtgggtgcctgtaaccccagctactcgggaggctgaggcaggagaatcgcttgaacccgggaggcggaggttgcaatgagccgagatcgtgccactacactcctgcctgggtgacagagcaagattccgtctcaaaataaataaataaataaataataaaatagtgcctggcatctagaaagtgcttaataggtgttagggacacttgagacttaaacacacttggtattaactttgctttggtgattgcatgtaagtcatttggccgagttgatggcctccgagttttccttggtaaccatgagagagacccaagaaaaccgggaatgtggcttcgtagtcgtccctcgcctgagaggattgcctacgctcagcacataagtagcaggggcttcttgtgaccagtttccactcatggagagtttctagctgtgcttattaaaaagatatttgaggccgggagtggtgactcacgcctgtaatcccagcactttgggaggccaaggcgggtggatcacctgaggtcgggagttcgagaccagcctgaccaacatggagaaaccccgtctctactaaaaatacaaaattagccgggcatgatggcgcatgcctgtaatcccagctactcgggaggctgaggcaggagaatcacttgaacccggaaggcggaggttgtggtgagccaagatagcgccattgcactctagcctgggcaataagagtgaaactctgtcttaaaaaaaaaaaaagatatttggagggaaagtcgccccccgtccacttcccttttatagcctggctagttgctgccctgctaatagaaccatctttgaagaaagagctagcatttgttttacccacagaccggtaagatcttctctctcagggtgaagcctaggctcacaaaagcctgagatcagaaagtcaagggttagagagagcaagtaggtgcaaccccagaaacctccactgtctggcaagccagagagtcttggggccccccaacagacaaagttgtctggaattttcttcacataggaagtgtagaatggtagatgtcttaagagccagaggcaagagaggactggggaaagataaaggaatttgtttattttattttatattttattttattttattttattttattttatttttgagatggagtctcactctattatctaggctgcagtgcaatagctccatatcggctcactgcaacctccgcctcctgggttcaagtgattctccagcctcagcctcccaagtagctgggattacaggtgtgtgccaccacacgtgacaatttttgtatttttttagtagagacggggtttcaccatgttggccaggctggtctcgaactcccaacctcaggtgatctacctgccttggcctcccaaagtgctgggattacaggcgtgagtcaccgtgcccggccaggaatttgtttaaaggtatactctgtgctataaaatactgcacctaatgttaggctttgacggctataatatctgactttgacattgaggtgtatctgccatataatttaattaacgtgtgatgccggcacaatgccagagagtcaaacattctgacagctcttggaagccacataagtccctttgaagttccccccagtgaagtgacacacagagaaacctcctatggttgaggacagcccctgatacggtatccagaaatttagctgcgtcttggttatattggatggcactggcaaagccacctgctggtttgccacagttctggaggtctgctgtggtttctaagggccccaaccatggagactggctctttggggaagaagaactcattcttcatcagggacaaaattgggaggtctcctgtttgcatattttgttctacaaaatgtttttttcttcctcaactttgcttagtgcaaagtcattgagctgcacacaggaacgtaaattaggtaagaggcatattaaccaaggagaaaaaagaccatagacatctattttgcacataattatttaacacccaccatacgcctaccaaagctttggacatttatagcaggaacaaaaacaatatcttggacatcataaaactacattttactggggagagaaaaagtacatgagcaataaaaatatataatattgcaggttgtaataaatactcggaagaattaagaagggtgtgaggctacagagagatggaatgttcttttatgtagttagttatttctatctacagcaggtagaacgagtgttcttttagatggtaggttgtgcagtatgagccttgggttgaccgagtaacgtgctcaggcgatatatcaataagctcttgtcacaacactgttgtatcacaaaccacctcaaaacatcagtaagcacttatttcctacatacatgtcagtgggtcacctgtggttcactggtctagaatgtgctcaacagggcttgactccaagtgtggattggatctaaagctgctccacgtgtccctcatcttctacggacaagtgggctacctgggacatgttcttctcatgacaatggcaaaagtgcaagagggtagagtgcaaatgcaatgactcttaagtccgggactcaaaatttgcacactgttacttctgcctacatctattggccagaagaagtcatgtggcctgacatcggtgggatgaagaggcatgctctacctctaaaaggtgtggacacagggggaggtgaagcactgggaagagtaatgcaatctgaaacaggtgtttcaaaccaaaactatgtatctctagctgtgacatttatatatacaaacacatatatcaaatgataaaacgacccttgttgaaaccttcagttttagattaaatttaaataaatccatgcaataattacattaccctccccgagatggtttatgatgtcaccagaggcttctgggtcattgccgccaatctcaggaaacctgggaagatgggccaccggccatcccaatgctgagagacaaaaaggccatgaagggccgggcgcggtggctcacacctgtaatcccagtactttcggaggccgaggcaggcagattacctgaggtcaggagttcgagactggcctggccaacatggtgaaaccctgtctctactaaaaatacaaaagttagccaggtatggtggtacacgcctgtaatcccaggtactcgggaggctgaggtacgagaatcacttgaatccgggagtggaggttgcagtgagccgagtattgtgtcactacacttcagcctgggcgaaagaatgagactcttttctcaaaaaaaaaaaaagaaaagaaggaaaagaaaaaagccatgatggaatggagacctttcttcctacaggggtttcccttgcaggaaaggtacaggtgggaaagctcagaggagaccccagaccgagcaagtttccttgcttacctctaagcatgtcttggagatgtggcataggatccaggaggtgtgactaaaagctagacttttagccagtctcgcaggctgtgcaggacacaccttcatctgttgtatgaaggtatatgagctggccaaagattcgcgttcttccttgcagctccttttccccccagttctgcccacctttctcttgctgtccttgaataatgtgggggggattcctaagtgtctctgcagaaagtgatgatttctaattttgggcctcctttcaatgaattcctccagggctctgcagtcagccaagtactggaacctagcccttccctttaggaaggaaagctcttggttcaattgattccgatggttaatggaatctcatcaccgttgcccagagtggttctaatcaaaggaatccactgtctaaaaattcaaggtagcagcatcaaggtttacatcttgtaagcaaagagactggggcactggggcagatatgttttatggtggagccccatggggattcagtctcttatttgggagaattctggctcctggctccaaaggtgtgtgagttgatccatcttctgtaactaatcctagcctggacttggaagggggactgccttttttattttttggtgtttggtttttgagacagggtctcattctgtcacccaggctggaatgcagtggtgtgatcatggctcactgcagcctcaacctcctgggctcaagtgatcctcccacctcagcctcccaagaagctgggaccacaggtgtgcgccactacacccagccaattttttatttttagtagagacaaggtctcattatgttgctcaggctggtcttgaactcctgggctcaagccatcctcccgcctcagcctcccaaagtactgggattacaagtgtgagccaccacgcctgaccatgtccttgatctgtaaatgacagtagcttttggaaactgagaaaataaaaatctggatcagacttcaagtcccctgacccctctctgatctggtcctcgtcttcccctctcctctggttccacagctgccacagagcacacccctggggcagcccagtgagtccctctacccattcatgccctcctgcttgttctgccctgggagggagcctcagcccctgagccccctgcctggagtgatccccctgctcaccctgactcccagctccaggccccacctcctctgcggagcccctcccaaatttctagggggttacatttcagtctaattctcccagatgcctttgtgcttattgtcacagccacaaaacttatcatttggttgctctgaaatgactttacgccttatctcctcgcttcagttgtaagttcttagagcacagggaccacagagcctagcaaggtgttaatacacatgagtgtacttactggttggatagcctcccatcaatttctgtctcttagtggtgtgggagtagaaaagactccccagatgttagggccaagaaggttgaaattgaggccgggcgcggtggctcacgcctgtaatcccagcactttgggaggccgaggcgggcagagcacgaggtcaggagattgagaccatcctggctagtacagtgaaaccccgtctctactaaaaatacaaaaaaattagccgggcgtggtggccgtcgcctgtagtcccagctatgcggcaggctgaggcaagagaatggcatgaacccgggaggcggagcttgcagtgagccgaggtagcgccactgcactccagcctgggcgacagagcgagactccgtctccaaaaagaaaaaaaaaaaaaaaaagttgaaattgaagtagatggccgggggcggtggctcacgcctgtaatcccagcacttcgggaggccgaggagggtggatcacgaggtcaggagttcgagaccagcctgaccaacatggtgaaaccctgtctctactaaaaatacaaaaatgagccaggtgtggtggcatgtgcctgtaatcccagccactcaggaggctgaggcagcagaatcacttgaacccaggtggcggaggttgcagtgagctgagatcatgccactgcactccagtctgggcgacagagcgagactccatctcaaaaaaaaaaaaaaaagaaaaaaagaaaaaaaagaaattgaagcagatgagctcagatcatgagggattttctgaaactgctatattttgaagaaaaccttgctggtcccctccagttttctgtaataacctggctgagcagtgggtttcactgtccggttcacgcactaactgcttcagggtcacctggggtgccagttcagaattcagagtcctggccccacgcctgaaaatactgactcactaggcctggggtggggcctggaaatctctatctttaacacgccactgctgactctgacgcacagccaggtttggaaactagtcgagtctgaaaagaatgttctcttcttggaagtgagaaaatgttaggggggcaccgtgagaaggggctatgatttggattctgagagaccaggtttgagtctcagttctgccacttaccaggtgtgtgaccatgggcaagttattcagcccctctgcacctcagtttcaagtgggaacaccacggatctgttttgtgactagtgccatgcaacaaattaccccagaactttgccacttaaaacaactctttggccgggtttggtggctcatgcctgtaatcccagcactttgggaggccgaagcgggtaggtcaattgagcctaggagttggagaccagcctgggcaacatggggagaccctgtctctacaaaaatacaaaaattagggtgagaggattccttgagctctggaggtcgaggctgtggtgagctgagatcccaccactgcacttcagcctgggtgacagagtgatactgtctcaaaaacaaacaaaaaaaaccccaactctttgattttgttcacaattctgtgggttaggaattctggaacggactcagctgggtacttctcacttgggatatctcattcggttgcagtcacacatcaacaggggctgcagccatcggaaggatatccgagatggcacactcctgtagcaatcagttgatgctggctattggctgggagctctgctgggctgttgactgtggcacctatgttgtgagtctctgccatggcagtagacttcttactgacttctctcagagcaagtgccccaaaaagagccaggagcaagctgcatggcttcttctgcctttgtcttacaagtctcagagtgtcacttctgttgtgttgaaagcagtcacaagcccacccagacttctagaagtagagacagagaccacacctcttggtgggaagagtgtcgaataactagcgggcgtgtttaaaaccaccacggtatctcatggggttgttatgaggattcagtgagatgatcttgctgaagtgctggacaagcatgagttcccctcctccttctaatttgaggcctggaggctaacagggtaaagccagtgccaggtgccaggtctccagtcgcttgcagttgttcatgtctactgggccatagggaccgtttttctcagtcttgtctcctcttctcttctcttctcttttactgacagagtttcgctcttgttgccgaggctagagtgcaatggcgcgatcttggctcactgcaacctctgcctcctgggttcaagcgattctcctgcctcagcctcctgagtagcttcaattacaggcatgtgccaccacgcctggctaattttgtatttttagtagagatgggatttctccatgctggtctcgaacccccgacctcaggtgatctgcctgcctcggccttacaaagtgctgggattgcaggcgtgagccactgcgcctggcctgtttttctcagtttctagtcatttctagtccttttggatagtaaatgcagggtgcagtgagcaccttctcattctgaccagctcagctctctcaggaggttgggactgcaagatctgtggttcactgtcacccccatatcagccttacccatgtgcctgatctcaagtgcaagctcactgggctccgaatgggaacacctggctgagtactgagtgttttcaggtcagacaacctggtttggggcccaggagggtcatctgttgcaatggtggcctgaggggcagctggagagaaagagagcagctttggttggcgtgggtcttctgtctcacggtcatgagtgggccccttctctgaccttgctttcttcacctcaggtctggagacagtggaggagctgaggaaaggtcacatggagaccactggggccagcaagccagctccccagggaaggtggggggtggcttgcatgacagatgcctcaggatgaggggcattaagagggtggctgggttccaggggctgccagagtgggtaggatttgccaaatagggtacccttggaaggcaggacacaagagggaggagccattatgtgcctgctgcaattcactggcatttgtggagggggtcgtttgcccctctggcccacacccttattcctgaaaaaggcagttgggcctgtgtttagcactccgaggaacctgctctctctggtcctcttcttttccttctggggctcctgaacctccccaccgacatgcttccctcattaccaccaagcctcacatgcagcagctgccttgctgagagcagacaggggtaggcttggagctgcacagcgatgcgacacatgatggggctccttctatgtgccccacacctagccaagggctaaaaatggtcacacgtctccatgatctcattgacgaactcacaccatgggcctgaaggagtgatgtgtgagtcagcaccccggaatccctggcagagcgggtcttggaggaccaggaagaccaggggaaacctcccagattgagtcattaggataggtcatagtgcaggctgccctcccctcagtctccatgcctcagtttcctcacctgtaaaaggagagtaactaagtgcccacctcatagtgtgaccacaaggagggaattggggtgcacccttaatcaggctgctctccacctgttgaagatttagatgaagagggacagggaaggagggcaggtgcatagggagttgctggggcaggggaggcagagtcatggaggagaaggcccggagggtggtagaggaggtgcctgctgcacgggtgaagtctgttcttcttcttttttttctttttggatggagtctcgctctgttgcccaggctggagtgcagtggcatgatcttggctcactggttcatacaattctcgtgcctcagcctcccaagtagctaggactacaggtgtgcgccaccacgcccagctaatttttgtatttttggtagagacggggtttcgtcatgttgtccaggctggtctcgaactccggacctcaagctatccgcttgcctcagcctcccacgcctgctgggtttacaggcgtgagccaccgcacccggcaaggagtctgttcttagaggcagagccaccactcctgctcccaaggaaaggacagtgaaacagctttcgcccataccccaacccccacctccctaaggccccgcagctcctccctccctccgtctggactgtttccccttctccctaagacatttcctggaagctctgcccacagttcttccttctacttatatacctggcctggccccagccctgccactgaggcctggcccccccattatgtgaccagcttttcctcttcttctttttttttttttgagacggagtctcactgtcgccaggctggagtgcagtgacatgatcttggctcactgcaacctctgcctcctgagttcaagtgatcctcctgcctcagcctcccgagtagctgggactacaggcacgtgccaacatacccagctaatttttgtatttttagtagagacggggtttcaccattttggccaggatggtctcgatctcttgacctcgtgatctgcccgcctcagcctcccaaagtgctaggattataggcgtgagccaccatgcccggctaacttttcctgtttctactcacttgggctgagatccccgttctcctatgtcaccttccttaaacatcacaccttggctaagaggaaagactgtccatttgggagtctatgcccactagctctgcgacctcaggagagccgcttaacctctctgagtctcagcttcatcatgtgcaaaatagggtcatttagttgtgactagtgcctcattttgaccgtacttccatgaggattgaataagggaatgcattgaatatgcaacaagtacatagtaggtacttaataaatggcagctatttccatggtgattctaggcctgtgtatccagagagtatttgactaatagacatctgcacgcctgtaatcccagctactccagaggctgaggcgggaggattgcttgaggctgggagtttgacaccagcctgggcaacatagttttttacaaaaagccatctgagggtatgacttgcatagggagccacttattattggagggcagataaagaaaaggaggtattcctttctttcccctgatgattcaggcaaggtggtccctgctcccttttatttcctgagttacatctatgctgtgccctagaattggaatcagtaagcacagatgccattggagtttttccccaatattcttttttttggagacagggtctcactctgttgcccaggctagagtgcggtggcgtgatctgggctcactgcaacctctgctttccgggttcaagcgattctccagcctcagcgtcccaagtcgctgggatcacaggtgtgtgccaccaagccgagctaatttttgtattttttgtagagacggggttttgccatgttggccaggctggtctcaaactcctgagctcaaatgatctgcccgcctcggcctcccaaagtgctgggattacagctgtgagccgctgcacctggcttctaacccaatatacttttttgtttttttgtttgttttttagaaggagtctcactctgttgcccaggctggagttcggtggtgtgatctcagctcactacaacttcctccttccgggttcaagagattctcctgcctcaggcacccaagtagctgggactacaggtgcatgccaccactcccggctaatatttgtatttttagtagagatggggtttcaccatattggccaggctggtcttgaactcctgatctcgtgatctgtccgcctcggcctcccaaagtgctgggattacaggcgtgagccacagcgctcggcctcttccccagtattcttgctgccttttttttttaaatttatttatttatttatttatttatttatttatttatttatttattttgagacaaggttttgctctggagcgcagtggcatgatcatagctcactgcagcatcaaattcctgggcttaagtgatcctcccacctcagcctcctcagtagctgggactgcaggtgagagccaccactcctggccagattttaattttttttttttaagacagggtctcactatgttgcccaggctggtgtcgaactcctgggctcaagtgattatcctgcctcagcctcccaaagttctaggatcacaggtgtgagccactgcctagtcaacagacttgcttctaagacttttggatggaaactcttctagagtatatttcaatgagatatatcagtttgctattgctatgtaacaaaacactctaaaccatagtagcttaaagcaacaatttcttcttctatcacaattgggtaagttggctgggctgttcctctgctggttacatctgggtttactcatgcagctgcagtcagctagccaacagctgtggggagatccaagatggcctcatgaacagtgtggcagttggtgccagctgtcagctgcagtgaactgtcactcttctccctgtggcctcacatcctcaagtatgtgagactggcttccttacgtggcagcctcagaactgcctgagagggtgaagcaggaagctacaaagtctcttaaggcttctcctcagaagtcacacagtgtcacttctggtgcattctattggtcagagcaagtcatgatgccaactcagatcctcgaggaagagatggagattccaccctagattagtctgctggggctgccataacaaagtaacatacactgggtgactcaaacaactgaaatatattgtcttactgttctggaggctgcaagtccaagaacaagttgtcagcagggttggttccttctgagatctctctccttggcttgaagatggccaccttctttgttgtgtcttcacatgttcttcccaatgtgtgtgtgtgtgtgtgtcctaacctcctcttttttttttttttctttttctttgagacaggctggagtgcagtggtgccatctcagctcgctgcaacctccacctctcaggctcaagcaatcctcccatctcagcctcctgggtagctgggaccacaggcgcacgccaccatacccggctaatttttgtattttcagtagagacagggtttcgccatgttgaccaggctggtctcaaactcttgggctcaagccatctgcccaccttggcctcccaaagtgcgagccactgtgcccagccagatgattcttttttgttgttgttttcgtggttttttttcttttcttttctttttttttttttttgacggaattttgccttgttgcccgagctggagtgcaatggcacgatctcggctcactgcaacctctgcctcccaggttcaaacgattctcctgccttaggcacccaagtagctgggattacaggcatgcaccaccatacccagctaattttttgtatttttagtagaagtggggtttcactctgttagccaggctggtctcgatctcccgacctcaggtgatccgcccaccttggcctcccaaactgctgggattacaggtgtgagccaccacccagccccagatgattcttttttttttttttttttgagacggagtctcgctctgtcgccaggctggagtgcagtggcacgatcttggctcactgcaacctccgcctcccaggttcaagcgattctcctgcctcagcctcccgagtagctgggactacaggcacgcaccaccacgcccagctaatttttgtatttttttttttagtagagacggggtttcaccatgttggccaggatggtctcaatctctcgacctcgtgatccgcccgcctcggcctcccaaagtgctgggattacaggcgtgagccaccgcgcctggccgactcccagatgattctttagtgacttcttctgtctgcctggaggctgtgagacatgtgccctctaggcttgccattaacttctgtgaacacactcagctgtgacagctctgagggaactcacccacccccatattagttatctaatgctgcataacaagttgcccaaaaatgtagtggcataaaccaacaataacaatgtattctatctcttgatttctgtgggtcaggaattcagataaagtacagcagggatggattgtctctgctcacaatgtttggggcttcaggtggaggagttgaagctgggatgctggatgatacatttccatggtggctcactcacttggttgggcgtgagggaggaaaaatgtagtgattagaagagactgaagaggtccagatgtggtggctcatgcctgtaatcacagcactttgggaggtcgaggcagatggatcacttgaggtcaagagttcaagaccagcctggccaacatggtgaaaccccgtctctagtaaaaatacaaaaattagccaggcgtggtggtgtgcacctgtagtcccagctactagggaggctgaggcgggagaatcacttgaatccaggagacaaaggttgacttgagctgagatctcgccactgcactccagcctgggtgacagagtgagactccacagtcaatttctcccataatcaaccaccttctccaggcagctgctggagctgctgccccaatgcatcacttcctggcacatagcaggctgcagggaccacctcatctgcctttgccacctctcttcccacttgttcagctgcccttgagcagactggatggccttccagaacaggacaaagcaggctggccacgtgtgcttttatgccctcctccccaacccgcccccccgacgccacacacacccctccatcctctgtctgacccaacactccccacaagatgcctagaatgtctttcccagggcggcctcccttaagggtatgtcttacttattttcatagctctgtacatatatgtaaggggtgtttcagaagggtttgtgggccagtcacagtggccctgtaatcctagcactttgggaggctgaagcaggtggatcacttgaacccaggaatttgagaaaatacaaaaaataccaaaaaattagccaggtggtggtggtgtgtgcctgtagtcccagcgactcgggagactgaggtgggaggattggttgagcccgggaggtcaagtctgcagtgggccatgatctcgccactgaattccagcctgggtgacagagtgagacccccctctcaaaaagaagtgtttgtggaatagaattgattttaaaacctttttaaaaaattgtaagggctaggtgccgtggctcacgtgtgtaatcccagcactttgggaagccgatgtgggcggatcactcgagcccaggagtttcagacaacatgacaaaatcccgtctctacaaaaaataagaaaattagccaggcatggtgatgcatgcctgtagtctcagctacttgggaggctgaggcgggaggattgcttgagcccaggaggtgaaggttgtagtgagccaagatcgtgccactgcactccagcctgggtgacagagtgagatgctgtctcaaagaaaaaaaaaaatgtatatagagatggggtcttgctatgtttcccaggctggttgtgaactcttgacctcaagcgatcctcctgcttcagcctcccaaagcactgggattataggcatgagccaccctgcctgaccaatagttcaaaatctttatggtccgcttaagtccgtagttcaccatattcccctgagttctctcaattcccaaagttgcaaagaggccagtggggattctgaaggtttctcctatcagcttctctggtgctcattctcccgctcccaagggccctggccttttcccaggattcattacatggtggccctttctcaccatgtggcatccttaaaagcatggggtttgaacattcagcctgagttttgcttgctatggattggtggaatggtagtgctgggagagaggaaacatttctgcttcctctgaaccctcttatgcgtgcgcgcgtgcacacacacacacacacacacacacaaccaggaaaccttctcttcccctagcccacgtctcctcccagtctgtgctcttgcacttccagagccagataaatggaggaaaaacacagctgcagatgtagccaccccaagagaaatcagaaagtgtggaagaaaaaaagaaggccgggcgcggtggctcacacctgtaatcccagcactttgggaggccgaggcgggcggatcacaaggtcaggagttccatatcagcctggacaatatggtgaaaccccgtctctactaaaaatacaaaaaacttagccgggcatggtgatgcatgcctgtaatcccagctactcgggaggctgaggcaggagaatcgcttgaacccgggaggcggaggttgcagtgagccgaggccgcaccattgcactccagtctgggtgacaagagtgaaactgtctcaaaaaaaaaaagtgtgcttaagtgactgctgtacccctactgactatacaccaccctcccctccatattgctctgttggagggtccctaagaccccttctcaatccttgttctcactccctgccactgcacacagagcttgatggcaagccgaatatggtatctccttgaaagtgagagaaacagttgcatttagaaggggaattcacctagcaggttaaggaaatggcccaaatggagatctctaatccccatgcctgtttttaagttgccatttgacccacagtggacatctctacaggaaggccagtaagtgcccgagactcccaggcctccgagctgccccagggcccaggaacgaggtcagatgtgataacggctctgatgtggccaaaagcttccatcatgctaagcagttccaaacagtcccgctcgtcaggcaggcccggggcagtggtgggtagcgacagtgtgatgctcggccttgcccccaaagcttaagcctttgatggcaaaagcacactcggctctgtactgagctgactgcctgaaaatattatagaaaacatctctcccttggcggggagagatctaagccccagtgaccggggagtttaaattttcgggatgggtgaccgaaggctgctaagaatatccagtcacaggcctgaccacaagccagttaacgccccgagtggcggcttccatggtccttggggcatgggaagaaggagccgactgggcagccagtacttgtggagtccctcagcaggaattgtgcagacacaaagtaaggagtaaaataacattaaagaaaaccaaccacctgatcgtgccctcaaggaataatctgagaagggaagacattgacctaccatggggtacttactgtgcgttaacagatcaaaacaaggacaaccatgcagaagggaacagtctccgagacaccaagtgccaacaagggaccccaggctggcttcccacagccagatggggtagttcttgtggcctggcagctggcagcctgacagaaagtcaggtaggcccagggtacacattctaccctctagccctcagtttcctcatctgcagagtgaggggtttgggagtcctgtttcgtcaacattttgggtgtctgaggccctctgggactctgatgcatgtacccctggcaaagtggacatgtgcacgagggccaccattttcacagcatttccaggggtgtccggccccaagtagaccagccccagatctcaagtgagggctctgaggtttttgtatagaggagagactgttcttggagggctggaagtggctgggaagagttcatggagaaagcaggatcgaagtttgggcagaaatgagatggctacaccttcattcaatgaatgccatgagcttcaacggtcagcaagcccaagggatggatgcgatgacaaagagaccagagaggatctggaatcgtgtgcagcaccgtttccagctggagagagagagcccattctgctccagccatgtgggctgtccttctcttcctcaggtggtccaaggttggtcctccttcagggcctgtgcacttgttgctcggctacctgaaactctctttcccccatactcatgcagctggttccttctcagctcaatttttcaaagaggcctcccaagccatcctggctaacactgccttccctcccactactctcagccacactgctctgtttcatcttctgtgtggcacatgtcatcatctaaagttaccttatttgctctgtttatggtccatctcccataggataaggaccttgtcagtcctgttctccacggtgccctggcacccaggacagtgcttggcacagagtaaacaactgccaaatttgcaatgaaccaaatgaagtaattatagccttaacgctagatggctgtgcactggggaggcctgtggcgtagaggaagggcagggtggtttgagagggtgaggctgagccactaaactggtctggatgactgtttggggaaggtatcttggaggaagtgctgtttgaacagagttgtgaatgactaagtgaagcgggtggagggatcgcaaatctaagccagctcccggtggcaacggctggatgtgggaaggggctggaaacagaagcccagagccaaggtctgaggggcagggcccagtagggtggctgagggcttccatctttatctcaatagtgaaagccactggagcaccctcgctctggctgcaggatcaacccccgccccccttttacctgtctgatcattcttcctcttttgcaatctggccaccctagaatcctggttgttccttaaacacagcaggcagtctcctaccacagggcctttgcactggctttgcctctgcctgcaaaactctcacctcagaaatcttggcttgctcccccggctccgttgagtctttgctcacatctcactttcccaagagacctcccctgagcaccttaatcctgcaaatccttctccccacaccctgccttccaggtgcttctttcctgctcccacttttctttccatggcatacatcactgtccaccatccatggtaattttgtgacctcttacctttattgcttatcgcccatctctctccttctggaatacaagtaccccgaggacaggtatttgttttgtttcctggggtgtgtcgggagcctggagcagcacctggcacccagcagcagtggttatttgcgggtgtggttgtggctggtggctgctgtgggggccatggactgcagaggggtaggagccagaggagggggcccagtgaggaggccattgccatggcgtaggtgagaagctgtgctaggcagtgcagggcgctggatgtgggggaaatggatggactcctaaaactgcgcagagaaaagaaaacggatttggtgaagggtcggtttggggagtgaagggattggagaggtcaagggtgattctcaggtttctggaatgtataaccaggtggttggtggggaccagggagaagaagcagttttaaggggaggaagagagaaggggcattcctgcagggaacatgcatgggccacaatggggaaaggctgtgtctgctccgggcatagcggaaaacccaatttaggctggagtggaagttcctgcagagaaggtgaggaagacagggtgggggcctaggcaacccgttaatgctgccaactccacgctttcactctggaagcctgggccatgcctagggctgccatgatgaagtgctgccaagcctccaatacggcacatctgcctggcgcatcactctcaccccgctcctccccccgccccaactgtggagcagtaagtttgcttctattcacgtgattttattaacaaaatttgcttccttgctgtctctagaagcagcacactgccctcccccaaccccccaacttggctcagagcaaccccacactcctgctatcaggtcatctgcccagagtgtgattgcagttttaaaactgattcctccctggtttattatttttttttagtttctattttttattttctggaagtacagcacacagacagaaaagtgtacaaatcctgagagtacagcttgatgaattttaacacacccatgtaaccagcttccagatcaacctgcagtgttcccagcccccaaggagtcccactgtgctccccatctccaaggataactccatcttgactcctcttcttttttttaatgagacagagtctcactctgtcacccaggctggagtgcagtgctgtgatcacagctcactgcggcctcagcctcctgagtagctgagactacagcacgcccaccacacccagcttatttttgtagtttgtgtagagatggggtttcaccatgttgcccaggcagggcttgaactcctgggctcaagcgatccacccacctctgcctcctaaagtgctgggattacaggagcaagccactgcacctggcccatcctgacttataacaactcagattaaaacctttgcccactttaaaacttgacataggcaaagcgccactgcactttagcctaggtgacagagtgagaccctgtccaccccccaccggcaccaccaccaaaaaaaaaaaaaaaaacaacacccaaactagatgtaaatggaatcctattgtgcatattcttttgaggctggcttcttttcatttgcaaggtgttgtgtgtgcttgcatcttaaaaaacagagtctcaggccaagggtgatggctcatgcctgtaatcccagcacttcgggaggccaaggtgggcagatcacctgagctgaggagtttgagaccagcctggccaacatggcaaaaccctgtctctactaaaaatacaaaaattagctgggcgtggtggcgcatgcctgtaatcccagctactcgggaggctgaggcaggagaatggcttcaacccaggaggcagagattgcagtgagccaagatcgcactactgcactctagcctgggcaacagagcgagcctccgtctcaacaacaacaaaaacagagtctcccaagcagcctcccacctgaggcaagggatcagggcccagtctcaggaggcccctgtagcctgtggaatactcagtagaggaactagggggtcagtggagactttgtgtggggcagaggacagcattggtgttttaagcaaatgacatgctaagcattgtgttagatgctgcctggatacaaaagtggaagatgcggttaagagggggtgaagggaagataagactggatctagagtcggccaggttgtaagaatgtcttgggctgggcacagtggctcacacctataattccagcactttgggaggccgagacgggtggatcacctgaggtcaggagttcgagaccagcctggataacatggcaaaaccccatctctactaaaaatacaaaaaaaaattagccaggtgcggcggtgggcgcctgtaatcccagctactcaggaggctgaggcaggagagtcacttgaacctgggaggcggaggttgcagtgagctgagatcgcgccactgcacaacagcctgggggataagagcaaaactctgtctcagaaaaaaataaataaaataaataaaagaatgtcttgaactgcaagaagaggaaagaaagtgaaagctcacacctgaggggaggacagaaaggtcagaagggttgtgactccccgcctcccaaaaagatcccctcagtgctacccttaaagtcactttcctgaaagggggggtccttgccttgggggaggagacaatttcagttctattatctcagtcatccagaaagacttctctgtgcctgtggtgtgttagagagaagacagatagggagggaggaaaaggggtggggggggtggagagagagagagagagagagaaagagtgcgagcatagtatacttcctgggaaactatctctcgaatagtagttctaggaagcctcatgccagagggcagtagtactggcctctgccttcttgatggtgcccttggacgtcagaaagaggaggaagcctcagggattggcagagacatttgagagtttcagaagctgaagtccagagagggtgagcgacttgcccaaggtcacacaccaagaaagcaagcattagaaaggggatcgagtgtcccctccatggtttttccatgatcgtgtaccaccctttcactttacaaagagcctagtgttgccaccaaaatagctgaattacctcatttttgaaaggcgttatgaattcacttctattatgtggaatggggcagagatgttgtgagcaggcatgacattataattcatattccacttcttctatttatctttgctgggttttgtgtatctttggaagcagccttaaatcattattggaacaaagtagggagaaaaataataatatgtaattacaaatgaggaatagaccgtatgatcctattaattgccttccctgcaatctttatttttggtattttcagaataattaacggcttaggtctcgattggtggaggtggtgggttagcactgaactctaaacagtaacatcacctactccaggaatggcccagtgcgatctgacacctgggacgctttcagggcaacaccaagggcaatgctccagtctgtatttactctcttctgaggagaaactctggcagcagctggaaaataaaacccaaagcaaggaagaagccgaaaagaagaaatactcaaatacgaggcgcattaatcatcggtgtcagatctagagcagaggacaatggctggtttgaagaaagactgaacctaaattatcttggaaactgatcttctctcctccgggttccctgtgcctgcaagcaggggtcccggtgcagccactggcatggaaccgatgggggcatccactggctgaccagcatgctttgtcacaggacaggttagagatgaccaccttctgtctgtggatcatccatagcttctgcttaggaagctacagaagagaaaaggcctctcacagggacctgcaggacaaattcattgcccatcgtgtcctcaggggacatcatttgcatgccaggatgcagtaaggccactgccttcagatccaaataaagcacccaattagcatgaacttgtgcaattggcagagtaatgaagctgaccacaggtgcctggaaagtccgaaatttagttgctagtgttgcaccgtgatggcaggggctgtgacggcatgaataagtctgggctttgggaatgggcagtgagcttccaggcaagcaggcaaattaattatcctctaagcctcagtttccccatctgaaatgggaataataatagtacctttattataggacagttttttttttttgagacagagtcttgcaccgttgcccaggctggagtgcagtggcgctatctcagctcactgcaagctctgcctcctggtttcacaccattctgctgcctcagcctcccgagtagctgggactacaggcgcccaccaccacacatggctaattttttgtatttttagtagagacggggtttcacggtgttagccaggatggtctcgatctcctgacctcgtgatccacccgcctcggcctcccaaagcactgggattacaggcgtgagccaccgcgcccagccatataggacagttttctatatgacatgagattattaatgtgtataaaatgtttagaactgtgcctggcagatagaaagcccttaataaattctagctattgttcttctaggagctgaagaacattagtgactctcttttcctcaaatcccaagagctcttctgcttcagaagagctgtgtgatgagttcttcccatgttatcccttcgtgaactaccttttcccatggtaaggacaagagtagtctttatggaagctcaaaacggggaaaagtgttgcccaggaatatgaaagggcaaggtagcttataatctcgccagacattgagccataatttagtattggtggaggtacaggtatttttcaaacagaatctatttgttctggggaggaagtccttcccttgaacatcttggccccacacttttttttttttttttgagacacagtcacactctgtcacccaggctggagtgcagtggtgcgatctcggctcactagagtttccgcctcctgggttcaagcgattcttgtgcttcagcctcctgaatagctgggatcacaggcgtgcaccaccacacccagctaatttttttatttttagtagaggcgaggtttacgccatgttggctaggctggtcttgaactcctgacctcaagcgatccgcctacttccacctcccaaagtgctgggattacaggcgtgagccaccgagcccaggccggccccacactttttcaaggcttacctggaaggaaggcaactcttcattcagatgatcaattcttaggttcccatggtgaacacaacagatgagctgaggcctgctgatcccagaaagaaagaaactccttttatgatacttactgcagttggcgagttgccaggatgggcccagaaggatgcaattgcagaagctatgtaggatctggtcccagaaatagttaaaggtttggggaaacagtgcatatgcatgacagacaaacaatataccctatgggaaagagcctaggtttggagtcaggtagaatccccgtagccacactctcctagattagccatgtgttttggcgcagtggctcacgcctgtaatcccagcactttgggaggccgaggtgggcagatcacaaggtcaagagattgagaccatcctggctaacacaatgaaaccccgtctctactaaaaatacaaaaaattagtcgggcgtggtggcaggtgactgtagtcccagctacatgagaggctgaggcaggagaatggcatgaacccgggaggtggagcgtgcagtgagccgagatctcaccactgcactccagcctgggcgacacagtgagactccaactcaaaaaaaaaaaaaaaaaaaaagtgaatggtaatacctaagccatagggttattttggggtgtgagtgagataacttggaaaagtacctgataaagtaactgaaatgaacaaaggtccttaataaacagtagctatttttatcacataggaattattcattgttaaaagacttgctttgctatcaaaaacagcgcagggacacagttactgttagaggtcaaatggcatggaattcagagaactccaattgcccagggtcagctgtgagaagaacctacacttctggtttcttagggtctcaaggagaaagacagtctcaatcttctgccactaagttaaggaccaaatgattggcaataggcaaagtactctaagaaggctctggtttgggttttgtcttccttttggctttctcatctcctggggatgatattctgcaggacttagttaaggacaggactcccaaggcctccccaccagcatgcacaccaggtcacttggctcctccagccgacagagacctgtacacaggtgtcccatactcccacgggcctccccaaaagacagtgtctcccccagccttatgcttcactttcctaatttcttctgccccaatcctcaccagaactacagagccactccccaccagtccaggtaccccctttcctatagcaccctctccacaactgtcttgttctcttgaacctggtttcttctctagccaggatatagaataccgattcagttagcaaaaatgtattaagtggctggctacagtggctcacgcactttgggaggctgaggtgggcagatcacctgaggtcaggagttcgagaccagcctggccaacatggtgaaaccctgtctctactaaaaacacaaaaagtagccaggcttggtggcacacacctgtaatcccagctactcaggagaccaaggcagcagaatcacttgaacccgggtggcagagattgcagtgagctgagatcgtgctgctgcattccagcctgggtaacagagtgagactctatctcaaaaaaaaaagaaagaaagaaagaaaaaaaaagtattaggcatgcaatacttcatttattgtttatcagatttttttttcatcaatatgtggtgagcaccatgctaggcactgggcacatacagccagaaacaaaattctgagaacattatggatatatgtacatcgctgcacactgatgcaagcttagcacctggtgatgatacactgtaccattatggacgatacggtcttgctgagggaggtgacctcccagggaccaacccgcagagcctattcaggagctgatagcaggcctgtgtggttggccttcagagggtgagctaaacactggcaagcaatgaagtggccttgttaaggcatttagattttgttctaagtgcagtgggaactagtggggtagtgacattcaacactttttttttttttttgagacatggtctccctctgtcacccaggctggagtgcaatggtgcaatcatggctcactgcagtctggaccttccagggttaagcaatcctcccacctcagcctcctgagtagctgggactacaggcgtgcaccaccacacttgactactctttttttttaagtggagatgaggtcttgatcctgtctcaaaataaataaataaataaataaataaataaataaataagatctttctagctgccacgttgcgggtggactggaggatagcaaaagtggcagcacagagattgctagaataatcatcctgtataataatccaggcccaagatggtggcctggcctcaggtggatgtaggaaaatgggaagaagtaggcttactagatagactatttggaagtagaatgggttagctttgccagtggactggaggaaggtgagggggagatgaatgaaaatgggtcaaaaatggccccctaggattctgctttaagcacctgagtgggtgagccattttctgtgatggggaagggagttaaagcaaagagcaggttctaaaggaaaagctcttctctatctaagagacatttgtcctgctcaccactgtttccctagcacccgctacaaggcctggcatttattaaatgcccccaaatatttgtaaattaattcctctttttagaattcagttgtggctgggcgcggtgctacacttgtaatcccagcactttaggaggcagaggcgggtggattacttgaggtcaggagttcgagacacatgccaacgaggcagtgtggcaaagtgattaggaccatggactctgaagataggactgcctggatttgaatcctagcaccaccattttctaggaatgttcagtaacttctctgatagtttcctcatctggaaaaaatgtacataataactctgcctaccttatagggcagttgtaaggattaatagttaatttatagaaagcactttgaagagagcttcaacctaacaggcgtgatgtaaatgcttgctattgttattaagctgagcgtagatgcaaagttgagataccaagtttgaagtttgatatggggatttggaactagaaaaaaaaaatgtaagtcatcaataagtaggtggtatttaaagccataaacctggatgagactggtggggaggaaggggaggatccaggcccaaggcaactggtagagcatagaaaagcccacaaagaaattgaaagcggttctcagctaggatgaaaaccctgtgagcaagcagctcaagggagcagtggtcatggtgtggtaaatgcttctgggaggccaaggaaggcaaggactgaaaaacaacgccgcccccccaccccggcccccactcctggcaacaaggaagtaaccagtgatcttgagcactttctgcagaatggccagggaggatggaggggttgaggagtgagataaatgaccatgtgtctatacagtgaaattccaccagcctggaaattgacaaggcctgtctccatgtgttgctagaaaagtaagatatattgataagtttcataggtgaggtacagaacagattgtgcagtgtgttcccatttctgaaagtagaccagaggacatgcatatctacagagaaactgggggggaagggggcactcccctgcagtgttggaaatctttaatgcacacacaaatatgtgtctatattcccccctattttgtttttacacaaactgtagcagatggtacacactgctctgtaccttatttttttttccttaactgtagaccttgggggtctttccatatcaatacacagagcagatcttctttattattttaacagctacagaatattccattgtatgcatgtgccatcaatgtcactgctgactctttaggttgtttataatcctatgctgttataaacaaagctgcacttattccagtgtcttaaaataacttcatgactagctgatttttagagtgaacatgaggtaagcctgcagaaattccacatggatggagacacctctttcaagaagtccaggtgtacagggaaacagataaatagggaaccagcaaaggagatgcgaggttaagaaggggcattataaagatgggtgatgcttcaagcaaagaagtataacaaggggcctttcaagaaagggtatggggggtgagggtggaggcagcaaggaaaagcctctaagaaggtgatattttagcaggtatgaaacgatgacttaaaacagtgtgagatcctatgttgggtgctgcgggaacatcaggatggatggacagacactggccttctggaaggttcaactccagcagggaagctgtgctgtttcacaaattggctgcaatattgttagaaagtggttgattctcggccgggcgtggtggctcacgcctgtaatcccagcactttgggaggccgtggctggtggatcacctgaggtcaggagtttgagaccagcctgaccaacatggtgaaaccccgtctctactagaaatacaaaaacattagctgggtgtagtggcgggagcctgtaattccagctacttgggaggctgaggcaggagaatcacttgaacccgggaggcggaggttgcagtgagccaagatcatgccattgcactccagcctgggcgacaagagtgagactccgtctcaaaaaaaaaaaaaaaaaaaaaaaaaaaaaaaaaaaaaaaaaaaaaaaaaaaaaaaaaaaagaaaaaggaaaaaagaaaaaaaagaaaagaaaagaaaatggttgattgtcttagaggtacaggatctacaaacttcccactgtggtccctgctggtgaagtgtgctcagagttccagaagttccctgagttcctgataagacaggaagctaggggagaggagaatattttgcctgaaatgttaagatttttttcccccatagggattcaatgacacgcatgccctggaaggtttcaaaaattggaaataaataaaaattccaagaagaatttatattcctgatggctatgctgatggtcttgtaaattgtatatttaatcaaagacactcaaatgtcttttttttaactattgaagagctatttaaatgtcaacataagtgattccctcccaaatagtgctgtttatacattacttcccctaatagaccataatgattcataaggaggcatttctcgcctctaaattgtaggcctattgaaatataaattaagatgataaataatttgaccttacctgagagtactaagtatttacatgtgtcaaatacgaaattaccctgaacatcatggtccctaaaaaggcagccttcctctcccgggtgaattcattaaatgaaacgggtttataaatttctcttagagtgtggaagagagagagaacacacaaaagaacgggcccggggacccggccgtccccgccctccagctttcccatgaggcccggggggccgcggaacccactccccggcggggagaggcgggtgcagaccgcccccgcgcgcttcccgcgctcccctctccccctccttctgcgacgccgcaggagtttcaaaacatggagtttccacaggaactttgccaggccgagctcgcagccctcccgggctcccgcagcgggattcgccgagtcggcggcgccgcgcggcctccccgccccccacgccctccggggagccgctgacccggcggcctcgggcagctccgcaaaaccgctcggtggctgtagaacctggggaggcgcgggggctccggggctccgcacccccgccgaccccgtccgggccccggagggtggcagcctggcgccctccgcggggccggcgccgagtccgtccgccggctctgttggcttggctccgccgcccggggccggggccgaggagcggaggtcgccggccatggcgagcgaggctgggtacctggccgcccgctctggagttttgttttgaagcccggcgtgggggaggggcagcacctcatcaaggagaaatttcctgttcgcaagcaagactccgcttgcagagtttctgtcctgcccttgacctgacaagtggatctcggctgcgcgggtccccgagagtcgagccagccgcgccaggagcgcgcgggggtgggggtgggggcacccgcgccgaggaccggggagcccggctgagcggggccgacgcctgccctcccggttcccgggcgcacccgggagcgcagagccgagcggtgactaatctgcggctccgggcctcttggcgcgcagcccgggttcgcctcccgccccctcgtctctcctcctccccgccgccctcccagcccagcagcgcagcgctccgccgagcgaatcgtgcgggccagggccgccgccgccgccgcgttcccgggagtgtgggaagcgggtcgaggcgggtggctcgggagccgtctccagtcggcctccttcgacccgggaccgaatgtgcatgtgttaccttccccttaagcactttgatcagcgttttctcctcgcagccgaggagccagagcgaaccggggcttttaaccccctgcgtgccggctccaccgtgggctgagggaagagggtgccgcagggagattggtcgatacagggtgcgatcagtttggtttagcaagcctgagccaggaggagcccggccggatccgaggagcttgcccaagcgcgggacgctctcctgtggagagcaggccgctgaggcccgaggcgactcgttaatgttcaagctctcccaggggcagcgctgtaacgcgacctgcctggccaggcaaggtgcgggcttgaaaggcccggcgggcggaggcttctggaggggcccgggaggccatggcgggacccgccttcacgcacccggttcgttggcgcgtgggtggctcctaaccccggtggaggctttgcgctcgcctcgcggactcggctctggccgccgctccctcccctggtccaggcctcgcttgggagttaatgattgatttactggctccgcgcggccggcgccctcccagctatttgtccaagctgaggagttgctggcgagcagcgcagtaggccaagagagcgggggtcgccggggaagggaagccacgctgccgacgggaaggagaggccactagattagctcccacttggcggctctagctgtgtcggggcaaaccctcaggaagccgggcccgggcgaagggagcattgggaagctccacatgtaaatgggttggcagctggcgattaggccgcccgattttatgagtcataatgggcctcccgcctggccctcaacctgctcgctgtggatccggcgcgcttggggcccaagtggtggaccattccggccgcgcagagggacatgcttctgggggcccaggccgccgaaggagttgagaaggactttctctcctttcttgtagaaggcaacacaaacaccctaaatcaaaccgctccgacaatcgaaggctccacacagacacatcaataaggatttcgcctcccgcgtatgaacgcacagaaacacttgtcctatttttatgcaaatgacaccacacaaatagatctcgcaggcccgggagaggggcgggaggaggaggggcgccgccaccccagccagggggctgtgagaggggaggggcgccaaacccgcaccccagggcccgcgccggctcgggcgcagcggggctggcactggtcaggaggcccgccccgcgggcagtggctccctgccagcgccgccaagtcggccgcgtccccaggctgcctgcagaggcggattagggaaggagcgaagcgagcctgtgactaatcgcggggcctcggaccggagcaccaaggccatgtgcgactgacaggaccgacactagcagaggacacggcgacgcctcgcttaattgcaggcttaaaaaattgccgcctgagcagctctggcgcggagagccacggcttgcgcgtcgagctagggagcgcgcgcgcttgggtgggggcgggggttcctgctctctcgctccaaggttggaacgtttggcgtctcctggaccgagggacctggcccttgcgtcccccactctgctgggtcgccccgccccgcgtgccgaccaagtgtggctgagcccgccaggagagtacgatccagcctccagggctaggtttctgacccgaccctttccccctaaatccgacgtttccccgctttcgccctagatcctatacgggagggggctgtgcagttgggggtgacagattccaacaaatccttaaaataaaaaccacacgcacgaaagaaacactttctcttccctccccttcttcaccgactgatacaaagccccgaatgaccaaagggaaagaggtaagtcggggctgcagggagcaaggtcatcgagtgccaaaacctcggggctcacagacacgcactctgagttcttcacccctggtcacagtctctgtggcccagaccttcctggagcactggggcctctcgggggcgaagggagaagcgtcgggaggccggcggctctgtgttggggagggggagtgggagggagcggagaacccagcgagagaagtttccaccacgctctggccggctactgccaaaatccccggacccctccccgcctgcaccgccttccgttgccaccacaagtttggtttaacgagagctcgggacaaaagcaaacgttttctatagaccccgaaaacaaaggggaaagagacgcgcggggccgcggagaagcggctgctagcgtaatggtgccaggccgaaagcagagcattaaaactgcaaaagccgcgcgggcgggaggaagtgcgaggcgggaggcgggagcgcggggagggcgggaggcgggagcgcgggcgggggaggggcgctgcgccatgtttccgtgtcacccgccgagtcgtcggcgctgggctcggccgccggctcccgcctgcctccgtaacagcagaaagcgtgcgattagcagccagacaggcggggactccgggcccgcggggccgccgcacacgccgcccgcggcccgagcccgcgccccccgcccgccgggtaatcatcctcctcgctgcagcgctgtgtgcactctcattagagtagggaggcttttctctgtgcactcgctcggctcccgctggcaaaacaacgccttcccgggccgggccctgggccaggagagtcggggagggtgggacggaggtggggggtgggtgaggcagggcaagccttgcaggtcagctccgccgccggatctcctccggacacggaggagacggggagcgtccattggcccttccctaggtggagtggcaaagtccgagccccgcagccgaccctacgtccctacgtggaggggggcgggtggagtaccggtgccgccatgacctactcccgtcccccgccggaggctagagtagggctgagggggagatgagtgtgtctggtttggagagcgggggcggacactgggaaggctcccaaaacaggttttgccccatctgttttatgaacgacctcttcaggccagaagccggatcccaggggtggcggcccttcgaccttcgaaaggagacccgggcccccagcaggccctctggcttcgcgctctgtcgcctgcagtgggtgggagatgggggtggccgaggcttggctgctcctggccctgagcttcggagccctattttctcctccgcgatctctgcacacaacagtaggcagcctctcacagcagcacgcgcccagctgcagggcctgggagcaggtgttcctgcccggccggagtggcggctccgcgcccctccggtcccagctgcggagctgcgagcggtgcgggggggcgtgcttatggtggtagcagagggacagggacatctcatcggaccgcaggaagggtcctctcggcttacaccgggataccgcagggcccgggtggtcgcctggggcgaggagggatcaggggtgacgcgcggccagccctcgtctggaacagccctggggccagcggaggccgctcggggcggcgcgagggcttccggtccccgtgactgcggcggcggcggcggggcggccgcgaggagcaccctcccctggctgctgccgccgcgcggctctcggaacggcgccccaggagcctctctgcgtctggcagcgccgctttcggcttgcgctgggatgggggccgcagggtggtctcggcccagcccccacggggaggggcggggaggcggggtccggagaccccgcgggaacggccgcgcgcctcccagcaccccctcctcgccgccgccgccgctgctgctgatatggcgggcacgtgaagcgcagcttggcgccccggcgccagccagggagcggcctgccccgccgactcagcttacccgcgggcccaggaacgcggaaccgagcctggccgggctccgcggagcccgcacctccgcccgcagctcgctgcggccccgcaccctctccccgcctgagcccggccttggggccgcgccaggcggctcgcccgaggggaactcgggctgactaatgggacgcgtgtgggccttacgtgaggcccggctgtcagcggatacccgcttgctcggagcttagaccgcggccaagcttttcggggaagggcgagaggaggggtttccccgctgggcggtttcagctccccagggacaatccgtccgcggcaggccccaacctttggatcttgcagcctggcttggagacggtagacttggcatgtgccggacgccacggtgccgacccggtcgggggcagggggtgggagcctcggggttgtgagctgggggtgggcagaggctaggtcagcttggtctggggcgcccgccttgaggtttgcattctggggctagccactgggccggggggaatttgcagggcgctctgaggtcgtggagtctgataccaaaaccttcctcgacaaagtcttccggaaaccccttcgcgaaattcctgtgcggaaagaaggatttctaaaactccccgagggtccggttcggctgggagctttcgggttctagggagtgtgatttcctttctctccctttataggggcctataaatatcagaagagtttcttcttatttcgcattaacaaccacttcatgttgacatagttatatgaccctcccaagtataactacctgtttagtttgaaggcactgagtgcgatggcgaaacacaaacatcgaccagtaactaagagaaggaaaacccagccgcgagcttgggttggatacaggataaatcctcatcacgcatccctggttttattcagcctaattgcactagtaatcctgccccccgcgagaaagcctgaaatcctgcagtcgaggtgcgacttttcctggggagccccgccaatggggggtgggttgtcagtggaggggaggtgggttttaaatgtcacttccaaatgaaaatctttctttcttttctttttctctttttcttttttgatccagttttcgaaaagagcatttttgcgagataagaagtgaccgatcaaaatcgctaaggggaggttgtaagcagccgctttgccccagcttagcgttatcttatctctcacacttgcatggcggaaaaaaaaattggcttatctttatccccacccccttctcgccttaattgctaaaaaacactagtgtgttaaaccgggaggaaggaggtctctggagtgtcagtggaaaaggaagattcaaaaatgtgggctcccgggggaagcaagggtggcagaatttattctttcccccaggcctttctggtacaacacagggtgtagtccagggtggaaggctgggtggctctttttttaaattattattttaagaacaaaatctgggcttggccttgggtcgtgtggcttccccaggcctcgctttctgaacttctcccctccttcatctctcaaaagctgctggtgggtctgggttgaggcctctcactctgccttcatcctccctcctctagacacatcctccttttggggagggggggatgcaaggctaggacacatagcctgctggaaatcattaaaatatatgcgagtgtctgcaaacacacacttttaaatcatggcgtttcccctccacgctggtctatttaaactccagagcgagctggatctcctccctctcagtcgtttgtctgtgtcaccgacaggccgctaatggccgggcttccaggcgctgtgcattatgcattagcctcctccctccgccgcacacagaaggttctgtcaggccgcaccacacaaaccaccctgagcccccccaccccaccccccgcactcagggccgggggctgcgcggctgctaacgcgctgggaacgcaggtatggagaggaggatgagcaccgagagcagagtggttcggaaggtggaatgggagcgggtgaaatgtgccgaagattacaccgtttggaatgcccagtccgttgtgagccccaaagctttgctcctggctgcgaccttctcgaggcaaccatcccgcgccactcacctctgtgaccgactttgttgggggcgggagggcagaggtatttagagacagatcagcaccgctttcccttctgctggtccgtacccaccttcctgctgcaggcgaggggctggcagagccttctctacccctccagttcgggagtggtaccgcgaaggggttcggggtggtgcgtcttcgcagggacccggtgggagtggaggagggaagctggatacaaaatggctggggccggaggccggcacactgggtccgaaggcgagtagttggtggttccccgccccctctcccggcggttcccactcactgcccccagccgggtaaaatatgcgcagaaggcgccttgctaaataagcagccgaggcgggacgtggcgtccgggtttatctgcaggagcacccggcccagcgcggcggcgtcgagggctcttaagcccttgccgagcgcaagaggcggccagcctcccagaagcctcctgtattatgcccatttggtcgacacccaaccaccctgcgggcccccgtagtgtagatgccagttcacccacacgtgcctgtgttcggggagctcagggcctgacccaaatcgagcccagaccagaaattccaagatggttgctaggaaccacggagaggctgcccttagggccttccttccccaaacacccaataaccctccaaaggctaggaagaagaaagaacagtcatgttcagcctggcgacccttaagtccagcagtcttctgccctgggaggcagctacctttagatgtttccagatgagtgaaatcctgggaggaggatgcgcctcctgtttgttacctcgtttgagtttcagaggggaagccagctgtgccttgtgcttggaggatggggcagcggatgttttttaaagtgccattggataagcccagagttcttgtacaaagtgaccagaagactataagtgtgggtgtgtttttaaagaaaggctacctcacattatgtaaaaatacattatctgtactcatccgagtcccacctgttccagtaccaagtgtcatcgccctgagaacagcctccgaggaggaccatcggaagcctacacatacgttataagctttatgatgtggatcctagtatacgttataaataaatcttgcacacaaggttagaaggccagggtccccccaaacacaggatgcctggcctttcccctaggccagggtggagctggaggtgtgtgggagaggccctagcgggtcttgcagagtcaacctgccttgagaagggcagccaggctcaaggcctgctcctagaagggccagctcgattgcccagttgcagggcctggttagcctgaggtcgagtggtttgttataatcaggagacacttccatgggaagggagattggtggcggaggggcagcccccgctgctccatccgcagcacctctcatttcggcacctatttctttatttctccgtgggctgcacggcctcccctcccatgcactcctttgctcactctctcctcctcctctgttttcattgaaatcctccccttgctgagtgctgggtatagcagcctgacccccgggtcagctcccgaagggcttgtgggagggcaggagaggagggggcaggagaagggccaaaccgccggcacccattgcaggccccgcggcatccccagctccctgagccccttcttaagtgaggacacaagatgggattgcccttcgacagctttctgcttgttttccccagaacaattggaactaaccgggccaataggtgtaatctcccctccccccctctgccttatagcgcctcgggaaaatcccacattttaattcccagtgagtcacgaatcccccccaccactcatgcctcttaggactcccttaataagatatttttgaaatcccacggagttgaaaaatgtatccctaggagatggaggagaaaccctttaatcctaccagcctaccgtggaggcaagatccctagaaaaggtgggggaggatgttgcaaattacgtcaaaggcgaatttactggcctgtttgtctccagcatcaaatttctcccccagtcagccctcccctcggccccttcgcatttacagcacccccaccacccctgttcattttaactctaggacttttttttttctttttcttttctttttttttttttgagacggagtttcgctcttgttgcccaggctggagtgcaacggcgcgatctcggctcaccgcaacctccgcctcccgggttcaagcgattctcctggctcagcctcccgaattctaggacttttaaagttagacaaacaggcctctttgtcagcagccccgggaggccgtaagactctgagaggctgcaggccccgagctcggttcctggattttctaaaagttctggacgtttacatgcgacttcgaactccgagaaaagcctgtgcctgggggcagagttggggagacgaggggaggggatagaaggtggctgggcgccgggccagggcctctgcggttcggcctaaccgagccggaagagcctggcacggctccacactggcccaggccagttctcccgtccagcctgcagcagcagagcggcctcctcgcctggaaccacgttcagagtttccccacaaatacccagcttcagccttcccggttatttttgacttgttttgaataaaaggagtcgcttcaaaaagaaatgttgccacaacacacaaccagaggccttttctccagctgtgtctgtaactcgcatgcgttcaatctaataacttttaatgtctggtcctaaaatgtctttataaaaaatagttttacagcataatagtccaggtgtctttctgcttgttaccggagattaaaaaaatgtgtgggttggcttgcagagatatccacccccagaaagaccaggaagaaaaaagcgtgcattccattctgcaggcgctggtcctggaagcgttcgcggcccagcctggctgggcactgctcgcgggggcacttgctcgcctgtcttttgcatcagttgttataagcagctctggagcatgaagatttaattctgccgaagtttcgggtttcaaacggtagagatgtttcacttctgctttgagaagggctgtttttataactatgtgctgagaactaaaacagaatgaataaaatcgcacctaataccagtcccacagtcagtagtgagtctaatttttaaaagggaaaatatctgctagctagagctgattttggccttgaccttgacttagtaatcaacttgagatgcttttgattatttttggcatggggacactccaggatattttaaaaactttccgtgtggatttacaagccacctccatttcagatttatgtttcatggagcctgcaccatcttgtccttaggcagaaagagacaccccacccccttcccagtataaaaagaccctagtgggcagccgaatggggtcaccattggccgcgaagtccgggcccgcagtctgggcgcggttagtccggaataccccctcccccactcctaccccttcccgccagcttcaccaactagggcttctcggctcgcccttgaggctttgcgctccggggaggccggaacctcgcttctccgcttccccctccctcccgcctgcccccgccctccccccgcgcccagagccgcgccgggtgcgctggagaagctcaatacgtgtcaattgaattgaactgctgcgggcgcaggctgtacgccgccgccaagcaccgatcagcacgacgttaccgagtggaaatttatggggcgaacggtgtaagccaaaagttgctccctgtcaaggaaaataaaacgcgggagataatctcccaacgccggggcgaggggcctgggcagcccctccaaccatcagaggtacagaccgtgaaaatgctcgagaaccgggagaaatacaggcggatctccgctcgccgaccgccccccacacgcctcccggtgcctccacgggctgctccccccttcccccacctccaaacaattcccacacaattgaaacgtccggggaactcgggcgcggagttcaggcggaacggccaccgttgcctggggtggtgttttcaggtagcttttaacaccgaaatgggaaagggctcctctgggaggaaggggcaaactggggtgggggtgagcacgggagcacacaggccacgctccgctgggtctcggaggggacgaggccgggagagcgcagcgctggtggcaagaggcggcggcagcggctgctgccgctggggtttgacagctttggctgagcggagtgcgaggcgctttatggtaattgcggtcctccactggccttctgggtagcgaggggagtctcggcgcgcggctgggagagccgcccccgccgcccccatcccttcggctctggctctgccggcagccctcgccgccgccgccgcccaagtcggtctccggctcgcccaggacgtgcgcccgggtcgggcgtgcgcagccaactcggcccgagctggggaggggaggccgggggacgaggagggggggcgccacccaagtggtccggggttcggatccagagaggccaaaacgtgccgggccgtgcatcgatgacggccggggaaactcgggcaaacctttcctggggaatcacccctcccgaaaccccgccgcggaggcgccgcagcggagggtgagcggagactggcggagctcaaacttgcgagagctggaggcggcggcgggcgggcggctgtcgcccgagcgctgcgcctgcggggggaggggaggcggctgttgggagggagggaggtagggcgggcgggagggaggacgggcggagggagggggaggaggaagaggagggaaccagggaggggggacgcgttgggatcgcggcgtgcggcggcagacggagcctgggctcccagcggcaaggtgaggcagagctgcgctcctcgctgaacgcgggccgagctcggcggctgcgggggagacgcgcaggagcccagaccgcgaccgagagcgggagctaggcgggcggcggcggcggagggggagcccgcgagccgccgggcggagagcccaagccgcgctgtcgccgcgcagggacgacttggccaacactcacacacactcacacacacccagcccgagcgggcgctcgcggcgaaccgtcaacatggcgctggggctcctgcccgagcgcgggcggcggcggcagcgcgggagctgctgagctcggccaagcccagtccagctgcgggagcccggaggatcgcacggggctgtcgccacctgcccggaggccccgagcccgccccgccccgcccccacccggcccagagcccacccctcggcggggccgaccccgagggcagccggctgccagcagacggcgagggagtcgagtgagcgcggcgccgcgagcgggctgcgggcagccggggaccgcaaactttgctgctcgccgcgcttctccggcccggctccttctccgctcgttaacgtcgccaaccccccccacccctcatatctctctccacccacccaaccgccccccgctccttctcgccgcctcgagtccgcttgggggaaaacttcaaagagccggatcgcaggctccctgcctactcccccaccggggatttcaggtcagtgcccggaacacctttcccccgggagaccgcggacgggtgggcgggcgggcgcgctgagggctgcagtcggccccctctcccggggccccctcccgcagcgtaccccgcgaagcttttgcctcgcgcttccctttggctgcttggctcgctttcgtttttatttcatagctatgttatttaaaatgcagccaacctaagcggccccgcgtgggcaccagggagggagggggcgcggctgggggcctggcgcctcccggtgggccaggaggagagcagggagttcgcagagtggaagtttgcagcctgtgtgtgtctgtgcgcgggagcgcggtcgccgctgagcgccgcgagtcgggcggaggggggggaggtgggctggaagctgggaagctgggttcggcgttagctcgcgagcaggaaggggagggcagcgggttgccgtctgctttctttttcgactcgggaaagaactgtaaaaacccccagccgccgccaccgccgcctcgtctcgcctctccgggggccggtcgttcctccaagtggaacgtcggcgtgtgcgtgcgcgagggtgtgtggcgagtgcctcgggccgagccgagctcgacctgccgccgctgccgcgcaactcgggaggggagtcccgttttttcttggcttgccccaaagcacgaatcacgtggattaaaaaaaaaaactactaagaaatcgagcagagcaaggggttccgacttggcccgcccgccagccaggtcagacgctttgttttgtaaatgttcttttaagattataatctgcgatccccctcccgctttccccctcctctccctccccgatgttcagcgtaggttttaagttatgagcccccaggggtgggtgtagaatgtgcttgtgcgggggcagcgtcgtggagggagggcgggggcgggcgagacctgggccctccgctgggcaatggggagtctggtgggtagccctgatgggcgtgtgaaagtctgcggccggaggaagttggtcccactcggagggcgtgtggcaaggaggctgtaggcgaagaggaacttgcgcaccggggcaagatcctcggccaaggcggggagggcgaggcgccgcggggcccgcgctcggagccggcgggcggctgcgccgcagagcctccgccaactcgggggctcgcggcggcggtgacgagcgcctgctgtttacggagagagccttggggcaccgtgtgtggagtagggcggccgaagtcacgcgtggtcccggcgggcttcccgccgctcgcacgctcgagtgggcccttcccggggtcccggagacggacgagtctggcagcgtgtaggccgtggccgggcgaggcgtaatttgctgttaatgaatcttttccagaaagtccgcgatctccagctagaggctgtgagtgcccgcgcgccagggcgcgcgccgccggcgtctggagggtgggggtggggggaatggaagagcgaagaaggaaggaggagggttatgtgtatttagaaacaaaccttaaaaagaaaccaacgcgcttcaaataggtattcgcacagcctcgctgcgtctagactagacagctcggggttttagctgtgttttcccccccttttttcgttttgagaagacgctagaggaggggtagtgtggtatttggttctaggggtagtcttttggagaaagatccttaaaatggcctgggagtaaagactaggaggaaatggcccaccccagaaggtggtgggtggtgagtgcagacagacttgggtatttctggccatctgacacttcctgtggcactggaaacggacaccgcgggccgaaatcaatccttacgaagtgttgggttcggttttgccaacagaattgcttgcgtggaaggcattttaattgtcagcctcaaagattcctgtacgtggacacttagggaatacgctcgttccttgaccctgcccactcctctctcgacctgttatctggtgtgggttttgcagtgttggttttcgtgtttattttgggcagggtttcagcgcgtagagcggagtggggggggaaggcgatgattaatatgccatccaggtttaatccgaggctggccttcagtgtgcgggtatacaccgccacgcacaccaattgccttggggtgtttaggggagcgcgcgggttttgggcagcaggcgcccggccggcaagtcgcggctggggctcggctggccccagcgctgtcctttgaggcgctgtcaccagtaggtgactgagagttaattaggaagtgttctccggatcaatgggctgcacagctcattagcgattctctccagccctttgcagggccgtcctggcctccgcctcccacacaggccggggcctcgctgtccaggctgcggggagcgccgctgggaagtggggaggggccggtagcgagggacggcggggaagcgagtgtaacttcgcggggcggcgcgttgcgtgcggcgcctcgaggcccgcgcagcccgctctttcttcctgcccgcggtcgcctccactgtgtctttaactcgctcccgctcgcgtcgctgcctggctgctcctccccgcctcccgcgcctatctcttgttctctaagcacgacgcctgtgctccccgcccagtttaggattagacaagataaaaataggactgcccagcgcgcggagctgtgactgtgccccggcagccgggctggtgggagcgcggggggccggagctggagaggacccgtggtgcgctcggagcggccagtgcctgtgggccccctacccccaccccgcaggcaccgtcacgctccccgggttctgtccgccgtgaaccgtgcgggccgggggacctgggcagggtctccgcgctctcgcgggtgttgttggtgtgccggtgatagatcggtctagacaggcatgcaggctccctcccggctgaaggactggaggggggggaggcgcggagatggcagcagactctgtgagctgcgagtgagcgagctagcctccgggcccagcgagctgggtggagggaaggccgtgggggtttctcttaaccctttaaaggccgtggtggggtagtgtaatagggaaaggggggcaaagagcctagtggaaattcctggaggcagagtagctcgcagtggggaggagctgtgagtctgggcctagggttttcctttctcttatgtgtgcacggtcacatcttggtgcatcgggctcgattcttccacaaaccaaacgcagctgctagatgatctagtttgaccaggtatttctcagtcggggagctgtgaacacacacaatgaacaccctcactttaaaaactgagtttggaagacagacgtagactcaatgttcccaaagagaattcatgcgggtgttcaaggacgggaaggtctgcacatagctgtagtcgggtggggcctctgactatgactgctgcagaccaaggacctgagcctgaaatgccccgccagcatgtacaggtatgcactgaagagagcaaagcggtctttgagttgtctctatataaatagacatacttttaaccaggaacttgtgaggagttagatatgtgcaaggagacagcctccaaagaggagctggacactgatgtgttgtgagatccatcgtttgtgtgtgtatatatatggctaatattaaattggtctaaaattttaatacacctctgcagacatttatctagttctttcttcagcttgaaatgggcggatgggttaccctatacataaataactcattactaacattccagtctcctcctccctcctcttcctttctttaagagtttgtgatcttaagggatcctctgtttacatttaaactgcaaacccatattggtctggcctgggaaagagccacattataggcaaagcaaaaagaatggaagtagtacgaatgctcagattaagatgtgcgcttgaatgacatgtgctgagacaaatcaagacacttgggctccgttgcccaaatggaacaagagatacataagagataaagaactggccaaggggaatgtaaacatgggtatgcaaatacagagatgtatagcgatattctgagagaaaaatcccagactttgttgagctggaaactggggcagaatttctgtaagtgcgttccagagacaatagcccatttaaaggtgtgaagagggtcacttggaaacacaaaaagcattcatatgcatacatccatgcttagatacacaggctgaatgacaaacactcctcaatgcctgacgaagactttcctgccgagtgagtgagaccgacttgggtacagaagagtgggccacacaaccacattcacacacttattcacagggaaataatgtgtctttggcttgaaggaaactgagggccacgctagcagcctaaaggatggatggtgtgcagtgaactaggattatctctggttatagtttctttcccttctaggggtgaggtggagtgggcagcgggttggtgacgagcaggtaggagcctttctgaagagattttgagttcctgaccttgagtggctggatcgtgtagccacaagaggggtagctttccactttgtggtcagtaggaatggctgttgcactgctggggtccaatttgctaaggtggagcagggcctcagtgggctgggaaggagaacaggaagaagtgcggcctctgggaggaataaaagggaggtatgctttctttcttttcttttttttttttcctctggaggagaccgtggcggggacagcctgtgttgggtggattagcaggcgcctcggtgaccccagacgcgcacgtaaactccggctagggtatggcttgcccgcggcgtcgatttgctgcggtccctctttgtctaagcccagccgggaattccagcttttattgggaagaccgcacttgggtggggcccgcgccgggcggagtggggcagggtccggtcgcgctgggcgggaggcttggagcccgcaggacgttccccggagctgcgggcagccctggcaatgccaccccggtggtttcctcgaggacaccgggcccggcggacccggagaggcgcggcggggcggggaacttcctgggtccatctcggccgccccgccccacccttctccctccggcccgaggccgaaaggagctcacaaggccctttgttaggccccgaggtcacactcgtgccccgggggccgccgatgggtgggagaaagcagtgctgcgggtcaagaggagcctccttattgcctcggtgccccagcccatcttctggatcgggcccggtgggggcctcgcccaaagctgggtggggaggcctgggccggccctgacccgccccggcttctttgccagtgtttatggccgacgggattccgtctgtttgcaaaaccggacgcgctgctgaggcctaggtggtagagccaggagaagccgccggggcgggagtaaatggtctccccccagccgccctggtggtagccgagccgcgttcgtcgcgcgcacttggccgggggcgtccactggtctccagccctgcccgacggctttctctggttgccctcaacgtgttcatcaggaagggatatcttactttttgttgggtggagttcattaacgatgcctttctgcgatatttctgtagaaggctcccttttggggcgcaagctcacctccatgtgtttacaatcgagggtctcagaaacgggggtcctcactccgtcattgttttagagctgtgtctcccacagccggcacccacgggctcggctctccatgattagagaagcggggaagtccactcggagaagatcctgacagcataaaaaataatttgtgatctaaaagacagtttccagtataatctcattatgcaccacagactcccgatgttattttgtggaaggcggacaatgatcaatttacattgacccggggctgggcgagcttttagatggtaattgccatattgatttgcatgcaaaaaggagacctgctaaaattaaagaccggaagctaaattaaactaaatttattgtctaggtgcaaaccaggggaactgttgggggatgggattgactcaggtcagggtgccaggggcagagcaggtgagaagccctggagcttcggaaggtcacaacttgggaagcgatctttgcccttgtgatttcatgtggggagggggaatgtgtttaaggaaaaaagttataaaaagacaattttgcattgaagtcactaggatctttcaatgctaataggaacttagagggagaggagaggtttatagggttataggggtcttccagcaccatttccggcgtcccccctccatttctattgttctgcctggccagacgctcgcagtcgtgctagggacaccaaaaacctcttgcatttgaagagttaaaaaataaataaaagcagcccgtcccccccttcccgccttgctctctctcccctcccccttcccggagcattagacttttcggagagagcgcaccgcgggcaggccaggaccgttggcgctgtagggagttcctccccggacgctgcggtcccaggcttggctggacggcgatcgcttcgggaagccgccctctccaggtggccacagtaggcgggggtggggtggggtggagcaaggcgtctgccctggccgccgtctagcggtgcccgggacttggggggaatcgcctccccggaggggttaggagggccagccccgccccgccccgcccctccccgaactgggtgggggccggggaggactggaaaccctgcccgttcgccaaggccggaaagtttaaaaaagagaaagaacgccacttgcagagggctggcctgcagccaggggtggccggcctgcgggggcgtgctcggctggctagcggggtgagcgccccggcgccgccgtctcccctccgtccctcccgccgccgaggcccctgcacactcggtcgcactgcggagccatttcgcacatccggagcttcagcgtctggaggagtaaccagtccagggccgggaagcccgagtgtccggtacccctgcctgtacccatcgagccgagccggaggtggctttggcaggctctgcgggtgtaggtagttcccggaacatctgaaagcctggggcagacccggaaattggggatagggtggggaggggatgttgggccctgaggtttgctgccggccgcttctgtaaagaaacgttggggaaaggacaagatagcctatcccccggcttgcgcttttgtgggggactctgggtggcccaatagaacatcttgctggcgtcttccatcttaattccctctcccacactactttgttccctggggtttttcctttaaatcctaggaaaggtagatggaggagctccctccaaagggcttttgctctatctagataatttgatttattgctttatgtggcgaaactggggtggcaagcctagctcctagtaccagtagtcagcacttttcccagagacctgaaaggagtcgacccaccttacccctgactattctggggtactggaggaagggaaaggggaggcttgttgagagcattggccttacaccagggtataacagtgtagggagatttgtaggatgtagggggaaatggtgaaagactttgagtggaccaggagatgacttagatacaggagaaactgggttcacggctcactgtagaccaagtaacataggtgttaaacactctttgcctcgttcttgggtacataaggcctaaggaagcttttcagaggagacagtatgtgaaaatcaggatttcaaatggcacaattagaccaataattggctcctctccgcaactccaggactgagtttgaccgtggcccattttttactagctgtgtgaccttgggggcaagttatttatggcctttgagccccagtaagttttttcatttgtaagactgggaataattatccacctttaggatctaaatagaatgcttggcacatagtaggccccaaggatgaataattgctttgaatgacttgtcatgttcctataggttgctcctccattccctgctgcccctgagaccccctgagacttgctaggcctgtgtcctgggacccaaggatgcagattaaatctcccctacgagggtattctaggtccaccttcctgggttcccctttccctttgttaccgtagtttgcattctgccttttaaaggattccatatgaaaagacttgcttctcccctccacccccaagtgggatcattatatggttaggaactcatttcagaaccgtcatctaggtacccttcggcaaggcttcctggcattatttcaggggggaaccacggtgcctagaggggcaagacctggttggaagaggtgagagggggtggcctggtgcagaggccagaggtgctgtggtttgtttgatagggattaagtccggatgttatgagggctcaatgtggttttcaataaagtctgccagggattgcttcttttatatcaatatgtatttaaaaaaattactagcatgagaagaaaaccagacctgtatggatccaggctggtagtaagctactgtgatcaggtttcctactcgactcccagaggggaagtcagtgtttgattgaagctacacttggttcttgactctcaggggatgcctgctctgaaacaggagccctccctccctttctctcctcctctccccctcctcctccctctttttcccttcttcccctaaaagcctttgtgctgaaagagcttcagtaggcacgaatccctggtccctctctaaagaatgccttacagcctttgctgacattgttttgtgaacagtgggttttaccaggccagcagtttccccccgattttagcgcacgattttaaaggtagtgtatggacaagatgcgccttactgcagtgattgcctcagtgtgtagcctgggctggggcttggaatctagagacgccttaacctttgccctaggggccctcctggagtggggggtgaaggtggggagctcgaggactgattgttttcgaggatctgtttgttttgtccagccaccgaggctgaaggtggagttgggcaagtctgagtgtatgttccagctttgggtctgattttaaacttggtttaattggagaaactcctaggcatttaacagttctgtacaaatgcaaacttgaaatagctcgaggcctacgtcatttaggaaagaataaatgaagtacagaaatgtccaaactatgtaaatcctagcgttgtctgccctcccataaacacatgacaagtgccaaggcatttccagtcaaaacacccatggaagcagcagcctccatcctttgtatttattattttattaacagcattttacacagcatttaacaagcacagcgtgcctgctttgcaccaggactctaagcaggcgaaagggtggaaaatggatggaggtgggggaggagtggttgctagaggacatcaactagagaaatctcatcagatgggtagggaaagcagcaccgggggtttatttctactggccacaaggaagacagacatagtgctttggaggaagaaatcctctctcccatcccaggaggaaagttgtacagctgtgatatgtctggtctcagctttgattccagagggtaaaacagggtatgtttcatgatactctgcccatcggttattggtgattttcaaagaataagtatttgtctgctatcgttattctatatcctggtggaaagtttataacgaaaagtaatgcctttcttaagtcataaaatgagccttgtatgcttatttaattaaaatctatttaaggaccgattaggcgtgtaatttgcactaataatgacgattatggaaatgttcaacttaaccaaaaatcataaaggagacattttgatcagtggggcggccagtaagtatttagtgagttgggcaatttccgaaagacaggaggcattccgctgagggctgcagaaagcacagacctgtctggcctctgtgacatggcatggagaggggcagacctccctgtcccggccccggccccagcccggccagaccccactttgctgagcatggaaaccaaccctgcgagtctccacaacctttattctcgtgatgcttcctcgagcttccagaaggagtaaactctcggagagggctgatgagccacacggaaatctctgcgaaatggcggtgctcttttgctttaacaaacagcgctgacaaacgcatgcttccttggctagccttggctggatcccggaggggtagggggagaaggggtcccttgttccggagaaacctgccagctgctgggcttggtgtgaaggcagcaaaggcagacacaatgctgctgttgttggtttgatctctaactgtggattgttagtctggctttaactatgtggtaaggggggaatgtgaaggctgtttacagcgagtgcaaataatgtgacagctgttggcgcgcgagcagcgctgcgcctcctcagcacttacacaaagcgcgcactatgcaggcccatggacgagctgcagaggtggcggccagtttctggccagcgcatccccagatgagagaaagctccacggcacacccgccctccatccccaacacacatctttatgacttcccaggattggggtggggtgcaggatggtttgtatgttgtggtttagggaacttgtggtgaggcagaggtggcgggagaaggcccacggggccgtgagtgtcaccgtgttggtggggtttggccaggatccgttgaactgggtcctcagctgtttatggctgagtttttaagatttgtgaaaataactttcagccctaagtaagcttgttggaaagaatgtgttattaactgaaagctttctggaaattgcagaggctctgaaggccgttgttcccctctgaaatggccctgttattcagacaagttagagacaggcgggtgctgtgttctgtgcactcgacactgtttccagcttggaaatgcaagtgtgcaggttcagtaccctaaggggggtgtattttggggggaagggaggacagattggcttttgattacccacatcccttaaccttttcttccaagccttcccgttttcaagagcacatttgccttcaactgcagcacgcaaaggtgccgtcctgaagcctgcccacagcaccacctactctgacttcatcaactagatgcccacagcaacaggctttctttgagttcctggtaccccgccaggccctgcagagaggcgccagggtgggagggagagcagttggtggtggcagttacccactaggccagtcctggaggttcatggctggcccaagcaggtggacttaggatggccaagaatgtggacctgcctctggaccgtcctggggcaagctgggtgtaaaaattcactcctctcccccatgagtcccaaggttgaagccttccaagccctggcacctgcctggtcctccttgggttttggaagatcatttagggctgactttggtctctgggtgtacagcctacaggatatctgcaaatctacttcattctctcctgtcccccccaccctcagcacctcccctccctaagtctactctctaagttttaacatggacttctacatctagttgggtttccgatggggagctgggagatgcttctggagtgagacatgaacttcggtgccagttctataaattggtctctttttatgacgtgtgccattttctgtaggaatgttgcttgcaaaacgagtttcgccttggaggaaaggcggaaagataaacaagcctgcaacgccaaaacactggcagtctttccctccttccagctctcttaaagcagccgggctgtatttccaggattagacttgtgcatgtgaggagggactcgcgttggctttttttcccccaagcaaatgcaaattagagaaaaataattttctttcaacgatatgcaatgtattagtcacttgttatcgtgctccgaggcaggcctcatttgcgcgtctgccagctcgctcacatctgctcagcgctgttcggggcattttaaccttggcggtgtcgtgtctagtcccatggatcaaggaggagtaattaagccctgaacagctacaaaaattcgtgggcccccatctataccatagttgttccatggctttgttttgggtgctctgagttccatgactgagtagcagacatgggattcctattgttccttgtaaagaaggtgggtgcccctctccttctctgaccctcatcccagcctttctgggactcccaggctctgcacaatcagtgagagactcgcttgcagattgcaggacccctgcattttacacatcttttatgcattaaaagttcctttgtgcttcctgtgtatactaatgatagctgttgttattagccttacggtatagcttgttcccttcggtggtggtggtggtgggggggggtggcggcgacggcgtttgtgttttactcctacaaagccctggtggaaacaaaagtgcattgacacagcctttggaggcatggtgtggaacatttattctggatttgcccccaggttgtgtagattcccaagtggggacccagttctgcagggactagatcaaagggggcaagtggtttctttttgcgtggagggaagatagtaaggagggattcctggcttttgacttgggtttctgttgccgggtggcctcctgtgaagggacacctgtttctaaatttgccctctcttgaatacacacgtggtttcctgactccccgtgtggcaaaaccatgaaggaaagtgaaaagaacaaaaagccggtggggtggcctggacagattatccggggagacgggcaagtgtcccccgttggcctgtgagagagaggttgggggcacctgaccccgggccatgggctctgcctggaggaggggagtgtagcggacaatccaggttcggcagcgaccctcagggtcaacccctgcagattccaccccggaccccaacgcccgagattcgcacccctcccacgttacagtaggcgacgcttggctcacatctttgtaaggggaagcgtccagaggagcagcgctctagtatgatcggaagggaacccagaacgatggcgaggaggggtctgccgtgcccattccccgggtgggctcggcggcgtttcccgggaggtctcggattctccctgcgcccacccaaagtttcttttcgtcagattcgttgatggggagagaaggtgcggcggggcctcgggaaggggcaccatggagagcgtgccaggccgcagggtccgaggggttacctagggtcgggaactgggaaggtcgggccgcctccggggaggctgctggagttcctggaaggcctggcgggggcgcgccgcgagggcgtgagtgtgtgccgtggtgcggccccgcgcgctgggacctccgccgaggagcggggaggaggagcgggcgagccccgagcagcacgggtgtgtgtggtgggagagaaaatccctttgttgccgaccgatcgcgctccgggctgaagcgcctcagcccggggagggggcgcccctccccctttcttcttcgccggggccaagttcactcccagcccaggtggctctccgctcagaccccgacgccccgggaggaggccgggaaggttctgggtgctggaatggtctgggccggcgagtttccccttccccctcccccttactaatgcaaaacttggaggtgtgggcggggacgcccgtgctggctacggctaaggctgtggcttggagtgtgccaagaggcagcacctgggccggctggatcacttccctcacccccaactctctcgggggagggggtcgggaggggtgggaccgggccagccacctccctcgaccacacccctggaagcctgcggttttgcctcccagggacctggggggcagccttggggtatcttactctccagcagacccggaggacccatcccacactgcacatccggaagagctttttcttctcatctcccactcccacacaccccacccccacccctcacatcctaaaataggaacttcttcacccctcccttccttgacacccggagcacagcgctgctgctgtgacgcagtctctgtttggagcaaccccaggaagggctggcgggtggtgagctttgggcttctgtaaaatctacacagttctgctgaagttccctccctgctctgatcccctctctgttgctgcctcagcctcccccgcaggatgaggtggtagtgccccaaagaaactgtgttgtgattctggggcttattacacagtgtgtttattggagtcgggtactatttagcggggttaaacgtggccagcgccagctattgccaggcaaaactcaagtccatagtgcagcttaatcctttggaaaacacagtgccaaatatttacagaggggaccaaggttggagaggttcagccacctgcccagagacacgcggtgagtgagggtgggagccgggaggctgtggtgaccatgttctccacagagaaccagccatgcagtagcgagacccctcccctgaagagtcctctgccagaggaccccagcacactggctgggaatgcctgcctggccacctgagctggaagcccttgcgaacctctccagttcttctggctgttaactgctggatagctgccggtgggggcaaggggaacctagtgagagagatcccaagaaaagaccccgagatgggccaccctcaatgcctgtgtggacagcagggaggcgtgagcagagttagtttggtggccatgctttccaaattgtcagtgccacttgacaagtgtaatgtgcagacttttaactgatcggcgcctcaagggtgggggcagtggaaagtggccctagtgcaagagggggccagggttgggggtggggaaggaaaggggccaaggcttgggacctgtggtctgccctcacatcttttcacagagggtgggtgtgtccctactcagggatgccaaggttggagtgatggcttatgatcttggtccctcgacgccccccttctgccaatcaggccttctcccccgtgtccgggccaagctcaggtgctctcatcataacccttggctgaagagcgaatgactactcagagtctgtccagggtgacccaagctctcctatgtgttccacttccttggtgctaagagctggagaccatgcagtatgcagtgtgcacgcctgcttctcacaagccaggtctctccacttggccctgggtgttcctgcaggcagctggaacagttcccagtctgttctttagagacccacaccctccccatctgacctcttctcagctgtctttcctctccatccctatccagcacctttacccacttctctccactactagaaaaaggggttaaaccccagatccaaggtgcagcttcgcagctcacagtggaacaggttggtgcttgtaaagtgcttttcatgagtgacttcacacatcttggcacttctggaagcatagcctgcatttggaagaagtggggggtggaggtgggcattgaaaaataaaagcaaacgagcttcatctatagctgcaaagcaccctgaggctctgtttgtcattgaaatcaggtcatttgccctctccacagtgttccgctgccaagggtcagcaacatcagtttcgaagcacttggccttagaggtaaaaaagtccccagctatttcaacagcagcttctagaagtttgatgtccctatactttgcctcccagtctctttttgtttcttaccccagtgtccccttcgttgtacatgacagagaaaccagggtgggctgtaggtaatggtgacccctgttcttcagtagaggcttggtgtgagccgtatggcctttgcaaaggaggtccctgcttttgtaggtttggactgctctttgtcacccaggaggagggcctcctgtgagccagggccattgctcattggccctttccactcctctccatctttggccaggaacccgaagagttaaaagtctttagcttgttgcaatgaaattatggctggcagtggcgccgctgtttgttcaacagacctccacttttaaacagttcacaaaaagttcatggggcagctaaagattataagtgtgtgtgtgtgtgcgcgtgtgtgtgtgcgcgtgtgcgtgcgtgcacgtgtgtgcgtaagtccacagcaggatccaacaatgtgttccccccttttgcttttatgttcagccccatcctccaccccttccctcccaaaacacacacacacacacacacacacacacacacacacacacacacacacacgacagtgaaccgctctgctagcctcaaccctccatctgaccctgtgcatttgagaacactttgttctggtggctggtatcatttatctgtgcgccattaatatggaaagccccaaaggaggagccctggagaaggggagatgctttgaaagcacccagtaggcccaggtgcctgtaaaccgcagtcacctttctgctaagtccaggtggactttgctgaagaaaggctctttgaagggaagcagctgctggccttttcggggctgggcctcagtataatgattctgtttcccaagaaggtgccgggaggtcctttgcacaaggtgtctacttaagggaggtgggtaagaggcaggttttttgtttgtttgtttgttttttgagttttgctcttgttgcccaggctggagtgcaatggtgcgatctcggctcaccgcaacctccacctcccaggttccagcgattctcctgcctcagcctcccgagtagctgggattgcaggcacgcaccaccacgcccagctaattttgtatttttagtagagacggggtttctccttgttggtcaggctggtctcaaactcccgacttcaggtgatccacccacctcggcctcccaaagttctgggattacaggcgtgagccatcatgcccggccagaggcagcttttttaaaggggaggccaatttttaagaatggggacaccagaagattgaggttcattaggcacacgcttcttccctcatccttttcttgggggtttggttgagtgaccctttggctcatgatgtaatttctgtatttcatcatggcacagtgagggggtggcatggtgcagtcccactgctgcagcccgatgaccgggacacactggcaccggggaatgatgttccaccttctctattatcctacccagaatgtcttccttttgttagaaagggcagcaggggccggagaggggacactgccactgcacaagggaatgtgccttgtggtctgcccagccctagtggtggccttccccacttgatttgtgtatttgcaagatggaagaaaagcccacgaacccttatagaaccttccccaacagccgagtcggtcctttgggggcgctgtggctagtcaactggaagagccgctgtctggagacacttcctagggaaatagctttccagaaccccatcatgcctgatgcctctgcagatttctgcctttttcttgggccctttacctctcttccagcctcattgttgagctctaactgtacgtggtgtgtcgctgcatgtggattttggttaacagacgttgttctatggggatgggggcccatgggggatgctggtggacaaaagacctagttaggacaaagaaatgagaaagtacagaccggctttgggattccatcccccaggtgtccccttaactcccaccctcagtcactctcacagaagagtccccggacctggtgcctccaacccaaccgacctggcagtctgctccgtgtgctaaagtgtaaaagcaagcatttgcatattttttcctgctaacaaaggaaatgtgtcgacttagggaacatttgggctttcggaaactgtgtgggtgggtgtgtgagggaggagaaaaaagttcccctgatgatctgcacaccaattatttcacacccaggtttgggtcccgtggaaaaatgccatggccggtctggacaagggacactgagatgtgtttgtgagcagggaattgccgagggccatcggtcccaggcattaaaggctcccctacttattaacccagcatttaacagcaggatatgggctgaagcgcagtcaaaagaaacggctcaacctccaaagagcaattaaaatcctgcacgaggataaatcacgcgccgtgataatcctgttaataaaatgcagcttgtcctgacccttcactcatgcagcaaactagaatgtgatgtgggtgggggcggtgggcagaggaggtaaaggggggtgggtggtggtctgagctcctctgccttggcaacctcccgctcccggaacgtggaaaatgggtggcttctgccggctccccatgtgccagcggcttggagcccatcagccagggctgctaagacttctgtgctcgctaatgatttctcgtccccagtgagcaggcgtcattgaattactcagccgcctctctctgcagcttccaggcaaaaccacccgggttagctgcttaatctaatccagggctctggtggggcggctcaccagcccaccgactctttttcacacttgatctgtaagttgcacacacgacagccttggaaattcagccctagaaacgcaggtagtttgagagctggacctgccgctcacctcactgtggtgccttccacccttcttgcacccttttggccccaggaaagatcagttgtgtgcctcccagtgatgcagcatccctgaacctattgtcagagcctccccttgttgaatcaagtcttctttaccttctttaacaagtggcaagaatgaatgaccactgtacactttcagaggaaagggagtgggcgggtgctgtggtgtgccctgaatgtgttctgtgccttggatgaggctacctgtttcgaattaaacttcttccccagccccagcacctcctaccagggaagctgcatgcccctccgctgtcccttcgagtcaggtgtctgtccttggctcccagaccactgtagacagcaggcacagcctgccttccccatctgcatcctttatgaatcacctagaaagaggccttctctagcgccctgtttggctctcctttactgaacctcctgggattttttttctttccttttaacagactagacgcttgaagcaaagctgccatcccagaagacgacatgctctcagcaacccccctgtatgggaacgttcacagctggatgaacagcgagagggtccgcatgtgtggggcgagcgaagacaggtgaatgcgcccatctgggccgggcctgagtggagcccacgcccatgctgaagcccccctcaacttctcacagccaccgtgggcccaaaaggggtgggagagaaagagcttcccgcctagtaggccgctcttgatttacagttttaacaggcaacctggctcagtgaagcattgccgccctttaaaagattagcccctaaagcggcctttcagtgcactttcgtccttaatttattatttcatatttatgaaggagaattaatcccagtctatatactgctttaactctaaatgtcaggagtgtgggcccaggtggagcagcattctatgtgcttttaaaacaaatagtttgctcagtaataaatggggagagagccaccgttttccttcattgaagcccaggatctctcattgtcctctgctgcctgttcccagaggccactggcgcctgcttttggtcgtcagacagctctgttatgcttcctaatcagtaattttggagttgtggggtggaggcagctaagcagtagatgattgaagctgctcttcggggtaatgaggaaacttttcctctgccgcttgtcagcgatttttatcctggggatttggaagttggcaccaagcactttctttatcgatgctctctgataacaagtcccagggcagccgcagcagcctggcacagatgtgcagcttccttttcagcctggaacagctgacatttgtatgatactagtgtgtatccccctgtcattttgacaaaggcagtcaaatatggcttttttatcaccatggaaaccagtttcgtaggacatggtccctaactttgttttggaaaaagttttgaaagcctaccctcctgggtaacacggaagtggttgatgacacgaccagccttccagccccctttggtatttggctgtgttaccacttcatgtctaccctccaggagagtttataagggttggctgggacagccgagctccgattggcctacttggcctctagagaaaaaaatctcgagggagaagtagttgtgcttaatttctggcttacctaccttggggacatcatatttgtgattcatgtcctcacacatgaaagctttgcgtttcctttgtttttcctggtcaagttgaatcaccatttgggggcgactttcaatatgggccattgacagctggtgggggcggagggttaaggacagttttaaaaattgggttagtagaaactggtctgttctggggagatctgtgaaagatggattcagtgaggaatgctttcatgaagttggtgtatctttttaaataggaaaatccttgtaaatgatggtgacgcttcaaaagccagactggaactgagggaagagaatcccttgaaccacaacgtggtaagagattaatagcttctgttgatgccatatctgcatatcagtgatctgtaatcaatcgtattaatttgcatgcccttaaagggtggggaatgggggaggggtggcagttcagagcagggctgagttggaggcctctgcgagaggacaaggcccccacccaagctcttccagtcttgccttcctgcctcgccacacatgtccctgtcccctagtgactggtgggatgtgtactctcttttcttccataagctggatgccacatcagcgctcccagctggataaatttccagcctccaagtagccccttagggtttacctttccagtaaaatacgaaacacaggactgtcacttcagacacaagggagaggaagtcaaaagacacaaccacagtttgacccatggcctctatattgatatagaaatgaggctgctaaagtcctctgttcctgttgtcccatcgaagatcgtttcttgttctgttaagtcatgccttcctgcacccaggggaaatgaagcgaacacccacccccaagcctgacaggcccagggagggttagtgtgaattctgtaccccatgagggtgatgctgagagttttggagttggtgtcctagttgtagcaaagaatttttgctgagaaggtaaaaatcttcagacttttttatttttattttttaattttaatttttttagagacagagtctcgctgtgtcgcccggcctggagtgcagtggcgcagtcttggctcaccgcaacctccacctcccgggttcaagcaattctcttgcctcagtctcccgagtagctgggactacaggtgcacaccgccacacctggctaatttttttgtattttagtagagatggggtttcaccatgttgcccaggctggtcttgaactcctgagctcaggcaatctgcccgccttggcctcccaaagtggtaggattacaggcgtgagccaccgcgcctggccaaaatcttcagacttaatagatgactgaattaatatatgggcctcaagtccaaagggaccaatgttttccctgcttccaggatactagttgagaggtgagaaggcaggcagcaaaggggtttggataagggggtggggaaacagaccccccacccccgccccgccggaagcctgtctttaaccctttgtgcttggatgttaaggctgatggcatgttgaactagttggcagtgtctttgggtgctgctgccttgaaggagtatcccagtaacacccatgttgttcttctgcaaaggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcaggtgagcccccccacctgaatttcagttactttaccagttgtcagttttttaatgtgtaaacaggattgggggagtatggtagggcagggcaccaggcagatttggtgaatgaagcttgtggtaatttgaatatatgcaatgtggccagtaagagaacgtgagtggtagcactgaggcgtgtctggatgctttaagttattctgtagattataagggaactccactcaattgctgataaccgatgttttaattattgtgaagggtatctaaagactgcatgacgtttacctatcaattgctttgatttctctgcctgtaagatagcaaatatacctagaagtgctgcttagaatgccttacttgatacctggtagagatgtgtagcagccgcatgtctgtgggattcatgcaaatttttcaccaaaaagaaaggaaaaaaaaaagaaaaaaggttgcttaaagggatagagtatgtatttaacttgctagtgaattatgatagatgttgtataggaatttccttaagatattttacttttaattaaaagatgaataaagccaaattgttttgcaatgttaagaaaaaaattggtttatgcttataaaaatggatgaagttatctaaatgatccattgagtgcccattttaattacatagatggaaggattacaagaggacagtattttatgtctacccgctgcttactgtgaggtcagttcttcaaatttttattactagaatcttacataaaccttttgagttaaatttcatttccaaatatacaaagggaagtttgtgggccatggtcgtctttattcattgtgtattttgtttcttttctgttgtgtttttgttttgttttctttgcgttgtgttttcgttttgttttatttaccttcaaaagagaatgtctgtctgtatgcaatagtgtatgtgtggatatacatacacatcgcatatatatctatatacacatgactttatgaataaagaatgtgtgactacttatatatagatactcttaagttttatctgttaaactttaaaatatctgagttacatctcataagctgtggttggttttgggcacttttctttgaaaatactttcctttaagataaggcaaatgaaatagcttttatggtaaggtgttgtttttttttttttccatctccgttctctttctagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgtaagtaaacctgagcagtttgcttgtgttggcctcaggtccggttggcatctgcttggagaaatgggctgcttttgccatgcatggaatgaagggccgattgtccttatgaatggtggcaaccaggaacgaggcgtctgtgaaagatagtttcctgggacacatctttttttccaaagaagcactggttctagagttgataacagtctaatataacgcagtgtagcagaggtatggcagtaggaaattaggtgcagggacaggttatattttgtagcagtggaatgacacttcccagccatctcctgccccacccctgtggtgacagtctgatgtggaatgaagagtccttatattctccctccaaaggcatagatgttgttgaagtaggatgaacatggtgaagtcaccataaagatgagcgttacgatttaccgtggggggtgggggagaattggccacagaatcccaaggcagcctggcatgcatgagggggctcttcccaccggacagagggcagcttgcattttggagggcaagtgatgtgaagagaaggctagtatcttcctcagtacactccctttggtccttacagcaggtcccccaccccaccaacagggttgactttgggatttgctcacgagtcttctagggtgctaagatgtgttggcagcaagtggaggtcttcctctttatttcttaaatatgcaagcttgaagctttaggtctgcttgcaacatgagaaacctcactgggcgaaggggaattagggtgtctgggtgaactaactggaggagtaggtgcaaagtcctcctgacacaggacacttggaagtgttgggtatgtttgagagctccccaccatgggccgtcggaggtttgacattcacaacacagttcatcggtgcctgacagagtttgggaagaatgtgtgatcagggagagtgtgcttcttgatactcggagcgcacacccctccctccacttccagctcatccctgggagcagactaaggccacctgccaggatcctgggtaagctaaaccaggactgatttgttgtaagtcattgctgaagaaagtagtttctgctgctaataggtggtggccttactcaagtggcagggactcaatgtacctgaagttgctcactcttcctcaaagagtggctacagggcagtgggaggtccaagccactcttgggtgaagtggcaaagaaagccttcctcctccctgatgattgctgccaactcgcagcccccactctgagttgcctcaacaccagctcttgggaaggttgtcagagggacctgggagaagtgggcaaggccgagttgatggggaaggtgcttctaaaagagggagtgccatacataagaatccctctttgttctgagtagatggctgggggcctggaggaagggacaggaacttagccagcttccagccttcttgcccttgctgtggtttttgagtaacatggccagaccctccgttcacatctgagtaactcggtgtggccaatggggagcagggcccaagccccacatgatgtagaaaggcctccctttccctttctgtaagtccctccaagcttcataccaacaggctgtgttcttggagcacccaggacagggccctgcaagccataagtcaccacgtagtgctcctcaggtaatgagccatggcagggagagcagaagaagagttgggggaaggtgaaggctgctttttaaatactagggccaaggaagagctggggcaccataggtttgtggttgatcaagaggaggaacctagaggaaatgttgtccttgctgctgccactgccatctcatccagggtacagcatgcgctggatccgtttggcttcaaattcactgagctatctcggccatcacgtctcttcatgggtgtcactgtggcccagagccaagctgtgagcatatggaaactggggtggggatttggggcaggcaggggtcacaaagagggtacaggatgcctccccgaagcctctcccctccactcctacagcaccagtagcttctgagatggcaggtgccgcctgtgcggcctcagctgcctgcgtgtgggtgcatcttgttgggagggcttgtttaaaaaaactgaattaactggacaacaccgtggttaggattttcattgactcttagtgatagtatgggttgctgagtttttcatttagaaattgaacaaatgagttaggagtgtccccaaactcctaaggaatgataagtggcattttgaagatggggtagggaacacggaggtgttgggcccttcctttttgtttttagttttattatttttattgattgatttacttttgttgatacatattagatgtgcatattagcccttccttcttgaatttgggtgtctgtctcccttggtagccacttggcttgtgtggacctaggactcactcagtggcaatgcctgagcgggagctggagaaagcgttgagtgaaagtgaaagggtttcatgggacttcttggctcaggaaacttctcttccaggacagcagcccctatgtactttgtaaactactttgagtttgggcagacagatgactaccaatgcctctgctgctggagagggtagaagttataacatggttggcctctgctagaggtgatgttgcctgcagagggagtagatgtcatgggcagtcctcaaaaatctcagtcctctgccatcctgtttagggcttactgggcgtggttataacagtggtgaggttgctttgttgccacggtgacttgtaaatgttgccatggcgatgcttccaggaggtattgcaatggcatagccatggtaaattatgggatgtatgtgctgtgccttataggaccatgatgcaaggagaaagtggtagacggtgtaggactcagccatgttcacatctgcctagatctcatgaccaaaggcacatggcattccactcacagaagggctgtaagtagttgcaatggaagaggaccctgatggttaggacccctatctatcccttcatctctgtctatgcacccatctcctttgccctcaagagtaatttctgtgggtactggtaagaatagccccatttgagggaggtccaagtgaagtgtacaggaaagtgacctggagcctctccctcatagctgtttgccatacgtatcttcggcagtcaaggtgggtgttctttgggattattactggcccatggagggaaaccctagcataaggtttgggggccttcactgaggggaattgggatgtttgccttgagaggctcaggggttgaaggaaggacaataggcctcatttgcggaaagatctcgtttgcggaaagatcttcttgagagcggacaagaagcatctacactgcgtgtgggcaggcatgattgcagtgaaccccagatgcagcagtggagggctcccgataatagttctggactattcaggaggcagaagggggccctgtccggctgaacggggaatggtggggacttggaggaggcatgtgtgtttcgcaccccttatcctagcctgctggcttccccatgaatggggagcagaaggtggtgtgtgcaggggagccctccccacccccactgggcagcttttcctagatggggagccccagagaagacagatggcaagacctccccatatctaatgggggtgctccctagcagagagactaggtccccagttagtcactgcctgttgatgccagtctgtgaaataagtgattacaagtcttctaggtggttttctgtggacaaaatatactggcagtttgggcataaggccaggtaggtgagatataaactcatttcactattaggaagtttgcagtgaaggtcaaaactccaatggaaaactttctccctgagaaagatgccttagacttggttgagattgttacaaatacaggtggctgtgtgagacctggagttcaaatggaagctgtggaagtcaaatccaaagcactagggttgagagattcttaatctgatggggatttgatgggggggggggggtgtctctgggaagggtgccaagacagggcagttcgttctgggtggggccccacactggctaagctgctgcctcattttgacccaggaaggcattgtgacattacctagtcacctctgctttcaaaccacttggctcaaaccctctctcctacctaaagggaggggaaatgagtacactttaaaagtataaaagtaaccttgcatgtggcgcttcgtaacacagtctttacatttttacattgcacccccagcccctcccacagggctttcaggggcggctgattggctccagaaagtcaaatagtatataactaggacaatcagttcacatcttaaactttcataaatatcagggctaaaaatcaagctggtctggggatcatagcgtccttttgtaagtaatttctccagccttaccctctgccctgctgcaccgtgtttatgaagcccaccgggggaggtggcttgcagtaatagtcccactttacaactcaagggggccaaactgtaaagtggcgctgttactgccagagtggttaagacacagagcaactcgagtcgcagcccaccctctttgcgtccccaggccaagctgagcacagtggtcaccacttctgcatagtgtaagttttgggcagcttgtgtgttttctcctgttgctgctgtgacataacaccaccttggccatgtttttggacgcccatccgttgctggttgtacctacagagacctggggtggtattccatggtgggggcttgggtgccgaatcccagtcccagccatccctgtccatacagtgcactgtcgtgagtgaggatgaggaggaacggttggggagattctaccattcctttgcaagaatagatgcagccccatctgttcccccttagaacacccttgaagagaaggtgaatgggtccttgcaccattgagagcacaggctagccaacacccctgtaaagctcacccccacagctgactgccgtgaaccgctggcaatgcccccgagagaagcgggtgagcggtgctggtcaggagtgggagtaatatttgaagtgggttggggagaggaagaatgagatcagcggatgaggcgtgtgcttatttcatctagaaattgacttgtgtgcctcagctcagagttaccaagacaccagactcataaccctggtgatgagagggatcatttcagcgggccaagggctgacaccttaacctcgcagtggtcattaagtagttatcatttatattcattgtgtattagaaaaattgtgaccagcaaagcagttaatgagctatttcttgggctagagcaaaaataggaagtgatgttgggctgaggtgattcaaggaaaagccccaaggcccgtgataggccgagcacagggttcctggaacgagcggttttgcaagcgctggcctggcatgggaaggacacaccaacaatgaggagatgtctgtcgatgcttgcctgtgacagagggtgtgaagaggagtgtcagctggggtggccagcatccccaagggggtccctttgtgttggacaggaaatgggaacagcccaacccattggtttcacatctgtgcatccagcaaatcgagttttttgaagttttctctgaactcgtgtatgtgttaggaaaccttgcctttggctttgccacgcccctcttcccagcagcctgggtctgcctgggttccctgcctccctctggcctggactgtaggcccagagccccccaggagtgagggtcacttctgcccatcaaggacctaggctttctttcaacactcttgtctccagtccattttcatctccccggttggcctaggtgaatattggtgttatcccttcgatagatgacattttggggatatttggtcactttatcctatcagcctgccatttatttcaaaataatgacctcagcaaatgtttccataaagatttttaggtcagccccagcttggttgcatcttctgctgaaaggactatagtgctttaaaaaacgtagcattgacgccccatctttcttggttccctcttgcccccaaccataagaagggagaaggagaaagtcaggagtgtgacatgcacctcactctgctttacttgccactcgtcttcaatgtaccctccctctggaaagttctgtttctgagggttttgtgctaaccatgtgtgaggaccccagtctccaaagaagcagctgtcaatagcagattaccttgggcatggtggtcccacgcactccccagatcctgccttctcatggcgaccttcgggcttcattaatgccctcttgtctcccctcccccaggcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaaggtgagccctgtctgcttcgcccgcctgccggggggtgggcctttgcatgcggccacagtggatggacaggagatgtggatgtgcggcgcgctgcccccgtagacagagtcggtgaggggaagccgtgggggcgcagcagtggagcggacctctccattcccacactgcctcgtgaggttcccaccctggagcccccggggggagccgcccacacctcccctcccccaaagccagaacccagatggccaaagatgattaggccccttcccaaaagcagagaccagtgaccacaccccccctcccccaccccattagtgatgcgtaagacagtttgttcccccccggggggctttttgattaatttgtagttatttctccattagatgactggcctgagagggaaatgacaaacagttcctctaaccacttagaagacccacattatagtgagctgaccaacctgaaggtgtgcattgaattaacagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggtatgcgggggccaccccttgagtgttcaccccgctcctggagggtgggtcatccactctctgtaggaaagggcttttgaggagatcttagaaggccatagcaattgacttcaacgaagatgtggcaggcagggagttctctcttgatgtccttgcccgtggttgcacaggaaggaagtctgaacaccttcattccagcctcaggctgtctccagtctctgggtcctgagcaacccagacccagtgggtagggggcaggaaagcaggaagagccagcttctgtcctctcttccgggccctttgaagcaacttgccacttggcgttttgtgggttaacttaggtgccgtttgaatgtggtataattaaaatattaatgctttgaaaacataattggtgtatctttaaaaactgaagccgctccagtgatcagtgttaacaatgggcttttcttcctgcactggctacaactgtgtaacgcccgcttcttctcccgtctcccatccgcccgccaccccgtcaccccctccgtatttaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtacctcttgaccccggcttccctctggggcctgtgcgaacacatccccgcctgcctgcttcccagcttgaggggacaaagctttccttttcctggactcctcccccacaccacacgtcactcccctgtcctagaggagcatgtcttctgggtggcagcgaagtttcaaactagtaagaatgaaatcccttcccccaaaccctcctttgacaggcaccccccacccccaaaaaaagataaggaataaagtgcctctctccacgcaggtttgtcacgtggggaggaggaggggaagcagcggctgttagaaggacacgggcttaaccgtgtgcgctgcttggttttatgataggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggtgtgtccctgtgggcgctccctggggctgcaggctggggggcggggcctgcggactgtggtgggcgaggggagggacatggagagcagagctcagccccctccacatcggggctgggccggtgctccaacaggatgtttgtgttagccccactctcactgctgtctctttggtggcttgttcaatcgcggtgtggaaagaaaggcctctctgatgttcagttcgtgttcaggcaggtaggctgctacggcatcctccagtctcgctaacttatctctgatataaaatctgacacaacccagggcttggcgactaggggaattttaatgagcccttttggattctgattagcaagggggagagaagttattagctctatctggggctgcttgtactgtttcgggtggaagggtggccgtgtagggggagtaggcaggaagtagctgtgtaggtcacagagggaggggggtggggcagacctaaggtctctttctgagtgggggggtacagtagccttagggctgagggctctggagggagggactgagacttttccctcaactcactgcttctccccagcccccctgctcatcctcctcctagcatgggccatgacaatgatagcttacgttgacggagcccctaagatccaaagtaactcatttcaccctttcatcatctttgtgcagtagtaactaatattattcccgctttcagatgaggaaactgagtcccagaggcgttacatgatttgaacagataataatccagcagcctggctccaaagcccagtctccccccatccccccaaactcggctcctctccaggactggctcccattggaatcacgcttttcacagttcaaaacctacgtctgcccctgtgcgtctccccaccacacacttgtcagttgagatagtgatgtaatagcccacagtgcaaagacatttttttttatgctggcatcagctctctaggagtcgtggtgaaaataaaatgcggttcagcaggctgagtgtgaagtgtggagaagcacccgggcgacaggatccatgccaggccatgctcagctgtgggctcccggaattcagccagagcccaggctcatgcaccttaaccatgctgcagtcagcagtctgctgtgccttgagcctttcctgatggggtgacccagctgccagtctccctttgacccagagcccaccctggggcatgattgtgtgggtgggaactgggatgctggctcacacctgtgggatggtcctttgaagcactagctaggtatttttggttgtatgtgactttgtctattcataccagcttgtttcttatcgatatctctggattatctttgagggaactctctagaaggatttgaaaattagctcagttacttgcagattaaacccaagtggcagccagttggtttcccataagctgagagcagcggcgcctatgaggacagggtagatgcagcgtgccaggcagggccactcattcctacgcatgattgggaaaatggacttgtgcttccagcaaacaccagaggtaagggagggctccagggcagcaaacttgccggccatagcggggtagggctcctggcctggtctttgatcctggcttcatttctgccagtctcacctttctgagcccagagcttcaagagacccttgtgggtgctctaaggaacagtttccattctggtggttttcctatagcaggcctggactaaggaacactgatccatgctttcttaggctaccaggcctttggtgcaagaagccttgagaatgtttatggaaggacaacttttccccttcaaatgtaaatgtcattatagaactttcccaggtcatcagttttgatgctgaatgttttaattactagatgaaagctttcaactttgaatccaactttctgggatttctttagtcagaaattaaaatgttaggatgatagtccattcagatgtggcagtgtaaaccctttaaaataaaagaacagtttgcttaacaggataaggtacggtatgaatgcacagctttgggagaggtttcccaaaacccctctttatcattgtcttctgcttagctaaaaagataccacatgcaataaaaaggctgctcaagctttgttttctgttaatctggttcttgaggtttagaaacaccctctgtcttcagatctgtaatagaccacctgaaaggccagttacagttgaacctgtctgttcttaggctaagatgccaatgtggaaccgcatgtgtgtgcatttagtagtgatggttaagttttctatgaatcgaataaatcatgtttttaaaaaagttaatgaggcatttaattaattaacaatgtcgggtttatggcctttatggttacattttgcggttaatgtcattcagcttatagctgcttaacagagaattgtccaacaaaaacagtttgattttgtttgggaatgggcgggctgcccttcaaacactcccatttccagcgtggagaataaaccaagtaatgtaatgggtagacagacttgtctggcttcttcattctctctgttggtgacagcggttgccacccatttaagatcccatcaccctcccatctaggagagtgtcattagcctgcttgaccccaacagaaaaggtgcaagggatgccggtcatggctggattgcagccctctagccagggcccttgattgggcctttggaaacttcccagcagacccgttgccaaaagacctgagttatgggtctgatactttgtgttaattgaatatggggcttaacctctctgggcctcaacttccttgagtgttgaatgagactcataccacttttccttcctgagatctcacaggtcactgtgggatatgacatacacatttgggaacatcagaagtgttacggtggccaatggcaaaacgtctgacctggttgttgggttactgttgtcttgcctgccatcctccaggataacagagttgacttacccttcagcctcgacatctttcatttctatgttccctcagatcagccctagtagtgatgaaggtttccaggtgaaggccataattgtcagagcaaataaaccctgggttgataggacaccaggccggctgccgggatccgggtagattgatctgtgcacagcagtcggtggcgcttagagctgatccctgagtcacgtgacagggcctctccctggctgggtacacagctcattagcttgcagccgtccactcgagtctggctagtgagggcctgctaaaagagcagcagcttcatgcggtatcctggataccagtgctcggggcaggtggcctgggagctcagaggattgtgggctttctggcaggtgagggcctgaaggaagagacgcatctgtgggcatgccttctctcttcctccccttgatttggaagggagctgccgcagtgtcctgaagcaacagggttaccggccagggttaccagcgtgcagccttaggttcacagggggagcatctagaacattctagttagtgttcaagtgagtgatcacctttgactgatgtgtcttagaaagggcataaaagaattttcagaactcacctcacgtttatgggtggctcaaatgctgcctattttaggttatagatgagttatttaagagttgtcacaaaggagagcctgctgtgacccatcaagctccccccttgccaagtggaacatgtgttgggctaccccacatgttctggctttccccccagtcttcagaacctgacagctctctgctggccatgactgctaggaaaacagtgtaacctgttgtctggtggcagatactgttccatgtgtttgaaaactttcttaatcaaggtaataaaacatggactaaattactgctctgcttactgggagcggttcattttaatgttttaacacgccaaagaagtgagattaataacagtgattctcatgcaaactgttgatgcggaacacattctgcaaagggggaagggaaggattgtcttacttagttcttgaaatgcgtaggttgtggtatgtggtgtattagattcctgtcattaacttaagtaaatatgaaaatatattgattcagccccaagtggggcggagagtgaagcaaaaagaaggtagggttattggaagcgttgatgtcatttgttgatgagtatgataccaacagaggcactgccgcccaggctccaactccgggtctttccaaggggcgtgaggaccagcctaaactcctgggcatcctcctctctgtgaagttgagaaacgttctccagctcatttaattgttcattatgccttgattggccttgcttttatctaaacttgtgtcgtcatccactactacctattggatgaatcgattgagtgaggaggatgtccttgtacttattcatgcgttgtttgaaacattagcaaccaaatccctctgtactcactgtgccaggcactgagctaagggcttgtgtgggtctctaattacagtttcttagcagcctctggtaggcgctgttactctcctccagaggtaggaaaggaagctttggagaattaggagcataactcgcccagggccaggcagctgggcagcagacccctaaatgatgctgtccctgtcatcaggcgcttcgcacatgtgtttccccctcaccaagacatccacagcccgcccgagaggttctcaggttctcaggcctgagggtgtatgtctttgaaagctacagagaggtccaccttacaaggtcattgtgcagtgatctgatggcattcttccctcccctccccacaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggtcagtgatgtgtcttgttctcagcctggctctgctgagaccaagcttccctatctgtgcggtggtggttctcagtgtatacgggaaattccaggaggaaagacagagggtgactgtaagcacactgaccactgggttctctggaattgaatccagcagacctttctggcaaatgtagatgtaaagctcccaattttgatcagtcctataatgttcctgtgaaccaaagcttctgaaaatgttgaggcctgcatgaataattgggggtgttgccttttaagaccctggactcttcatcaccatctatgaagtcactgtatttaaaatatatttgagctgaaagtcccaggagtacacacagagtgccagctgcccctccgctggttcagcaggacctgccattgccacccacatccccagccgtggccctcaccctgtccttgaccctggtttattggtcagagacccaggtctgagtcagcctgaacatcttcctggttgtgtgagtgggatgctgccatgaggctgggcactgggggtttcctgacagtgacagaaatagccaaacggaaatgtatttggtgtttcacactttgcaaatagcattccctcagattgggcagagacccatcttctccctgccaaccccaacccccagctccatggacacaggtaggaggcctctgtatcctgctgagaacacaccccaccaggcctgtttcttctccccaccgttcccttggcttctgggccagaggttaatcactgatctgtgtgaggtcctgggatcaggctttcaggagagtctctgctaatctctttgcatctagtttcttttaaaaacagaggtggcttttttttttttttttttttaatgtgtgacagttgcttgttgtattggcttccatgatgatgggacctcttttatcccctgtaagttaccttcatatggtccatgactacttaaatttgttgaaaatgttttcattttgggcttgacttccttcttaggccttggattaagatagggtttgcagctgggcagtggctctcttgcctgtaatcccagcacttttggaggccgaggcaggaggatcacttgagcctaggagttcaagatcagcctggaaaacatagtaagaccccgtccctacaaaaagaaaaaattagccaggtgtggtggcatgcgcctatagtcccagctatgaggaggctgaggcagaaggatcacttgagcccaggagatcgaggctgcagtgagccatgatccgccccactgcactccagcctggacagtggagtgagaccctgtccacccccacccccacccccgcaaaaaaaggatagatttgggtttgagatttaggcctgaaatagtctcttcatctgccctgtaaagggttagtcatcaaaataacagtgattcattgcttgacgttgagccactcactgtagctcagtttccctatctgtgcagtggcggtgactgtgcacacctcctggatgaaatactgtgcttaggaggctcagtacccaaggtgcacatgtgcccagctttgcctgttgcttttaaaggagacaactgctttataagcaagtgtggcttgcatgagcataattctattgcgcctctcttcctaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacaggtatgacaaagttcaagaaatggtcttattcaaaaattagatgataactcgatacaatagatgattggaatttgactaggcagaaatcacaaaggctgaaactgtaaagcttttaggagagcagccgagtgtttgaacttttgtgtggtttgactttgttctagtgaagctaagtcatctattcaccctaatgttttaaaagatttcctaaagttattcccattttccacacatgcattcttaacttaggtatggctcataggtttacatcttgagtctgggaaaaatgactcaaaccttccatacatgaaattatttggacaggtttatggtgttaggtcatcagataacccattacttaagccctgggcattacaaagtgcctaaagcagaagcacaaggttttcatgagtgtcaggcacctgcagttaaagtccttatcaggcacttcctgccaaagaatgccactaactcactggtgacctgcccttgtttaccttaaattacactcacttgttggaagaagcagcttagttaggctatcaaagaagagatacataagtaggccggacacagttggctcacgcctgtaatcccagcactttgggaggccgaggcaggtggatcaccaaaggtcaggagttcaagaccaacctggccaacatggtaaaaccctgtgtctactaaaaatacaaaaattagctgggcatggtggtgggcgcctctagtcccagcttgggaggctgaggcaggagaatcccttgaacccgggaggtggaggggtggaggctgcagtgagccgagattgtgccactgcactccagcctgggcaacagagcaagactctgtcaaaaaaaaaaaaaaaaaagagatacataagtgtaatgctactttattttgctgagaaagaggaagacaggaaatgaccttccagcctgtcatgaatgtataggaaaaaatgccacgtggctctgccatcattttgttctcagcagtagattttatcttgtttttttatttttctctccctccagattatttaaatgacctccagggtcgcaatgatgatgacgccagtggcacttgggacttctatggcagctctgtttgtggtaagctgcattgtttgctctagttccgtaggaggtgaacaagttcaagtccatttctgtctggtatgggtgagggaaagtggatggtgggcactggaagcaggactcacttgggaaagaatcttgttatttaaactccttgttgttgttgacaactgtggacatcttgctgtagtttactgattccttcctctcttatttgccctccattagaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggtgagcatggctgtcatgtgattgaaaactagctgagctgctcttgaggtgacaggagttagaaatgcgctttgagcagatgagggtgggtgggtgagtgacctccttaactgtccacgaacctcacacaatgcagtagatattttccagaaagggtacacatcagcttccttacacccagtgtggtggggggtggggcacagcatggtataaacctgccctcatcactaacaccaaggcttaagtcactccccagagaagtgggtgactggaactttatggaagggtcagcaccttggatacttaaatccttaaacactttgagaaggtgtcctccctaggactgcctgcaacagaccactgtaggatgttttgagatgtacggactacactgataaaccaccttgtgtaaggttaggacaatcattgtacatgacacttaggatattggtgtgtcatcagatttagttaatcccctctgccccctatggttgagcccctattcgccagtgaccaatcatcttgggtgtacttgtcaagagactgctctgctgtgtgttgacagagctgcttgatgagtaacatcctcctcagccctgaagctataaacatatatgccattacaaacagtgatggaaatcataaagtatggtaggttgtatgcaaggaatgtaacaccttccttctcaaaagtgtcactcccaaaagaatggaaggatgggagtggacatgcctgaatggagagacagccttgtgtgtttataatgctgttagtgagggtctgaggagagaagagatcaaagaaatggggatacagacttactctcccagtgactgttgatagcagggcacttggataggcttgaccctagttgtggtcacagctgaatgagcaggactttacccccagaaaggggagaaatggggcttattcagatggtcctccctagatggacagatgagtccagagttcctactgctagaagtagttactctgcctcaccttagaaaggaatggcgatggccgggcacggtggctcacatccgtaatcccagcactttgggaggccaaggcgggcggatcacgaggtcaggagattgagaccatcctggttaacatggtgaaaccccatctctactaaaaatactaaaaagtagccgggcatggtggcgggcccctgtagtcccagctactcgggaggctgaggcgggagaatggcgtgaacctgggaggtggaacttgcagtgagctgagatcgcgccactgcactccagcctgggcgacagagcgagattccgtctccaaaaaaaaaaaaaaaaaaaaaaaaaatggtgatcagagagtaggtatggtgagaaatgaggggtgggagcagaatgaaaggacatagaggctggtccacttgggttggtagttaatattaatagttgggcgcacttttcattttactggaaactcaaagcattttcctttctgttttgtaggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaatt

SEQ ID NO: 4487 - DNA, 126083 bp, human
ggtatttccgaagctggccaggccctctgctgctgaccctggaaatcgggtcacactagacaaggctgcatgtgcggggagaaggcgggggggctcctttgcacgcggctgctcgcgtttccccaaggcctccaaatagtctaaaaactcacctcggaggaggagaaagagcgtgaagtggctctttcgatctgagacaccccctcccggagaactcgccccctcccccccagcccagagcggagtgaaatcttagaagccgtggctgctgggtttgaacggaatgctggagtcagtggaagacggagctggtcggcccgaaggtcagcgagttgttttgagttctcctacccggaaggtagggggtggggtggggtggggagcagggagtagaggacgccagggcccccgagagaccccgcgtcagagcaaaaattgtttgtgccccggaacaggcagctcagcggaagccgcgacgggggcgggtcacgtgcggcggtggcggcgcagctggcgggggagccgggctgggacaagggccgggccgggcgggggtggcgcggggcggcggctctcgcagccgaaggtggaaccggctgactctgggcgctgggagcgagcggctccccgagcccggagcgagggaggagcgcgagttatggagggaccggtgtgggagccagggcgcgcggagctccgcgtggtgcggcacgggccggacgaggaatcgttggggggcgggggcagggacacggaagcgggctcccggggcgagagcggaaccgacgcggaggctgcgagggcgtctgaaccccaagaatggagtcgccgctcttgtagtcgccggccttgttttcttcttgcacgcaaatcccggaacgaccggaaccgccatccccgcctgcgtcccaggggcgccccattacgcatggcgggggggcccgcggggctactccgggaggggatccgtgaggccgaggccggggagggctgcgaggtggctcgcgggggtgcaagccggagcggggctacacaccacacaaacagcctccctttcccccggaagagcgggcgagggaagacgcgggctagctctgggggctccccaggactgtgggagccaggcgaggaccgcaaggcggaagggagtgctgcagacaaaccatcggccccacctggaagacattggtggcctcgtggccggtggtgaacggtctcacgcttccccaaagtggcgtgcgctactctagcgtgggagggaaaggacacaaacttggccatctgccagaacccttgaagacgcctgtctttggtgtccctccgccccccgcagtggcccgaaatgtactctccctcccgtagtccacgaggttcaggtccgaaacctggaaaagtagggtagcgtggtctggcctcggacgggaaacccacccacgttcttctgaggtgccacgcggggaaggcgcggaacagtcttcttgcaaagtttcccgcccctcaccccagtcgagtaagggcggctcttccggaggtgggggcggggaacggtctcgtagcggggagtggtgctagttcctcttccctgcgaccgctcgggccgcctgcgcgttcgcgtccccagacgctgcaccccagtttgctgcaacgtctgcttggagtcgcggtagcgggtgctgcgcggagtctaggacgacgcgagacgccatttgcatcccccctccctcctgcaggttggcgagggcggcggtgtcgcccgccgcggaagcgtattcctggcagtgacactgattagatgctgtgtcgatacgtgcacagaatcggggtgggccttcacctctcgtgtgcgcacacactttctgttggaaaagttgcgatattttttctccccctctcgccgcacagctgctgtctcccgggcggaattaggcgaccacgtttgctcaacccgaaggagagaggatcgcgcgggcgctgggcggccgccgggcccgggccgcgaaaatccagccctggctttgcgtcgagctgctgagtgccgcgcttacgcgcgcggggccagccggggcctggtttccatctgccccttttgcctccgtgttaagttcgccggggaaaacccaacgatccgtgctgagcccctcggaggagagcccccgccccaccccacccccagcccgatcccgaccgatggaaaaaatgacagtataggtcagaacaggctgcccgcgagtattaatatggacggcctccgttcctggtgcttggggaggatgggcgcttcgccaggaaaccgccgaaggaggcgccatgagggccgcctgccccttctcgggctagaaaacgtggattctcagagggaccagacaaatgtggtcagatagctgcaggaacttaccccatctaaatacaggttgcccgtgtatattccaaccaagatcatttttgtttcaatctaatacacgttgaatcaattagaaatactgtgagaaactgtggtcaaacggtagataggaaacttgctctttgcctaacattaaatgtatgctcaggaggtgcggggctgagcactatcggcgcagccagtctgtgtcctaagaagacagggtcccctttgcgttccaccttccaggaccttaatagaacgcgaagagaggaattattttagttgtagtttctattagagggttgcttactccttgcaaactcccgcctggggttgtcggtagttagtagtagatggttctgcgttttggcttttacagtccacgtttttctcttggctttttcttttcctgcgtacacgctgctgggtacggggagggggctgcccagacgtgtgctgccgccgccctcgggctctttcttgcgcaccacgcggcctcggaggaggggaaatgtgaactctccgggtggcgctcgagaactggaattctgatttagggctgcgggtttgttccggaggctggctgggagcgtcttgtaggggccggaggctgtgaaggggaagccccagaggtgaccctgaggcctcagaagcaaacctggaggcgcccgtgttctttgtctttctcggggctggcagcttggcacgcacagttccgataaggatctactgagagctagagcgcactgccagcacatttcagtgattaggcaaacgccggtagccacttaaggcaaaggccatttgcgttgtgtttgaaaaggaaaaggcagcctcacctaatgaattatgggtgaccctggagaggccaagcaggggaggccgaggcctccctaggctcttatttgccgcaactcctcccctttttgccagagtcgccatttcaaaggtaatgggaagccttttgaaattagaagtctgaccgattctgtctacagaagtggtatttgcatctgtgcaccagtaaaatgtggcccgccagcggcccagggacaaggcctgccatacgccagccctgcaccagtgttagaccaaagtacatcccagaggacatggcttttggccaactcctccgagaactgatttaaagaggtggccttcagccatcaaaaaaggtgtcctggaagagtaggctggaggtcctggaaaccagcgctcttccccagggctgcagggagagagtgggtaatggtgcctgagccctgacggaacttgctattaatccagtctaaatgagcaccattaaaaaggactctccctcctatccaccaccacacacacacaagcctttatgggacggtctagtggagacctagacagtttgagggcatttggccttcacttttcagtggccatacaatagtgccctttccaccctgccaagaccactggctccatgtaaacttccaggaactttaacccggaactttgtactccctacccatccaaagggagtgccagatcatagtaacaaacacacgtagcattgtactggaggcagcgttctaagcaccttatgtatggaggcatgttatcctcagaacaaccctacgaggtagataatagtattggtcttattttacagatgaggactccgaggtttcgaactgttaagcggtttgcccaaagccgcacagcttgggataatagggcctggattgaccagagggagagatagggcctggattgaccagagagagaaatagggctgtgttgcctctctagcgttttgtaatgaaagtgatctgtttgggggttgtttcgagaggactgcctggaccccaaccttccaaaggaaaatatgaagagactagaaggcccaacatttggcctttattttgcaaaagaaagttctggagagtcgtacagaggcatcttactgtggctcctccgcggcaaggaaggggtcagggaaggcaatgcaaaggcccccctggcccacctagctgcatagcatccggcggtcacgtccgccggaggtgactggggactggggacagccgattgccgaggaactccttatcgcccagtgtcagtgctcccgggtgccggagctaaacgtccgcctgcgggggcggctagttcacaccagtcccctggctcccgacgcgcccccgggcttctcccgcggagctggctagatgcccggcggcggctccgaagctccgggctccccgccgcttgtcccgccagcccgaggcatggagccccacggcccaggactggagagcccagttcgtcagtccaggttgggactgctggttccgggttgctcacgatcactctcccctcaacacccgtccggccagggcgcgcgcgcagacacataaacacacacggcttccaagcgcgcagcccgcctcccgggcctccgcttttccttcctcctccccgctcgggcgcttcggaagcccgtggcggttgtgtgctgcgccagggaagagtccgggtcggggagaccgcgctgccctctttccccccaaggtctgcgcgcacgctagtatccttaggaagcacagtcaggcttgtgggttcccatcttcccgggaaatgacggctgctggcgaggacctgttcgctccgtgtttcgcaatggcccggggatcagaggagaggaccgggcggtggggcctgcgcgtggatgagggtggcggtaaatcccctctcccgcgaaggtggctgagcctccggccaccgctagtagtagtctaccctgctcgtcttgcattggccgcagcttgactcccctgcgtgccgcgggtcggtgtgggtgtccccactccctcaagcctttactttcagctcgcgaaaccccatggatccgcggctgggctgggcagcgcagacgcccagctgccctcgccaaccccaggcccagagggggccaggctggcctgggggctgggcggcccggctgcacttgccggcgttgagagaggctctgtgagccggagccggccgccgagccgagggagagagcgcatcagcccgcgcgccttaaggcagaacacacgcctttcccggaaccttgaaacccaggggagccgctgccatcttcgcgtgacgagcagcgagacgccggtgattaagtgtttctttccggctccctctccgggttgcggctctcctcctttccacagggctggaagaataaaaacctggggaaaaaccacacacaactgcgctctggtctcgctcgccatgtccgcactggtttcttagggtgcgcccacgcggggcaccccctgctcccctactccacgcctggccggggtcgagggctgcgtgcctcggtttccatccgctctagcgcaaatctcggagtttaatggggagggggcacacattgctgaagccacccgacccccattctccttacgccccccccccatggggattaaacctaaacacatgaatcccccacccatacccgggactaatccagccgcgcctcctgggattaactcggctcacaggtccataaaacacttccggcgcggccagagggtctgtctgcagaaacactttaaaattgtcctcccgggcctggagtcggaattgactgggtggagggaagtgagtaaacagacagttgtaagagacaatccgtgaggtttgcaggctgtgaaaagagctgcttaaaatatgggctgtcggggttgcctccagcaggagggtggcccgggtcctagcagacagatccaagaaaaggatgcaatatattctaaatgacattgacctggaggaaggagggtgtaggcaggagcaggctggcttcacatggcttctggctccagttcagtgaggaagactagcttccagaaatttgtgggggcgagtggccagtctcttcatgtgtaaaatcagaacagtaacacctactctgtccccctcggatgggtttctgaggaccaaaatgtgaaggcactttgtaaatgcggctcaacccttctgcttcactgtggttaatgttcagtctctcttaggtagaaaaaccagtgacttgctgattagaaaacaaagtagaaatcagccctttctcaaatctacgcaacaatgttcgagataaagggaacccaaaagcaacctaatattttgaacctccttttacatcatttcgagataagtttctgaagtaatgagagaatctttggaatgttctaagaaaatctgtcaaaaactggaggttaatggggaagaaagggaggctttaaattgggtcaaatcacattttaagaaggctgggcgcggtggctcacgcttgtaatcctagcactttgggaggcgagatgggtggatcacgtgaggtcaggagttcgagaccagcctggccaacatggcgaaaccccgtctctagtaaaaatacaaaaaattagccgggcaaggtggcgggcgcctgtaatcccagctactggggaggctgaggcagaattgcttgaacccggtaggcagaggttgcagtgagccgagatcgtgccacttcactccagcctgggcaaaagagcgaaactccgtctcaaaaaaaaaaaaaccaaaaccaaaacaaaaccggaagaagaatataaatttatagtagcttcctggctatatccccttctgttagtctgcagaagagatgcccgttggtagccattcccccagccccaggaccgaaggacgtcttgactcaggcttggtctgctaggtgcaaggtgttgttggcgtctggggtggggacagtgaagaaaggcgatcattttgctttaaatgaacatcagaagacccaggcctgctactgcgtcttgaaggcctggagttgttaaaactctgtgggagggggtgcctcgtgacctccttcctcgcagatgggctcaggcagcgtgaccggccccaggtggtgcccaggcgcgctggggatggaggcccaggctgcgcgttcaccctgcctcgcagatagcgagtaggggcctccggctggaccgcccaccggccttactctcccttccctggccttggggccttggaccagggttaaccctggtcccgtctccacctcattgccccccgtgcagcgccgtccccgccctggctcccggcccagatcccgaggcctccctcgcccagcagtctcggttcttccccctcgtgattcatttagcagcggtgcagaaagcctgtttacctccgcagccctgggcgactcgatctgcgtaaaaagccccaacgccagctccgaccagtaggggggggattgtcctatagattatttctcctcctggtttttgtttttgtttttttttaaaccagaaggcttggttgaagagggggtggggtggcgtgttgctgctgttttttaaaacaccgtatttgaaagagaaacaaaagccacacaaaagccgtttaggaggtaccaagactgtttttacatataaaaagtgcagcgaataccaaggggcccccaacagtgataaactaaatggttggccgatttcgacaattaacagttaatctgttatctgcgatcagcaaacaagttttgaggctcgaaggacaccgaattcctgttccagtcgatagcgttgtactcgaatctgttgagcacatcagatgctccctgtttctcctagagcgaatccagctttagcaaacatgggtttcccaggttgaaggaccgacttgagccagagaaaattctcttgtgcagctgaggagcctctgtctgcatcgcccctcgagcccgagctcatctgtttggtttagatttctccaaattggttttcaccccgatttcgcggacctcctaattttgcacgtaataggcctccgataaatgtgtactgaatggcagaaactaaagtgaggccctcggcctggaagacggcctgacgcacggcctcgcccttggaaccccactcgggttcccagagcccccaggccgctgcagcctgcgcgcagcttcgccctgcgccggccagggcgggcgggcgggggaggccaggaggcacgaagcgcctggagcctgcacgatgataaatattgcgcagacagcccataaataatttgcattatgttcagctgacaacgcggggcgattaattttaatagctacatatttgcctgggctgctgctttcgtaggccccgtaatgaaaggcgagaggccgccctggctccgtgctcgcggtccaggaaggcagccgggggtgcgggaaggcccgatgtggcgtctcctccaggcagccccccggggagccccagccccttggcccccctctcgccctccgtgccttgtggaggtgaggtgtgcgcgcaccgccggagcacccccgaggcctcgagcaacaggagccaccataatgacactgcacatttgtctgtgtggggagagccacttgtggactgggagaccctccacgtagctttgtgccccacccggaccaagtccggagtttcaggttccacttaggctaggaggggggtgtttgccgccgccaattcgccagtgggccccagctcggccgaggcttctccgccctcccggcagaggcaagagacaaaacaaagcccggctgtccccgcgtcctctccgcgcgtgtagggtcctgagttctgcctcccaggagctgtccggcgctccgcggaaggcccccctaaaatgcttcctgagctccttgatgcaaaaggaccgcacacataaaggacggaagaaaagaaagggtctggaggagctctttaaaagagggggcagggaaggaagcgcagcgaggaaggacgcggctgccgcggtcccgtggtggccgggtgcgcgcgtgtgcgtgtctgtgtgtgcgttccgatgacaaagccccgccgccgccagcaagctcctggctgccagagctctggtgggggaggggaaagggaggagaggagccagcgctagcgtaggtagcggggaatcgaagcttcccaggagaaagagttcattcatgagctgtaggaggcctcgcggcccggccaggtggagcctcctgaagccaacacctgtgtattttcctttttggaaacaggcgagcccatcgatcattaccatattttaattgcctttcgcaaaggtcatctctaattatgggttgcgaggagggttggtcaggagtccgtggccctttattatctgtgtgggtgtgtgtgtgtcgccgcagagacaatgcgcccagctcttatagaaatgccaatccgagggtgtccgtgcgcgcctgcgaggcggtcacgacgtgctggatccacgcagaccaggctgcgtgcacaataaaagccgagcaggcggctgagggccgcgcagacccacgggttttctttttagaaacagtggtgcgaagagacttgacaataataacacgcagcaggattaaatcagggcgggaataaggaaatgtattttcgtttctagaaccgcggactgtgtttaacccatccgatcctcccctccccagagcattttgtgcacacgtggagttccgcgcagggacaggcgccgggcacagagtggcttgggactgcccgatgacgttccagggcagccacgttacgttcatattaatctcttcccttaattcggcatggttgtcagttacagtgacgtgaaacagccttaacgatgtctgttttatgggaaacaatacctggctagttgaaaaagagaaagcaaacgttgaggttttttaacttttgaaagtttgcatttccttagtttttatcactgtcagaaacccttgtggcaaaagcctattttaacttcctccgagggagaagagcagtggagaaggtagatggagggtcaggggttcttgggaggatattttggagatggagggaggtggagatcagtgaagagctgtgagtcaggggtggtcagcagccactctgaacttgattttctcaaaggagcctggcacttctgagccccgatgctgtttctggtagtccagcctgacaaagtcagaggctggggtcaggagcctcagagagttggagagttttgtactggtcctgcttcctgcctgcccccacacctggcctcctggcctcaccagcagccagctctgccctgaggaaggcagagccagatgactggtccaaccccccagagaccgcctggctttctcctcccctgtaatcataaccagatgcacttaagcgcctttcatcagaggaagcccaaagccctttaacaggcttcaataaaagccttttgagggcctaccagcctgctcagcgttggggcccctgtgcccactttccacctgagccagcctggggctgcagtcagggtctagcctctcccctggggccccagaagccaaggaagtttactcaactaaggcaacctctccaagcaggtagggtgccaagattcctgccaggtgtgtgggttcagacctcattaacaggaggaaagaaaggcatgggagggaagccagcagctagtgtctgtcttaaggaaggacaagaaggagcagcctatgagaaggaaccagaggggctaggaaatagagccggggtgaaggggcagtgatgatggagatgttcacaaagactcccatggtacttccaccaacccgaattcagaggtcagagctgctgtcccactgtgttgcagtctgtctcccttactaaactgtgaactccctaaggggagggactgtcttattcacctttgcaggcccggcccgggacctggcacaaaataagtaatcaagatgggagatcacaagctacgatggaaaactctggatcaagatgcatacgggcttaagatgggagctctgcccccagtggttgtgtagcctatctgagcctcagtttccttatctacaaaatgggtatgagaatgcctacatcaaaaaattggagaaagatccgatgaagtagttgcaggtgaagcaccaggaagatgataataaagtttttaataaatactgtgccctagctgggtgtggtggctcaggcctgtaatcctagctactcgggaggcagaggtgggaggatcacttgagcccaggaggtcaaggctgcagtgagctgagattgtgccactaagtgacagagtgagactctctcaaacaaagcaaaactagatagatagatagatagatagataatctcatgcccttgctcttgaaggagtgaagagaggatttggactgatattgtttgaattgtaagtaggaaggtttgtgttacaccctagctaggcacaggtctctctggcctgggatttggatcagaagaaggaattgtttctaaactgtgtgaattggagccacaggaccccactgcactgtccaacagggcaagcagctccaaagctgtgaacttgggaagccaagccagccttggtctcaggctctggggaaggggcaggtcctagacccttggactctcctgcacagggctggttgtggctggggcctagttgtgcactgcggaccaggctgctggagatgagtggctggcagataatcccagttggtgctggctttctgtggtcaagaggagaactgccccttcagctttgacctctgctccagtaatcatggctgtattttatttttggcgggttcatcctctggcatttggcagggcggggaggggaagcggggttgcctgcgtctctttgctattccttctggtctgctcagtagctccccacctctcatcccccaccccaccccacacaatgtggcctggttttctccccattgcaagctgctttatcatttttgcctgttccctggctgctctgcttgtttgagagtgggggtaagacctgggctctccccattcccctcctcggtccatcacattccagatgtctttcagcccctcctcccatctccctgagcttggcacttccccaggagggcagcctgagggtcagggtccatgggccgcctgggcatcaggggcctgtgagtgcctggctcagagaaggaggaaatggtgggggacagaggccagctgcactgctgcacattcctagctttgtgaatggaagctcatggcatttggtgtgtgacacaagtctggtagtcggggtcagaatgaaaaggtgtgggatttgtaggggaattgggaagaaaatgaagtaagctaacacttcttgcataattcatccctccctatccctgagatgagcaccctccaggagaggcaagaaaaacaagagagaagagaagagaagggagagcaaaaccagcctggtggaaatgctttgcccctctcccttcctgcctagggaactggctcccttgtgcagccaatgtaggtcaggaggggacaatagttagggtcctttacccagatcctctagggaaaatgtgagatcagatttgaggaagacacaggtcactgtcctacagggatttcagaaagaataagacactgcgttatcaaaggtgggggatttgggttatgatcagaaatttccttaaaaaaaatttcctgcctgtcacacttttgtttttaacccagttcaccttcttccatggatttagcaataagttatgaaattgatctcttcccctatagcatgtcagctacaagggagctcagaagcaatttaattctgctcctggaatctgtgggtccagaatttggtggactcaacagctggaggctggaagcatccggaggggtctttactttatgtctggctgttggctgggacctcagctgtgtcccatagcatgagcacagggctctctatgtggcatgggcttcctcacagtatggtgccttgagggtaataggactttaagttacaaatcggcagctcagggctccagaaaaccagcattgcagtaaataaggctgaagctgcatcaccttttttttttttttttctgagatggagtcttgctctgtcgcccaggctggagtgcagtggcaccatctcggctcaccgcaacctccgccttccaggttcaagagattctcctgcctcaacctcctgagtagctggaattacaggcatgcaccaccatgctcggctaatttttgtattcttagtagagacggggttttagcatgttggtcaggctgttctcaaactcctgacctcaggtgatctgcctgcctcggcctcccaaagtgctgggattacaggcgtgagccaccgtgcctggcccgctgcatcaccttttctaatccacccttgaagtctatattcattggttgcgattgtggtcacaaacccatccagattcaaggggaagggacagagatcctacttccacttgggaggagtgtcaaagaacttgtggccatggtggggtgggggtgggggtgggaaggtggtaggggaagccataccaggcacctttgagagctaagcttaattagcagtagctctaaacagactagtctacattgtaataggggtttctaccctcaagaggcctcataaattatatgggggcagggggactcagagagctaaaattaggccagggtaaaagaaatagagcctataaagcaaatatggattttaggaaaaatagaaaatatatcaagacagctgtctctatgatcttgtccaatgtgggaaggactgagggagaactgagtggtgggatcagatgggttttaggctcttctgcattgaaagggaagcaggtaaaagattagcattctatctgccgccatccttagcctactgtcttggggaagatctagtaacccttcatcgctcccaacaacattattttcactattgccttataagtcaccgccccctctaccaccagtatacagctatctttatatggtacaaagctaggaatgtagtcaatgcatttcctgtagtgtgtatggaaaaacaattaatacttactatttgtgccctccctgaggtgtggttttaaatatccagcatggatagtgttgtgactgaaagggcctgggtacatctctagggccccaggttcccattatccttgtctctaacccctgaatggagagtttgacttctaatttcatgctagaggtttcacgggcataattgtatttgcctctgcctttgatctgctatttgatctgctagtttattgtgggttcgactaggagacacagatagaaacgtggtggaaaacatgattttgttttgcttgggaattggcagttattattttctatggctcccttaacatgacacatcttccctaaatccaaaatctaatcattttcccatttttgaaaatccaaaaggcatgtgtaccctctggcctgctttcctctcccctcctgaagatttcattttcagtaagactttggaggcatgacgttcagattttagacctcagtgcagattggagccccgaattagtgtaatacacctgggtgaactctgccacacctgcccctttcctgacctcaccacggcttcccaggatgtatctggttcaccctagcctcccttgaggtgattttgggtctgcagggccaactcctatcctgagacccaaacaaagaaacccagattcagcaggtgggtcagaactaagcgacattcaggggatggcccttgaaataagctggcttctcaggcagggtcactgtattacattgtacagtttgtgtactgcacaaaggtccccagccaaaacacagaataggctactggcagctctgttctcagggcaaaggagaaagagattatgtctctgatccagaagaaaagagaaggtgacacaggacagatagaggtcaaaagggtttcttgggagcacactggatcagcctaagactggaccaagccagtgttgacccagcatgttggcgcggtaggcctatatacactctctttgttttgttacctctcatctgcaggcactggttcgtaagttattgggtccctcctaggccttatttggagtgtgggtgggagaaggacaggagtgtcaccctacttatgtgtcttgtttagccagcaagatgggatttgtttcttgggcagagggagtttctttggtttatgaatatgaagattttaaggcatattgttcactgcagaccgttatgtacttgatgtaggtgtttgagtgcaagaccctaacagggctaggcgcggtggctcatgcctgtaatcccagcactttgggaggccgaggcgggcggatcacgaggtcaggagatccagaccatccaggctaacacggtgaaaccccatctctactaaaaatacaaaaaattagctgggcgtgatggcgggcgcctgtagtcccagctacccgggaggctggggcaggagaatggcgtgaacccaggaggcggagcttgcagtgagcccagattgcaccactgcactctccagcctgggctacagagcgagactcagtctcaaaaaaaaaaaaaaaaaaaaaaaggggagaatcggcctggtttctggctcacacctgtaatcccagcactttgggaggccgaggcgggcggatcacgaggtcaggggtttgagactagcctgaccaacgtggtgaaaccccttctctactaaaaatacaaaaattagccgggcatggtggcgctaatcccagctactcaggaggctgaggcaggagaatcgcttgaacctggcaggcggaggttgcagtgagccaagatcgcgccacttcactccagcctgggcgacagagtgagacgacgtctcaaaaaaacccaaaaaacaaaaaaaaaccccaaaaaacaaaaaaacaaaaattagccgggcatggtggcatgaacctgtagtcccagctactctggaggctgaggtgggagaatcgctccagcccgagagccagaggtcaaggctgcagtgagcccagatcgcaccactgcacttcgacctgggcaacagagacagaccctgtctcaaaaaatatgtaaataaataaaaattaaaaaaaaaaaataaaaaaggccgagttcggtgactcacgcctgtaatcccaacactttaggaggccgaggtgggcagattgcctgagctcaggagttcgcgaccagcctgggcaacatggtgaaaccccgtctctactaaaatacaaaaaaaaaaaaaaaaattagccgggcgtggcggagtgtgcctgtagtcccagctactgaggaggctgaggcaggagaattgtttgaacctgggaggtggaggttgcagtaagccgagattgtgccactgcactccagcctgggcgagagagcgagacaccatctaaaaaaaaaaaaaaaaaaaaaaagtagaggatcatctgaagaaagaaattccaatcaaaattaaacaactccaaaaaggaacttttctagtgtcagtaatgggctggttgaggaggtctttgggagccttctttttattgattgactgattttttttttttttttttgagacagggtctcgctctgtcgcgccgctgcactccagcccagcctgggtgacagagtgagactacatctcaaagaaaaaaaagaaaaagtaatccggccgggcgtggtggctcatgcctgtaatcccagcactctgggaggccgaggcgggtggatcacgaggtcaggagatggagaccatcctggctaacacagtgaaaccctgtctctactaaaaaaaaaatacacaaaattagccgggtgtagtggcgggcgcctgtagtcccagctactcgagaggctgaggcaggagaatggcgtgaatccgggaggcggagcttgcagtgagccgagatcgcgccactgcgctccagcactccagcctgggcgacagagccagactccgtctcaaaaaaaaaaaaaagtaatccatgtcaaccatctgatggtggagggggatttcagatctctgtaccatactttcccttctccattcttaccatagcactagagcacaatgccttactaaattcatatccagtgtttactttgtaaccacatatatatcattcattgctgagccaaatgagcttcagtgattgcagttcctttcttgtaagatttttttttcctggagttaataattgcctcatttttatatttgcctaattttctttgacctatgactacttttcccatactttccaacctctgtacaattaatctgaggacaattttctgcatgtccaaatcttgaagaccatctgcaaatgggctgatctttttttgctttgtgtttctttttttaatccctattttctttaaatctgaaaactttttcaaaaagtttccaatcttccatttagttttattttctaaaacttttggccgggcgcggtggctcacgcctgtaatcccagcaatttgggaggccgaggcgggtggatcacgaggtcaggagatcgagaccatcctggctaacacggtgaaaccccgtctctactaaaaatacaaaaaaaaaattagccgggcgcgttggcaggcgcctgtagtcccagctactcgggaggccgaggcaggaaaatggcgtgaacctgggagccagagcttgcagtgagcggagatcgcgccagtgcactccaacctggacgacagagcgagactctgtctcaaaaaacaaaaaacaaacaaaaaaaacacttttatgaaatgcggtgggagtttttactgatttcaaatggggtattgtgttttggtgggaaattgtgtctgtcccacccagctaatgtcaagagctgagaaattaatccagagtttctgatatttgatattttgcttggttgaaataaactttcatcatttttcctaaacaacaacttttcagaagtaatgactgttagccccgggaaccgtggaaatattcagtattagtaaatctttaccctcccctcccccccgaactgattctacatttttagaaataaagattatttttaaaataattggcctttacccaggccatttactgcaagattcatgccctttatttacgttcacctcacggtgccttttatttgtgttcagtcatttacaagtctgcctttccaactagattgtaaattacttgagggggccaaaggtgtcttttaaaaattcacttctgtacttttggatccccctaggtcctaacacagcgcctcgcccttagcaagcgctccataaatgcatgttaaattcaaaaagtggacaaataaagttccagtgttctccaatcaggagccctaaaccgtggtaactctcaaatcctctctggcctcaacagcgccctgtgaacggtgggtaggcctcgccccccacccccagctgcctcggcaggttgcctctggggacagagttctggggtgcgcgggagaagcgataacacgttgaccatcgcgggagtccgggaaccagaggtcgtttctcaggattaaaatccgctccagcgtttcgaggaggggcgacactacaggccacgctttcaccagggacggccgccccatcgtccccgacctgggtcagcgtggcccgcagcggggaggggggcctcgggagggagcgccccccggcagcccgggaacgcccgcgcggcagccccggcccagcctgcggctccgcggtcctaccgccgggggcagcgccgcctgcgcagccgggccaagatggcggccggtgcgcagccgcccgcgtccgggggagaagcggcgacagccccgtgtcagccggggcgcgcgctgtcccagggcgcgaagccgctcctcctttacccacggggaccccgagggccagtcctgccacttcgtcctgacaggccccctgcccggagccctacctggacgggccccggctgggatcgggacggccaggaggatggccgcctggctagacatggtggacaggggaccagcggggaccactgggtgccagccccacacccaagccatttcttccagccctgggacacctctggtgcgcaattcgacattagtaaccgcaggtagggcttcatgccccgtaaaaacacagggctcaaagcacttgaaatcaggaatgtcttggaaaatctgctacttctggttgtgaaatccacggtattctctagtaaaggcagtaaaggctacagaatatgtgcggttcctcacatttgctgtgacatcggtatgcgcgcagtgtaggctgcctgcctcctaggacactccaaaacctgaggtccaatttaccagaaatggcattgatgaatgcggtgcattctgagtgatctcccgctgggctcaggttgggaggtcagaagggcccccaaagggagcagctaatgcaggtagaatcacaatggtagaaacagagaagtacccagaaacggttccccattaccctttgtaaactgggttgacacctcccactggttcaaggttccaaccaaagtttgcatgttgtttatcagctcagcttgagaggcagaatgtgaactttttggttttgttttggtgaaatagtctttctgcataacatttgcaccggcttgttattcttatggaaaacacttcctccacctaccctgggcagcagccacaccagcctttacttccttctgcaggccctcttaattacctctctcttgctccagtttaggcagcccccggcactttgttcaagtacagcaataaacccaagactgggcctaatcctctgtggtcctgaccttccccacagcgggcctggagtctggagggcctggagtctggagggccttcctgctcccctgattagggccaaggacgcagcttgatgtgttttgtgttttctcccctctgcacacttggtacttttcagagtgcttcactaaaaaatcagatacaagaaaaagttcacatcagccctttggagccaggcctccgtgagctggggtcaccccaccaccaagccaaccattcgacttctaaactgtagccagggccaatgggttaccgctgaccttttgcacaccgaattcctctcctagcgttagctcgggtggccagggagcctcagctgcacccacctcctgcccggtccagtcccgatgcccctcgcgggaagcgcggtaaccttaaacggcacgacaggcggctggccgagctggttcggtgacgactccctggagacagcggcttcgagcagcaggccccatctgcagcgcagctgaacgagttaagctgccccaggcgtgagcgtaccaggctggggcctggacaggagagaaccggcggggggccccggggcgcctaagccctaggatttccaagttgcagggggaaaggtgaacctgactcccctcccgaagggctgcgtggggggctcagaagactcctgtcaggggttggggaggcgcctcgaagcggggcccagagtgaggctgctgaaagggggcctggggggtaggcggtgcgccctcgaggccacctggtcagtaaaggcgcttctgtgctgtacaagcaagacagcagttgtagcacccgaccctcgggctccagtggcccacggtgcaggcgggcaggggaagagtggctctgcgcgcagccccgggtgccctaaggtcacctcctcatcccctgccgctgctgtgccgccccagccctacccccgccccgaaaaaacccggccgcgcgggccagagcctaagctgcacgggctcctgaccccggctcgccaggctcagcccagtccgaccccgcctcggcttcacaaaggccacgtgcggccagggccgacaaggaacgaccacgactctcagatctttaattacgctaggagtccctacccttccccccaacccatcgccggcttccagccctttaatcaatttcacgatattaaatattaatttcctgccagccacggtttctcggaggagggggaggggatgggcagggcagctccgaggctggaatggctttgcagggtgtgaccacgacagcagggcgcggaggacgcgcggattcctaagtgagctgtgcccagaactcggagccactgggttttcgctctgtagctggggaacttggagagttatgagcgcctgggtgcaggcctccaggaggggcagcgaggtgcgcggagagtccgggtgtgctgggcgaccgcctcctgctccgcgcgccccccctccccaccccagccgcgagtcagcctcacgcgggcccgcggcgcgctgcgatgatggatcgcgcctggcgggggtgatttggtgttgatcgcacattatcactggcaggttggactggttgctgatggacgacttctagcggcggcggcagcagcgtcttcagacaccgcgctgggactcgctcgctcggcgagggtctttcccccccccacaccccctccctacttccaggcgccaggagggcctgagagtccgagtggggtctcctcgcgtccaaggccgcccgctcccgtctgggtccgggtgtgggctgttggctgggtgaggagaggagccaggacgcctctcccacttcctcccactcctccttcccttgccgcctgctccccacccccttcctgcttccccaccgaaacccggaggccctgggtcactccgcgggtgatatccacgccgcctgaccctggccgcgggggtgcggactcctctgctccgcagcccccgaccctctcccccggtcgcagcagccgcggcactgcggtgcgccccttctcgcctctttttctaaagtgcctgcagatacaaaagcggtttcgtaatgccttccgtctgcgagagccggaggaccttggctgacctttcggaaactgattgcaactgcctgttaacagcccgtactgaccgcactgagcggagcggaggacaatcatttaagtgacagacggcgaggtggccccggctcagtcgagcggcctggttaagcccgccccgcccctcccccgaccccctcccctcccgcagctactcccccagccccgggcgcactgcgggccgcggcgggcgctcgggcaggcggagaggacgcgcgcgcgcgtgcgtgtgtgtgtgtgcgcgcgtgtccacgattaccggccgacgggttaaccctttgccgagcagccggtccctttgaggccgggtgctgccggattaatctgccatctgcaaaagaggaataacagggccgtctccgccgactttccctaatgggtaaactgtaccctgttagcgtgacccacgctgcgtccctgctgctgccagggaaagatccggacccttggctcttctgccgcggccctgggtcccctccctgcactgcccttcctctgcacagacacagacacaaggaacagcacgaggggtccaaaggctcccaggggctcgcggtgcagtggacgtgggtgttcccggtgttttctattttggaaactggagaaaggtggggtgggggggacgtagagaaaagccgaggtgggggaggggaggctggtgacagggcacctcgggcttcgctcgctccctctctcgggagagatcgccagctgctctccaacaggcagcgccctgaaatctatttaaagagagggaaaggggaggagaacaaagggggaggagggggacggcgagcggagcctgggcgagagcgagcgagcagggaggatccgccgctccgcgggcacatcaagcgctcacatctgtacactccgcgatcgatggggagaatggataatatttgtcagctgcagacctttctcttcccggttcctggggaggggagggggcgaggagggggaggggcgggcaggccaggcgagagaggccgcctcaaggacagcgcgcttcccgctgcagccacacggaaacccagagccatgaaagccgggggatttttctcttattatcattattaattattttttattattccagagcagccagcgaacgctcggtggcgcccctcccccgccgcctccctttgttgattctcagctgctagagcggcgggcccgagccgccaccgccgcagagcacgatctgctcttgcgccctcggtcgcagctgcggcccaggaagccggggctgcgtccccgccccctgccccccacggcgcggcagccctcgcaccccctcctcgcctcccgccacgaggccagccctgcctctccactgcctctcgctgcggctccgagtccccaacgcagagcagaggcactggctgctgcggccccgagcctccggccgcgcgggggcctttgccaccccctaacccccgcggctgcactctgatgccgccgtcctcacacatggtcttcattttgcacactagcggcgtgcttcctctcagctcctctcctcggggcttttcggagcgaggagggaggtttagaggaagttagaaacccagcgagcccaggggaaagggggaaaaccctcgctcttagtctcagcttccgaggcagagggagcgccccgcggggggtggggcagagtctgggtgccctccccttccttggatgcaggaaaggttaagtgaggggtggcggtcggaggagcgacagatttgcttttgctcatccacatgcctgctcagaccggcctgggtatcactgacccggcactctcggaacggcagaacccggatgggagcagatccgccaagcggtcatcaaacaagaccaaagacatttcagctgtcccccaccctcgggccttgggcgagggtgggggtgccccctgggtctttgcttcctcgcgcaccccaaggttggaaggccaaagccgacgcctcacagaccgggggtccgggccccctctctagggcggaggtgtgcagaaagctctagtgcgagtttacttgcggcctggctaccccctccccccgccgctgtcctgcgattccgggccagcctgcggcggcgtccccgactgctccgcggtcctgggcagggcaggaagctggcacggccgacggctgggcaggcgccacttggccgggcaggctgctcgctggaactcgcgcggcaccttcgcgccgaatcgggttcctgggtctccagcccggtcaccctgagcggtttcaccccccactttgaccatcggcctcccgcggaagtctccctgtctcctcccgccctctcggcttttcccttcctcattctgtctcgggagctccttaatgcagtcaaccgcctttcccgagattcaaaaagaagttttgtgtttccccgggggcagccgcctaatgcttcccttgttttccggaacaaagcagacattcagtgaggagggggcaggcgctgactccctcccctccccgcagcaccccgcactcctgcagattcagaacgctggctccggggcccgggtggcctgggggtggggtggggacccccttcccctaggcttggccacaaaagcctcgcccggtagccggagagaaagcggcgtggtgtttgggtgaggttcccagcccgggcggggagggcgtgcacgcggctgtttacagtgtgcctgtgctgctggaagctcacccgccgccgcttgacagcgtggggcacccgctggctgccagctcagaggagatgcgcagcggcgagccctccagcactccacccgaggcctccgcagcgccagggccagggcgcgctgggaagctccaggtctccaaccccgagttccttcggcccacatacccctccccgtaacaatggcctagatccggtagtatatcaaagggacggggtggggaggggtgaagagcgcacaaggggcgctcagggctgtcgaagcgcctgggttctgagcatatccccgccgccgcctgtccccttgcaggactaaattccccggcccgagtgagcgaaagacaaatactctagtgacttggaggtgtttctctctccggatacccccctgcaaccccaccaacccctacccaccgtgcccagtgaacttctctccaccccaccccgtggggaccgctgcactagctgtgcccacgagcgccaggccttctcgtcggcgcagcgctgccttagatcccgctccacctcttcccctctcctgggcctgtggccggcccctggcgcctccagcgcggcctgaaacttgatctcacgtcgaaaggacagtgtgtaaacaccaggcgcgctccgagaacccacgggaggggccgagcgagggccgccggggcagctcgaggccccgcgcccccgcctgcctgctcgcccgggacacgatcggcggggccgccgtctcgctctctgcctccccagttggctcagctaattggagccgccgccgccgccaccgctgcggcctcttgttgaattttctagatcgcaaccgttcagtcgtggctgcctgtcgctcccctcccccttccacagctgttacctctgccggcaacttggtggtggtggggacccgtccccccgctgaccctggcctcaggctccgagttcaccccagcagttccagggggtgtttttcttcgagacgtgggaagggaggtaaagccttatcggaactgtgaggcttcgtgccagaatccaaggctcgggtactagccagaggatcctcccggcagaaggccatggtcctccctgtcttacaccaggaggtagtgacagtcccggagggaggggctccaggaacaactctgctggcgacttctgttcattccaggaaaacattacagaagggtgaggtgatgggaggcagaaagatcccccctccctcctgcttgccccaatccctgtcagcacttgggcatttgggacttggtgtgtaggttccttctgcagcagagctcacctgcgccttgggcctaatccacccacatgccacaaggatgcttttcctcttggtttggagtacctggtgggtccaggggggaagtgccacccttagtgggttctggaggtacaactcccccatgctgggtcagttctatgcttgtaccaggaggccctcctgggccttggtccttcccagccatccccagccttagcctcctttccccttggccagctgtctcatgccttaaccacacatctgtgctagctgcaaaaggtcccgcctgtatggatctgtaagaggcccagagctcggccccatggttgaggtgggaagatgtgaagcagtttgctagtgcaggaatcatgaagatattgttgatgatggcagagcagttcctggtctccagcattgccttagaatggcttttcctcgtggtagaactttcgctagtgggtttcacaggctcagggcccaatcttgtgaaagtagctacactccccagcccggaaacacataaatacacataggcaaactcccaggaggctgggtgtaggaaccaccaccggggggatctgcagcagccagagaatgtctgcttttcctgtgatggttctgagaagggcgcctgttccctccctttgatggttctctgacaactgttaggtaacaaagagtggaggccacaggctcattaactgtcattttccacctctttcctccgcttctaacttttacccaaattactactttggagttttcctgaggtgttctctccatctatttataactagagcaagatttccaactcaatccttattgatttaaactatgataaaaatgaatccataaaattattattataatttggtgtctaagatgacatttcactaggtcaagttcacacagtttttggcatctaaaatcccccaggcctttccaatcagataacctaagtgtgtttcccactgtcagtttctcttccctttccgtagtggaaaaaaactgaatcctctcaaagatgtttattctccttcactcctaccccatcagtctgtgagaaccttgtttctgtttagggtaaggtatatttctatgttttgataaagaagagagtaatacatgttcctcttcaggcctgaaaagataattatgcatcctgggagcttgctcttctcctggctgtttaacggacaatctggattctggctctggagcaggaatgcttcgatgtcccagtctccttctcgtcccctttcctctgtcaccactcagccatcaccaggcctttaggcgggtcacacggcctgaggatttctgttctgaaggctcagagtgcctcagaagattgcagctcagagcctggtatcatgcattcacatttcttttactgtgcaaagcatattcggagccattgggattcctgttccatctctctgaaagcttatgccaagagctccccatggggcctatggtgatggatgtcatgaggcccaggaaggagccatcatggtgggaagagttgagagcctgcatgtaagactcagactcgaaccaaacctaagtgcaaataacaaggaaaaaaagcaactccgcgcacctggctggtaccctgcttggaaacaaaccgtacctccccaccctcccatctcaaagctagtagagcctaggggcacaccattcctttggcttccctttagcttgacctgggaatggcgcagttaagcatatcaggaagctgagatgcatccactactcctcacttcccctggcgctgggctcagcttggctgaacttgccgttcctgtctttttagaagagctggttgtgttcccgaagcaggatcgcactgtgccgcctccccaggggtccccagctattgatttttaatatccgtattcaatattgtgtattaaacattgaatccatgcacaagaggatgtgatgcaaatcaccagccgtgcctgagactttaatagttgttttattgcccggaaaccacagttggacgcaaggcatcctgcagccgaggctgggggtggggatgacaggctgagaagagagctgagcggagcggagcagagcagaggatacgagatctctgaaatccgcactactgaaggcacagccaggcactaacagctccccccaggcaggctggtggggggccggctccaggctgttgtggaaagagcaggggctgttgtgtgagacccgggcagaggaagaggtgtggggctgtgttcttccttcctggacttccctaactggactgtgcattcctgtccggcagtccttcccctccatgcagatgctcacccagaaacacatacacaacgatggaacaggaaagttaactttggggcaggaaaccccaggcctcgggcctcttccaccactcttcgcgctgtgaccttagcacagacctctctcaacccgctgggccccatttccctcctttgccaatgggggtgatgctatctgtcctacttccctcacagcgctggtggtgaggctgccgcggcacatgagataatattcggggaaaaggcttttgtaaattgtcaggccccacgtaggcaggctgagggattagtgctggctttccctttatactccctctctcctgcaggctgtgtctcctggctgccttctttctcagacatgggcctcctcccccatgaagggccctctcttctgtttcctcggccacctctgcttgatctctcaggcttcctgctctgcctggactctgcattcaggctaggcaatccggtttggaggaggcccagcagggagaaaggaagggtgagaacgactgagtgtgtggtgggggtgagtgcagcaagtgtgtttaaagccaacagcctcgggagggaggagaagcacactcggtagctgcggccctgggttgcggagcccgcgggggtggggccgtgggtggggggcgttgatccgccccgtgtgcggacaagcgggagaagggttgagggaaacctgagtctaggagtgtcttcacgttacactgttgctggttatgggaagtccagcttgaatcccgattgctggaaggctagggtgtgggcagtgccttcagggtattgcaattgcgaaggccaaatggaaatgcggtggaaagtggcagccctccagcgccgccaagtcagataaaaagttgcccgaggccctgagagtggaggcaccagctctctgatggccttgtagacgccctgagaacagtccgagctcctcaaacccgctacctttgtcctgggctcaaggagggggcggaaaccagaggggcccggattcttgaagacctcccctggggaccccactgtctgctgggaaggcctcagccaactgtaggcccaagccctacagagaccagctctggcaggaagtcatgccaagagtctgtgtccgcgtccttaggcgtgagaatggggctatgccaggctgggcctggctgcgcacgcctccgcttcgggactcgggcggctgctgctgccttcgttttcgggtcttcgaccgagcctccctggctctctactcccgctttgtcttgctgtcagcttctcgcctgtcctcgccagtctcctaggtcggcgggtcgcgctctgcctctccgagtgcgtctttgcgcacatgtggcggtcttcctgcaacctgggtcagctcggcctcttcccgcggggtacttggctttgcctttggatcgctgcgagtgtccacttcttgcgctctccttctccccacctcgccttaggcagacgcatcccgggcttggcggtcccccaaacagaaatatccccgggtttctggtttagctccaccaaaacaaactcgagggattggggtatccttcacttgcgtttcccgcttctctcagccctaggccgaaactggagggtttttttgttttgttttgttttaatgagacctactttgcagagttgacggggaacatttctgcggcagacttcgaggtctgtggcgctctcccaactttcaagactgtaagccgccaagaaagagaatttgggtacatgattttgccgctgatgtgggctgggacgagggtatccagagtgcacgtgcatgtgcggatcgcagggactctcggtggattagccgccaaaagctggggagcgccgcgtatggacgctagggctgggggccagcggggacctacaaacaccccaggcggccgagcaggtgaaggaaacgttccgagcccgccccctcctcccgggcccgcacgccgccggcctttgcggcggaaacacggtccaactccttgaaagtaaacttgccgccaggggctaggggcgcgaagaaaggagggggctgacagcggtgtctgcgtcggggaggccaggaaggcttgtgtcaaatttcagcccccaatgacactcggtggcgaggtgccaaggccctgggaacggcggcgggggttctgggtgagagtgatcgcgccgcagggcccagcttgcgaaccccgaggcgcccgcagggcctagggaggccacgggggcgggcgcggcgggcggggagggggcgctcctagagcctcctgagcggagcggacgcaggcatcttccgcaatccattcatgcactgaagcgcgtgcagagctgctgatcgctgccattgttactcgcgggcggtgtgggagctgagcctccactctggcgagagataaatggcctctgacagcccctcctcgccaagagagctcctcggatttcaccgcgcggcggctctcaggtctgtgcctcgctcgcttcccggtgagaacctttaaatcagcctctcggccctccctcctcccggacactgtcccccgcccgctcaggccccggcagggccccgggcgcgctgtgtgcagtctcggggtcctctccccacctgggggttaaacagagtgggggcgcagggaggacctcagggccgtggggggaggcaccgggctccccagccccggctccgcgcctccgcgggagcggagccccgcgccccgcctccgcgcccacgagatggatcaggctaccgtgcggagagcgggctgtaaatatttaaaaagtctctcgcgcgccggcagtaatggctttcgcagtcggaatgtgtgctaggggaagaggaagggcgacgtgtactgtgttgcagggtggggaattgttcctacgcttccccttaggtccggggtgggctgcatgttcaggcttcccgatttcccgccctccgcctctccgccgccgcgtcccacgatagcatcgagaacgccagtcgacagggaacttgagcatagccgggcaacagaggcccggtcgaggtgaccccggagccaccctccccaccggggtctcccaagctcgtgggttgcgaatggtcccagacccctaatccgggtccgcttctcgctgctgcacaggggagggcgggaaacgcacagattggagccccctgagtttgggtggtcgcaaaagcctgggccggggtttctgcagagggggcctggaccctgtttgtgcctttgctaccctccccagccgctcttaaaccttgatccgctctccaggagacccccacccctatctgaatctgaaagtagctttgtggctgctgggaccgaaacctgggaggaggcagcacggagagtttggggcggggagggggtagcctccaggcttagtggaggtcacacgtggacctgaacggggactcttttgcctttctggtgagtgtgggcctgggatctttaaggccaagccctgccggatggtagaggtgggggagggggattcagccttctcggcttggctgggagagacttaatgggcccaccacagggtgtgtgtcgggtgaggttgtcccctttgccagcggccactccctagcggggcggaggggctgagttgcccagagctggggcgggccgggcgccgcgggttcgcgcggaaggttccaggggtgtgggcccagtccggagctgttcgcctgcgccccgccggctctgggacctgccaaagtgtgggtgctggcggcgtgtcaggacgcgccaggctgctctccgcgttcgagcgctgggagctcccgactcctggcagctccgtgcagtcctcttccaggggcttgtgttgcgcccttctcgcttgtttgtctcgtgtgagcctcgtaaaccgccttgatttattacccagactaaatgcttaatttgtgaatatgaaacagattaaaaggggcggggggaggggggttgaggtcggcatattttagcaatcagaccaaagcagctcggcagatgtttcaaatttgtcgacattttcaggctcatgtggaaagccagccagagtggtcaagaggtcctttctccttccttcaacctgagaacttggcagtgatcaaaaggaggtgattagtagctacagagaaaaaacaccagcaggcaaggagttaacagagactgagccgttcacctccaggattgggatttggcggggagggggggcggtcacaaaggcaagaggaatcctggctaaacaggcgcaagtcgtggaagccaactctgaagaacaaagtggagggtccgttaaaagttaattcagtaaataaacttcattggtgataaaacaaataagaaagatggaaactccaacttaaaatagccaaaagataagaaaaataaatcgcttttatgtggcctgaacatgtgcatgtgtctttggtcaggtccccgcaatgatccacctaacaaaggcctctcctgagtaccctctccctttgaataccccacatgtatagccagtgttttttggcgtttgtcattttggggcaacttcacacatcaaaggcgagcaccgttttcttttcagctccctggttccagccacccagtgaagcagatacaatttctataaattggccttcttctccaggtttcgattgatcatcaccatatgagattactgaaagtctaatgtcttatttcactttctccaaggagtgaggaggggaacagtttattgaaagtcaggccacgtgaagactctggtgttgtgcaatagtaatttccattagcctggatttatcagcctcctgatactgccacctgatactgcagtctcctgcaggttccttgtaccaccttccctcttcccctccaggtctcagcatctgtccccatgaacaggtagagttcaaaccggagccttcctattggtaaggagaaaatggctgatgaccaaaaattaggaaacaaaagatttgttgttgtttctcaggacggagtcttgctcttttgcccaggctggagtgcaatggcccgatctcgactcactgcaacctctgcctcctgggttcaagcgattctcctgtgtcagcctcccgagtagctgggattaccaggcacgcgccaccaggcccggctaattttttgtatttttagtagagacggggtttcaccacattggccaggctggtctcaaactcctgacctcgtgatccacccgcctcggcctcccaaagtgctgggattaccggcgtgagccaccacgcctggccaaaagatttgttttttaacatatttgttataacttaagaatcccctctttggcttttgtttcctactccaaagttttttgttcccctttggccttgataccatctttcgttttattaaagttgattatggttcctctgtcttgtccctagccagacaaaggcttaggagaagtcaaaggacgtgttaattatgtttcttgtaaactgacttttcatttccccctaacacatttagttggcttggtgtttagtttaacaatcaattgctacaaatatgctgcttaaaaatgctgcttttattaaaacaaataaatgaattcaaagacctttctaatttcaactcgtgtgggctagaaacagaagagaaaatcgaaagcaagagagagggaaaggcggcagggaggggagagaaaggagaccaggaaacacacacagacacacacacacacacacagacacacagcattcctgctgccatccctccggaagccatgttaaactggtccatacaattgtccctggctgccccctgcagctcgccagtccttctggattttccatcacttggcgcctaaggcgatcattagctgagaatggacaacctcctctacctgccggcagctcagctcgtcatttaccagccaggggaggctggccccatttgctcaacccgagaggggtccttggtttttgcccctgggtgcattggtgcctaattaaactctatccagggcaacgtgcactaaatatacgtaggctgagaggaagctgggaggaaaaagcagtcattacctaggaagagaaagtgaatcttccgagagagaggaggaaggacccctgcgatggtgctttctgtttaccctcagcagagccttggagtgcatgttcacttgggtgctgaaatcaaggagaaatggaaatcgggaaaaaaatccatagcccacacatacctgaacagggcctatgtcaccacagagcaggagggaggtctgctgtagctccagacagtgttggctgcagaaaaatgactcaggtgcccttgtggcatcggagttattgctcatgtgccacggccccctcacgcacaggagctggagctgtataaatggccgtggggacagaaaggaacagatgtgtcaagagtccaaggactaggtgtgtgttgtaaagccaaacagatggtggaggagcaggggagaaccttcagctgaaggctaaagaccctactagcacctgggcccaggcaggatcgaagtgacccaacctgaagctaaaatgacagccggcaaacaagaatgtatgcagatgtcatacaagagccaccagggctttaattgagctctgtttaacccagtggaggaaatcagttgagagggtgaaaacactagctcagggtgacatgtttgtggcaaaagagaccagaacccagagctcccagcttcagaaaacagccagaggaggaaagtgactgctggttagagaaagatccagagtgctcttggtcactgaagaggcctggtattttagtcatttggcatttattaagcacttgctgtgtgcaaagcactatgctggcatcaaagggggctaccagcactatgagccctcaaaggactgagcagggaagactctcccctttatatgtgcctggtgacaaaggccatgaaagacagtgggtgaaggggctggggaatgggaggaggaagccaaccactctgggttccactcttgaagatagcagtttacaggtgggcatcgaggccagagggcaacctgtagcaatggacccctctatggcctccctgagccaaaccctacctggctaagcacctgcgcctgtaagattgtcctcccagtggtgggagtgcgagagaggccatcttcacttccccttccttggagggcctgactttgttgccctaggcaggccaggaaacttattctaatgccaacgaaggaggcaacttttctagctagaaaagcacacgctacagctctctctcttgccctgaacaagcagaagagcacagcttatccccaaaagctcctggacaaatgtaggctctctgggggagctggtaagggaatactgcctcccttaacaaaacaaacctgagaatctccaaggtttagcactgcacacggagtctcccagcagagaagggggctagcttaagtgccccatgcattccacctgccccttggggcgctctcagtgtgatcacaggtgcccttcctcaagccatctggcctgggcccagcctctgctcttggtttccctaagcagaggcgaaacacgctggaaccttcaaagcacattcctaaacactaagagagagctgtggggaagtgaaaacaaagaggccaaggagcgctggagcagttcagcttccagagtctgtgggccaacagggctggctcaagttcagtcagacttactggccctgggccaaccagagctggcagcgtgccctcttcagcccactgctcaggccccgtcgccccccaaaaacctgggcacaccccagagcaagcccaagccccaggaagccctgctgccccttggcagccctctcagaccaccccctcccccttctagttgtgggttgctagttccagagccagggaatggcttccaaaatcccttcacccagagcttcccaagagtgagtgggttgccaatgggtcaagacggggatcccccagcccctcagagtgaaccaggggtgacccaattccttggctggcagcttcaggccatgttgggcaattgtggacactcggtcactgtttaactttgtgcaacagaaaaatatcacattctgtgctgagaatcactgctcacttgtcataagtgtggcatccatgctccaagagttacccacacatacgaataggaaggatattggaccacatggtccttcgtggatggtgaacacagcatagtcagtgattcaactagcattcgttcaagcctctcttgtctgtcctgcactgtgcttgtggctgttggggtggctcggggaaacccccggttaacaagacccaggcccctccttagagaacataaagtctccccaagagagataagccccatggagctgaaaacttcattgtgcttacactaaaaccaggagaaagagcaatccctggtattactcctcaggcatagttttttggtttttttgtttgtttgtttgtttgttttaaatggggtctccatctatctcttgctgaggctgtagtgcagtgaggtgatcacagctcactgcatcctcgacctcccaggctcaagtgcttctcctgcctcagcctcccgagtaggtgggactacaggcatgtgccaccacagctggatcatttttcttttttttttttttgtagagactgggtctcaccatgttgcccaggctggtctcgaactcctgggctcaagtgatcctcccgcctcggcctcccaaagtgctgggattacagccgtgagccactgcaccccgcttaggtatatatatattttttaagccaaaggtctgatggtgtgtttctgcccactttacacataaagctgggaaactaaagactccctcatactcccagcagctgacctgctgaatgggacttgggagctgggaattccgtgctttctctccaaagggtccgcccaggtgacatcaagttcatggcagatgttatgggtaacacctgcacttggcagaaaattctaaggctataaaaggatgtttggtgcctctcccacccgcatttctcagtcactcagtttgcctctctgaaggcaaccagtgctcccagtttattgcttactcttcccaagatagtctattaaggctgattttttttttttttttgagacagtctcgctctgtcacccaggctggagcgcagtggcacgatcttggctcaccgcaatctctgcctacctggttcaagcgattctcctgcctcagccttccgagtagctgggattacaggcgtgtgccacgacgctgggctaattttttgtatttttagtagagacagggtttcaccgtgttagctaggatggtctctatctcctgacctcgtgatccacccaccttggcctcccaaagtgctgggattataggcgtcagccactgcgcctggcctattaaggctgatgcttaaaaaaaaaaaaaaatatatatatatatatatatatatatatatatatatatatatgtatatatattatatatatatatatatatatgtatatatattatatatatatatatatatatgtatatatattatatatatatatatattttaaattttattttgaaaaaaatcccaaacccacagaaaacttgaaagagcagtacaatgaacacccatatatgaaggcaggttttcaaaagcattatatttattcaacacgcctacccttggaaagaattcaaaaccccttcaaaggtctgaattagtttaactttatcttaaactgttacttaggagtacttttccctcatagacatgttgcctgcttgttcatccccctcctcccagcccccagcaccttattagtgtgcctcgtgcatagtgggcatttcctaaagcttgcaggattaaatagcgaagactatgtcgtagttagtatgggggagccagactgtctgggttcaaaacctggctctacaacttgaccagctgtgtgacctgaggcagttactctcgccaccttacttcccccatctgtgaaatggagggtagtgatacaatatatttaatgatgttgggaggattagttgatggacataaagcatgtaaaatagtgcctgggccagacacggtgtctcacgcctgtaatcctagcactttgggaggccaaggcgagcagatcacctgaggtaaggagttcaacagcagcctgaccaacatggcgaaaccccgtctctactaaaaatacaaaaattaggcaggcgtggtggtgggtgcctgtaaccccagctactcgggaggctgaggcaggagaatcgcttgaacccgggaggcggaggttgcaatgagccgagatcgtgccactacactcctgcctgggtgacagagcaagattccgtctcaaaataaataaataaataaataataaaatagtgcctggcatctagaaagtgcttaataggtgttagggacacttgagacttaaacacacttggtattaactttgctttggtgattgcatgtaagtcatttggccgagttgatggcctccgagttttccttggtaaccatgagagagacccaagaaaaccgggaatgtggcttcgtagtcgtccctcgcctgagaggattgcctacgctcagcacataagtagcaggggcttcttgtgaccagtttccactcatggagagtttctagctgtgcttattaaaaagatatttgaggccgggagtggtgactcacgcctgtaatcccagcactttgggaggccaaggcgggtggatcacctgaggtcgggagttcgagaccagcctgaccaacatggagaaaccccgtctctactaaaaatacaaaattagccgggcatgatggcgcatgcctgtaatcccagctactcgggaggctgaggcaggagaatcacttgaacccggaaggcggaggttgtggtgagccaagatagcgccattgcactctagcctgggcaataagagtgaaactctgtcttaaaaaaaaaaaaagatatttggagggaaagtcgccccccgtccacttcccttttatagcctggctagttgctgccctgctaatagaaccatctttgaagaaagagctagcatttgttttacccacagaccggtaagatcttctctctcagggtgaagcctaggctcacaaaagcctgagatcagaaagtcaagggttagagagagcaagtaggtgcaaccccagaaacctccactgtctggcaagccagagagtcttggggccccccaacagacaaagttgtctggaattttcttcacataggaagtgtagaatggtagatgtcttaagagccagaggcaagagaggactggggaaagataaaggaatttgtttattttattttatattttattttattttattttattttattttatttttgagatggagtctcactctattatctaggctgcagtgcaatagctccatatcggctcactgcaacctccgcctcctgggttcaagtgattctccagcctcagcctcccaagtagctgggattacaggtgtgtgccaccacacgtgacaatttttgtatttttttagtagagacggggtttcaccatgttggccaggctggtctcgaactcccaacctcaggtgatctacctgccttggcctcccaaagtgctgggattacaggcgtgagtcaccgtgcccggccaggaatttgtttaaaggtatactctgtgctataaaatactgcacctaatgttaggctttgacggctataatatctgactttgacattgaggtgtatctgccatataatttaattaacgtgtgatgccggcacaatgccagagagtcaaacattctgacagctcttggaagccacataagtccctttgaagttccccccagtgaagtgacacacagagaaacctcctatggttgaggacagcccctgatacggtatccagaaatttagctgcgtcttggttatattggatggcactggcaaagccacctgctggtttgccacagttctggaggtctgctgtggtttctaagggccccaaccatggagactggctctttggggaagaagaactcattcttcatcagggacaaaattgggaggtctcctgtttgcatattttgttctacaaaatgtttttttcttcctcaactttgcttagtgcaaagtcattgagctgcacacaggaacgtaaattaggtaagaggcatattaaccaaggagaaaaaagaccatagacatctattttgcacataattatttaacacccaccatacgcctaccaaagctttggacatttatagcaggaacaaaaacaatatcttggacatcataaaactacattttactggggagagaaaaagtacatgagcaataaaaatatataatattgcaggttgtaataaatactcggaagaattaagaagggtgtgaggctacagagagatggaatgttcttttatgtagttagttatttctatctacagcaggtagaacgagtgttcttttagatggtaggttgtgcagtatgagccttgggttgaccgagtaacgtgctcaggcgatatatcaataagctcttgtcacaacactgttgtatcacaaaccacctcaaaacatcagtaagcacttatttcctacatacatgtcagtgggtcacctgtggttcactggtctagaatgtgctcaacagggcttgactccaagtgtggattggatctaaagctgctccacgtgtccctcatcttctacggacaagtgggctacctgggacatgttcttctcatgacaatggcaaaagtgcaagagggtagagtgcaaatgcaatgactcttaagtccgggactcaaaatttgcacactgttacttctgcctacatctattggccagaagaagtcatgtggcctgacatcggtgggatgaagaggcatgctctacctctaaaaggtgtggacacagggggaggtgaagcactgggaagagtaatgcaatctgaaacaggtgtttcaaaccaaaactatgtatctctagctgtgacatttatatatacaaacacatatatcaaatgataaaacgacccttgttgaaaccttcagttttagattaaatttaaataaatccatgcaataattacattaccctccccgagatggtttatgatgtcaccagaggcttctgggtcattgccgccaatctcaggaaacctgggaagatgggccaccggccatcccaatgctgagagacaaaaaggccatgaagggccgggcgcggtggctcacacctgtaatcccagtactttcggaggccgaggcaggcagattacctgaggtcaggagttcgagactggcctggccaacatggtgaaaccctgtctctactaaaaatacaaaagttagccaggtatggtggtacacgcctgtaatcccaggtactcgggaggctgaggtacgagaatcacttgaatccgggagtggaggttgcagtgagccgagtattgtgtcactacacttcagcctgggcgaaagaatgagactcttttctcaaaaaaaaaaaaagaaaagaaggaaaagaaaaaagccatgatggaatggagacctttcttcctacaggggtttcccttgcaggaaaggtacaggtgggaaagctcagaggagaccccagaccgagcaagtttccttgcttacctctaagcatgtcttggagatgtggcataggatccaggaggtgtgactaaaagctagacttttagccagtctcgcaggctgtgcaggacacaccttcatctgttgtatgaaggtatatgagctggccaaagattcgcgttcttccttgcagctccttttccccccagttctgcccacctttctcttgctgtccttgaataatgtgggggggattcctaagtgtctctgcagaaagtgatgatttctaattttgggcctcctttcaatgaattcctccagggctctgcagtcagccaagtactggaacctagcccttccctttaggaaggaaagctcttggttcaattgattccgatggttaatggaatctcatcaccgttgcccagagtggttctaatcaaaggaatccactgtctaaaaattcaaggtagcagcatcaaggtttacatcttgtaagcaaagagactggggcactggggcagatatgttttatggtggagccccatggggattcagtctcttatttgggagaattctggctcctggctccaaaggtgtgtgagttgatccatcttctgtaactaatcctagcctggacttggaagggggactgccttttttattttttggtgtttggtttttgagacagggtctcattctgtcacccaggctggaatgcagtggtgtgatcatggctcactgcagcctcaacctcctgggctcaagtgatcctcccacctcagcctcccaagaagctgggaccacaggtgtgcgccactacacccagccaattttttatttttagtagagacaaggtctcattatgttgctcaggctggtcttgaactcctgggctcaagccatcctcccgcctcagcctcccaaagtactgggattacaagtgtgagccaccacgcctgaccatgtccttgatctgtaaatgacagtagcttttggaaactgagaaaataaaaatctggatcagacttcaagtcccctgacccctctctgatctggtcctcgtcttcccctctcctctggttccacagctgccacagagcacacccctggggcagcccagtgagtccctctacccattcatgccctcctgcttgttctgccctgggagggagcctcagcccctgagccccctgcctggagtgatccccctgctcaccctgactcccagctccaggccccacctcctctgcggagcccctcccaaatttctagggggttacatttcagtctaattctcccagatgcctttgtgcttattgtcacagccacaaaacttatcatttggttgctctgaaatgactttacgccttatctcctcgcttcagttgtaagttcttagagcacagggaccacagagcctagcaaggtgttaatacacatgagtgtacttactggttggatagcctcccatcaatttctgtctcttagtggtgtgggagtagaaaagactccccagatgttagggccaagaaggttgaaattgaggccgggcgcggtggctcacgcctgtaatcccagcactttgggaggccgaggcgggcagagcacgaggtcaggagattgagaccatcctggctagtacagtgaaaccccgtctctactaaaaatacaaaaaaattagccgggcgtggtggccgtcgcctgtagtcccagctatgcggcaggctgaggcaagagaatggcatgaacccgggaggcggagcttgcagtgagccgaggtagcgccactgcactccagcctgggcgacagagcgagactccgtctccaaaaagaaaaaaaaaaaaaaaaagttgaaattgaagtagatggccgggggcggtggctcacgcctgtaatcccagcacttcgggaggccgaggagggtggatcacgaggtcaggagttcgagaccagcctgaccaacatggtgaaaccctgtctctactaaaaatacaaaaatgagccaggtgtggtggcatgtgcctgtaatcccagccactcaggaggctgaggcagcagaatcacttgaacccaggtggcggaggttgcagtgagctgagatcatgccactgcactccagtctgggcgacagagcgagactccatctcaaaaaaaaaaaaaaaagaaaaaaagaaaaaaaagaaattgaagcagatgagctcagatcatgagggattttctgaaactgctatattttgaagaaaaccttgctggtcccctccagttttctgtaataacctggctgagcagtgggtttcactgtccggttcacgcactaactgcttcagggtcacctggggtgccagttcagaattcagagtcctggccccacgcctgaaaatactgactcactaggcctggggtggggcctggaaatctctatctttaacacgccactgctgactctgacgcacagccaggtttggaaactagtcgagtctgaaaagaatgttctcttcttggaagtgagaaaatgttaggggggcaccgtgagaaggggctatgatttggattctgagagaccaggtttgagtctcagttctgccacttaccaggtgtgtgaccatgggcaagttattcagcccctctgcacctcagtttcaagtgggaacaccacggatctgttttgtgactagtgccatgcaacaaattaccccagaactttgccacttaaaacaactctttggccgggtttggtggctcatgcctgtaatcccagcactttgggaggccgaagcgggtaggtcaattgagcctaggagttggagaccagcctgggcaacatggggagaccctgtctctacaaaaatacaaaaattagggtgagaggattccttgagctctggaggtcgaggctgtggtgagctgagatcccaccactgcacttcagcctgggtgacagagtgatactgtctcaaaaacaaacaaaaaaaaccccaactctttgattttgttcacaattctgtgggttaggaattctggaacggactcagctgggtacttctcacttgggatatctcattcggttgcagtcacacatcaacaggggctgcagccatcggaaggatatccgagatggcacactcctgtagcaatcagttgatgctggctattggctgggagctctgctgggctgttgactgtggcacctatgttgtgagtctctgccatggcagtagacttcttactgacttctctcagagcaagtgccccaaaaagagccaggagcaagctgcatggcttcttctgcctttgtcttacaagtctcagagtgtcacttctgttgtgttgaaagcagtcacaagcccacccagacttctagaagtagagacagagaccacacctcttggtgggaagagtgtcgaataactagcgggcgtgtttaaaaccaccacggtatctcatggggttgttatgaggattcagtgagatgatcttgctgaagtgctggacaagcatgagttcccctcctccttctaatttgaggcctggaggctaacagggtaaagccagtgccaggtgccaggtctccagtcgcttgcagttgttcatgtctactgggccatagggaccgtttttctcagtcttgtctcctcttctcttctcttctcttttactgacagagtttcgctcttgttgccgaggctagagtgcaatggcgcgatcttggctcactgcaacctctgcctcctgggttcaagcgattctcctgcctcagcctcctgagtagcttcaattacaggcatgtgccaccacgcctggctaattttgtatttttagtagagatgggatttctccatgctggtctcgaacccccgacctcaggtgatctgcctgcctcggccttacaaagtgctgggattgcaggcgtgagccactgcgcctggcctgtttttctcagtttctagtcatttctagtccttttggatagtaaatgcagggtgcagtgagcaccttctcattctgaccagctcagctctctcaggaggttgggactgcaagatctgtggttcactgtcacccccatatcagccttacccatgtgcctgatctcaagtgcaagctcactgggctccgaatgggaacacctggctgagtactgagtgttttcaggtcagacaacctggtttggggcccaggagggtcatctgttgcaatggtggcctgaggggcagctggagagaaagagagcagctttggttggcgtgggtcttctgtctcacggtcatgagtgggccccttctctgaccttgctttcttcacctcaggtctggagacagtggaggagctgaggaaaggtcacatggagaccactggggccagcaagccagctccccagggaaggtggggggtggcttgcatgacagatgcctcaggatgaggggcattaagagggtggctgggttccaggggctgccagagtgggtaggatttgccaaatagggtacccttggaaggcaggacacaagagggaggagccattatgtgcctgctgcaattcactggcatttgtggagggggtcgtttgcccctctggcccacacccttattcctgaaaaaggcagttgggcctgtgtttagcactccgaggaacctgctctctctggtcctcttcttttccttctggggctcctgaacctccccaccgacatgcttccctcattaccaccaagcctcacatgcagcagctgccttgctgagagcagacaggggtaggcttggagctgcacagcgatgcgacacatgatggggctccttctatgtgccccacacctagccaagggctaaaaatggtcacacgtctccatgatctcattgacgaactcacaccatgggcctgaaggagtgatgtgtgagtcagcaccccggaatccctggcagagcgggtcttggaggaccaggaagaccaggggaaacctcccagattgagtcattaggataggtcatagtgcaggctgccctcccctcagtctccatgcctcagtttcctcacctgtaaaaggagagtaactaagtgcccacctcatagtgtgaccacaaggagggaattggggtgcacccttaatcaggctgctctccacctgttgaagatttagatgaagagggacagggaaggagggcaggtgcatagggagttgctggggcaggggaggcagagtcatggaggagaaggcccggagggtggtagaggaggtgcctgctgcacgggtgaagtctgttcttcttcttttttttctttttggatggagtctcgctctgttgcccaggctggagtgcagtggcatgatcttggctcactggttcatacaattctcgtgcctcagcctcccaagtagctaggactacaggtgtgcgccaccacgcccagctaatttttgtatttttggtagagacggggtttcgtcatgttgtccaggctggtctcgaactccggacctcaagctatccgcttgcctcagcctcccacgcctgctgggtttacaggcgtgagccaccgcacccggcaaggagtctgttcttagaggcagagccaccactcctgctcccaaggaaaggacagtgaaacagctttcgcccataccccaacccccacctccctaaggccccgcagctcctccctccctccgtctggactgtttccccttctccctaagacatttcctggaagctctgcccacagttcttccttctacttatatacctggcctggccccagccctgccactgaggcctggcccccccattatgtgaccagcttttcctcttcttctttttttttttttgagacggagtctcactgtcgccaggctggagtgcagtgacatgatcttggctcactgcaacctctgcctcctgagttcaagtgatcctcctgcctcagcctcccgagtagctgggactacaggcacgtgccaacatacccagctaatttttgtatttttagtagagacggggtttcaccattttggccaggatggtctcgatctcttgacctcgtgatctgcccgcctcagcctcccaaagtgctaggattataggcgtgagccaccatgcccggctaacttttcctgtttctactcacttgggctgagatccccgttctcctatgtcaccttccttaaacatcacaccttggctaagaggaaagactgtccatttgggagtctatgcccactagctctgcgacctcaggagagccgcttaacctctctgagtctcagcttcatcatgtgcaaaatagggtcatttagttgtgactagtgcctcattttgaccgtacttccatgaggattgaataagggaatgcattgaatatgcaacaagtacatagtaggtacttaataaatggcagctatttccatggtgattctaggcctgtgtatccagagagtatttgactaatagacatctgcacgcctgtaatcccagctactccagaggctgaggcgggaggattgcttgaggctgggagtttgacaccagcctgggcaacatagttttttacaaaaagccatctgagggtatgacttgcatagggagccacttattattggagggcagataaagaaaaggaggtattcctttctttcccctgatgattcaggcaaggtggtccctgctcccttttatttcctgagttacatctatgctgtgccctagaattggaatcagtaagcacagatgccattggagtttttccccaatattcttttttttggagacagggtctcactctgttgcccaggctagagtgcggtggcgtgatctgggctcactgcaacctctgctttccgggttcaagcgattctccagcctcagcgtcccaagtcgctgggatcacaggtgtgtgccaccaagccgagctaatttttgtattttttgtagagacggggttttgccatgttggccaggctggtctcaaactcctgagctcaaatgatctgcccgcctcggcctcccaaagtgctgggattacagctgtgagccgctgcacctggcttctaacccaatatacttttttgtttttttgtttgttttttagaaggagtctcactctgttgcccaggctggagttcggtggtgtgatctcagctcactacaacttcctccttccgggttcaagagattctcctgcctcaggcacccaagtagctgggactacaggtgcatgccaccactcccggctaatatttgtatttttagtagagatggggtttcaccatattggccaggctggtcttgaactcctgatctcgtgatctgtccgcctcggcctcccaaagtgctgggattacaggcgtgagccacagcgctcggcctcttccccagtattcttgctgccttttttttttaaatttatttatttatttatttatttatttatttatttatttatttattttgagacaaggttttgctctggagcgcagtggcatgatcatagctcactgcagcatcaaattcctgggcttaagtgatcctcccacctcagcctcctcagtagctgggactgcaggtgagagccaccactcctggccagattttaattttttttttttaagacagggtctcactatgttgcccaggctggtgtcgaactcctgggctcaagtgattatcctgcctcagcctcccaaagttctaggatcacaggtgtgagccactgcctagtcaacagacttgcttctaagacttttggatggaaactcttctagagtatatttcaatgagatatatcagtttgctattgctatgtaacaaaacactctaaaccatagtagcttaaagcaacaatttcttcttctatcacaattgggtaagttggctgggctgttcctctgctggttacatctgggtttactcatgcagctgcagtcagctagccaacagctgtggggagatccaagatggcctcatgaacagtgtggcagttggtgccagctgtcagctgcagtgaactgtcactcttctccctgtggcctcacatcctcaagtatgtgagactggcttccttacgtggcagcctcagaactgcctgagagggtgaagcaggaagctacaaagtctcttaaggcttctcctcagaagtcacacagtgtcacttctggtgcattctattggtcagagcaagtcatgatgccaactcagatcctcgaggaagagatggagattccaccctagattagtctgctggggctgccataacaaagtaacatacactgggtgactcaaacaactgaaatatattgtcttactgttctggaggctgcaagtccaagaacaagttgtcagcagggttggttccttctgagatctctctccttggcttgaagatggccaccttctttgttgtgtcttcacatgttcttcccaatgtgtgtgtgtgtgtgtgtcctaacctcctcttttttttttttttctttttctttgagacaggctggagtgcagtggtgccatctcagctcgctgcaacctccacctctcaggctcaagcaatcctcccatctcagcctcctgggtagctgggaccacaggcgcacgccaccatacccggctaatttttgtattttcagtagagacagggtttcgccatgttgaccaggctggtctcaaactcttgggctcaagccatctgcccaccttggcctcccaaagtgcgagccactgtgcccagccagatgattcttttttgttgttgttttcgtggttttttttcttttcttttctttttttttttttttgacggaattttgccttgttgcccgagctggagtgcaatggcacgatctcggctcactgcaacctctgcctcccaggttcaaacgattctcctgccttaggcacccaagtagctgggattacaggcatgcaccaccatacccagctaattttttgtatttttagtagaagtggggtttcactctgttagccaggctggtctcgatctcccgacctcaggtgatccgcccaccttggcctcccaaactgctgggattacaggtgtgagccaccacccagccccagatgattcttttttttttttttttttgagacggagtctcgctctgtcgccaggctggagtgcagtggcacgatcttggctcactgcaacctccgcctcccaggttcaagcgattctcctgcctcagcctcccgagtagctgggactacaggcacgcaccaccacgcccagctaatttttgtatttttttttttagtagagacggggtttcaccatgttggccaggatggtctcaatctctcgacctcgtgatccgcccgcctcggcctcccaaagtgctgggattacaggcgtgagccaccgcgcctggccgactcccagatgattctttagtgacttcttctgtctgcctggaggctgtgagacatgtgccctctaggcttgccattaacttctgtgaacacactcagctgtgacagctctgagggaactcacccacccccatattagttatctaatgctgcataacaagttgcccaaaaatgtagtggcataaaccaacaataacaatgtattctatctcttgatttctgtgggtcaggaattcagataaagtacagcagggatggattgtctctgctcacaatgtttggggcttcaggtggaggagttgaagctgggatgctggatgatacatttccatggtggctcactcacttggttgggcgtgagggaggaaaaatgtagtgattagaagagactgaagaggtccagatgtggtggctcatgcctgtaatcacagcactttgggaggtcgaggcagatggatcacttgaggtcaagagttcaagaccagcctggccaacatggtgaaaccccgtctctagtaaaaatacaaaaattagccaggcgtggtggtgtgcacctgtagtcccagctactagggaggctgaggcgggagaatcacttgaatccaggagacaaaggttgacttgagctgagatctcgccactgcactccagcctgggtgacagagtgagactccacagtcaatttctcccataatcaaccaccttctccaggcagctgctggagctgctgccccaatgcatcacttcctggcacatagcaggctgcagggaccacctcatctgcctttgccacctctcttcccacttgttcagctgcccttgagcagactggatggccttccagaacaggacaaagcaggctggccacgtgtgcttttatgccctcctccccaacccgcccccccgacgccacacacacccctccatcctctgtctgacccaacactccccacaagatgcctagaatgtctttcccagggcggcctcccttaagggtatgtcttacttattttcatagctctgtacatatatgtaaggggtgtttcagaagggtttgtgggccagtcacagtggccctgtaatcctagcactttgggaggctgaagcaggtggatcacttgaacccaggaatttgagaaaatacaaaaaataccaaaaaattagccaggtggtggtggtgtgtgcctgtagtcccagcgactcgggagactgaggtgggaggattggttgagcccgggaggtcaagtctgcagtgggccatgatctcgccactgaattccagcctgggtgacagagtgagacccccctctcaaaaagaagtgtttgtggaatagaattgattttaaaacctttttaaaaaattgtaagggctaggtgccgtggctcacgtgtgtaatcccagcactttgggaagccgatgtgggcggatcactcgagcccaggagtttcagacaacatgacaaaatcccgtctctacaaaaaataagaaaattagccaggcatggtgatgcatgcctgtagtctcagctacttgggaggctgaggcgggaggattgcttgagcccaggaggtgaaggttgtagtgagccaagatcgtgccactgcactccagcctgggtgacagagtgagatgctgtctcaaagaaaaaaaaaaatgtatatagagatggggtcttgctatgtttcccaggctggttgtgaactcttgacctcaagcgatcctcctgcttcagcctcccaaagcactgggattataggcatgagccaccctgcctgaccaatagttcaaaatctttatggtccgcttaagtccgtagttcaccatattcccctgagttctctcaattcccaaagttgcaaagaggccagtggggattctgaaggtttctcctatcagcttctctggtgctcattctcccgctcccaagggccctggccttttcccaggattcattacatggtggccctttctcaccatgtggcatccttaaaagcatggggtttgaacattcagcctgagttttgcttgctatggattggtggaatggtagtgctgggagagaggaaacatttctgcttcctctgaaccctcttatgcgtgcgcgcgtgcacacacacacacacacacacacacaaccaggaaaccttctcttcccctagcccacgtctcctcccagtctgtgctcttgcacttccagagccagataaatggaggaaaaacacagctgcagatgtagccaccccaagagaaatcagaaagtgtggaagaaaaaaagaaggccgggcgcggtggctcacacctgtaatcccagcactttgggaggccgaggcgggcggatcacaaggtcaggagttccatatcagcctggacaatatggtgaaaccccgtctctactaaaaatacaaaaaacttagccgggcatggtgatgcatgcctgtaatcccagctactcgggaggctgaggcaggagaatcgcttgaacccgggaggcggaggttgcagtgagccgaggccgcaccattgcactccagtctgggtgacaagagtgaaactgtctcaaaaaaaaaaagtgtgcttaagtgactgctgtacccctactgactatacaccaccctcccctccatattgctctgttggagggtccctaagaccccttctcaatccttgttctcactccctgccactgcacacagagcttgatggcaagccgaatatggtatctccttgaaagtgagagaaacagttgcatttagaaggggaattcacctagcaggttaaggaaatggcccaaatggagatctctaatccccatgcctgtttttaagttgccatttgacccacagtggacatctctacaggaaggccagtaagtgcccgagactcccaggcctccgagctgccccagggcccaggaacgaggtcagatgtgataacggctctgatgtggccaaaagcttccatcatgctaagcagttccaaacagtcccgctcgtcaggcaggcccggggcagtggtgggtagcgacagtgtgatgctcggccttgcccccaaagcttaagcctttgatggcaaaagcacactcggctctgtactgagctgactgcctgaaaatattatagaaaacatctctcccttggcggggagagatctaagccccagtgaccggggagtttaaattttcgggatgggtgaccgaaggctgctaagaatatccagtcacaggcctgaccacaagccagttaacgccccgagtggcggcttccatggtccttggggcatgggaagaaggagccgactgggcagccagtacttgtggagtccctcagcaggaattgtgcagacacaaagtaaggagtaaaataacattaaagaaaaccaaccacctgatcgtgccctcaaggaataatctgagaagggaagacattgacctaccatggggtacttactgtgcgttaacagatcaaaacaaggacaaccatgcagaagggaacagtctccgagacaccaagtgccaacaagggaccccaggctggcttcccacagccagatggggtagttcttgtggcctggcagctggcagcctgacagaaagtcaggtaggcccagggtacacattctaccctctagccctcagtttcctcatctgcagagtgaggggtttgggagtcctgtttcgtcaacattttgggtgtctgaggccctctgggactctgatgcatgtacccctggcaaagtggacatgtgcacgagggccaccattttcacagcatttccaggggtgtccggccccaagtagaccagccccagatctcaagtgagggctctgaggtttttgtatagaggagagactgttcttggagggctggaagtggctgggaagagttcatggagaaagcaggatcgaagtttgggcagaaatgagatggctacaccttcattcaatgaatgccatgagcttcaacggtcagcaagcccaagggatggatgcgatgacaaagagaccagagaggatctggaatcgtgtgcagcaccgtttccagctggagagagagagcccattctgctccagccatgtgggctgtccttctcttcctcaggtggtccaaggttggtcctccttcagggcctgtgcacttgttgctcggctacctgaaactctctttcccccatactcatgcagctggttccttctcagctcaatttttcaaagaggcctcccaagccatcctggctaacactgccttccctcccactactctcagccacactgctctgtttcatcttctgtgtggcacatgtcatcatctaaagttaccttatttgctctgtttatggtccatctcccataggataaggaccttgtcagtcctgttctccacggtgccctggcacccaggacagtgcttggcacagagtaaacaactgccaaatttgcaatgaaccaaatgaagtaattatagccttaacgctagatggctgtgcactggggaggcctgtggcgtagaggaagggcagggtggtttgagagggtgaggctgagccactaaactggtctggatgactgtttggggaaggtatcttggaggaagtgctgtttgaacagagttgtgaatgactaagtgaagcgggtggagggatcgcaaatctaagccagctcccggtggcaacggctggatgtgggaaggggctggaaacagaagcccagagccaaggtctgaggggcagggcccagtagggtggctgagggcttccatctttatctcaatagtgaaagccactggagcaccctcgctctggctgcaggatcaacccccgccccccttttacctgtctgatcattcttcctcttttgcaatctggccaccctagaatcctggttgttccttaaacacagcaggcagtctcctaccacagggcctttgcactggctttgcctctgcctgcaaaactctcacctcagaaatcttggcttgctcccccggctccgttgagtctttgctcacatctcactttcccaagagacctcccctgagcaccttaatcctgcaaatccttctccccacaccctgccttccaggtgcttctttcctgctcccacttttctttccatggcatacatcactgtccaccatccatggtaattttgtgacctcttacctttattgcttatcgcccatctctctccttctggaatacaagtaccccgaggacaggtatttgttttgtttcctggggtgtgtcgggagcctggagcagcacctggcacccagcagcagtggttatttgcgggtgtggttgtggctggtggctgctgtgggggccatggactgcagaggggtaggagccagaggagggggcccagtgaggaggccattgccatggcgtaggtgagaagctgtgctaggcagtgcagggcgctggatgtgggggaaatggatggactcctaaaactgcgcagagaaaagaaaacggatttggtgaagggtcggtttggggagtgaagggattggagaggtcaagggtgattctcaggtttctggaatgtataaccaggtggttggtggggaccagggagaagaagcagttttaaggggaggaagagagaaggggcattcctgcagggaacatgcatgggccacaatggggaaaggctgtgtctgctccgggcatagcggaaaacccaatttaggctggagtggaagttcctgcagagaaggtgaggaagacagggtgggggcctaggcaacccgttaatgctgccaactccacgctttcactctggaagcctgggccatgcctagggctgccatgatgaagtgctgccaagcctccaatacggcacatctgcctggcgcatcactctcaccccgctcctccccccgccccaactgtggagcagtaagtttgcttctattcacgtgattttattaacaaaatttgcttccttgctgtctctagaagcagcacactgccctcccccaaccccccaacttggctcagagcaaccccacactcctgctatcaggtcatctgcccagagtgtgattgcagttttaaaactgattcctccctggtttattatttttttttagtttctattttttattttctggaagtacagcacacagacagaaaagtgtacaaatcctgagagtacagcttgatgaattttaacacacccatgtaaccagcttccagatcaacctgcagtgttcccagcccccaaggagtcccactgtgctccccatctccaaggataactccatcttgactcctcttcttttttttaatgagacagagtctcactctgtcacccaggctggagtgcagtgctgtgatcacagctcactgcggcctcagcctcctgagtagctgagactacagcacgcccaccacacccagcttatttttgtagtttgtgtagagatggggtttcaccatgttgcccaggcagggcttgaactcctgggctcaagcgatccacccacctctgcctcctaaagtgctgggattacaggagcaagccactgcacctggcccatcctgacttataacaactcagattaaaacctttgcccactttaaaacttgacataggcaaagcgccactgcactttagcctaggtgacagagtgagaccctgtccaccccccaccggcaccaccaccaaaaaaaaaaaaaaaaacaacacccaaactagatgtaaatggaatcctattgtgcatattcttttgaggctggcttcttttcatttgcaaggtgttgtgtgtgcttgcatcttaaaaaacagagtctcaggccaagggtgatggctcatgcctgtaatcccagcacttcgggaggccaaggtgggcagatcacctgagctgaggagtttgagaccagcctggccaacatggcaaaaccctgtctctactaaaaatacaaaaattagctgggcgtggtggcgcatgcctgtaatcccagctactcgggaggctgaggcaggagaatggcttcaacccaggaggcagagattgcagtgagccaagatcgcactactgcactctagcctgggcaacagagcgagcctccgtctcaacaacaacaaaaacagagtctcccaagcagcctcccacctgaggcaagggatcagggcccagtctcaggaggcccctgtagcctgtggaatactcagtagaggaactagggggtcagtggagactttgtgtggggcagaggacagcattggtgttttaagcaaatgacatgctaagcattgtgttagatgctgcctggatacaaaagtggaagatgcggttaagagggggtgaagggaagataagactggatctagagtcggccaggttgtaagaatgtcttgggctgggcacagtggctcacacctataattccagcactttgggaggccgagacgggtggatcacctgaggtcaggagttcgagaccagcctggataacatggcaaaaccccatctctactaaaaatacaaaaaaaaattagccaggtgcggcggtgggcgcctgtaatcccagctactcaggaggctgaggcaggagagtcacttgaacctgggaggcggaggttgcagtgagctgagatcgcgccactgcacaacagcctgggggataagagcaaaactctgtctcagaaaaaaataaataaaataaataaaagaatgtcttgaactgcaagaagaggaaagaaagtgaaagctcacacctgaggggaggacagaaaggtcagaagggttgtgactccccgcctcccaaaaagatcccctcagtgctacccttaaagtcactttcctgaaagggggggtccttgccttgggggaggagacaatttcagttctattatctcagtcatccagaaagacttctctgtgcctgtggtgtgttagagagaagacagatagggagggaggaaaaggggtggggggggtggagagagagagagagagagagaaagagtgcgagcatagtatacttcctgggaaactatctctcgaatagtagttctaggaagcctcatgccagagggcagtagtactggcctctgccttcttgatggtgcccttggacgtcagaaagaggaggaagcctcagggattggcagagacatttgagagtttcagaagctgaagtccagagagggtgagcgacttgcccaaggtcacacaccaagaaagcaagcattagaaaggggatcgagtgtcccctccatggtttttccatgatcgtgtaccaccctttcactttacaaagagcctagtgttgccaccaaaatagctgaattacctcatttttgaaaggcgttatgaattcacttctattatgtggaatggggcagagatgttgtgagcaggcatgacattataattcatattccacttcttctatttatctttgctgggttttgtgtatctttggaagcagccttaaatcattattggaacaaagtagggagaaaaataataatatgtaattacaaatgaggaatagaccgtatgatcctattaattgccttccctgcaatctttatttttggtattttcagaataattaacggcttaggtctcgattggtggaggtggtgggttagcactgaactctaaacagtaacatcacctactccaggaatggcccagtgcgatctgacacctgggacgctttcagggcaacaccaagggcaatgctccagtctgtatttactctcttctgaggagaaactctggcagcagctggaaaataaaacccaaagcaaggaagaagccgaaaagaagaaatactcaaatacgaggcgcattaatcatcggtgtcagatctagagcagaggacaatggctggtttgaagaaagactgaacctaaattatcttggaaactgatcttctctcctccgggttccctgtgcctgcaagcaggggtcccggtgcagccactggcatggaaccgatgggggcatccactggctgaccagcatgctttgtcacaggacaggttagagatgaccaccttctgtctgtggatcatccatagcttctgcttaggaagctacagaagagaaaaggcctctcacagggacctgcaggacaaattcattgcccatcgtgtcctcaggggacatcatttgcatgccaggatgcagtaaggccactgccttcagatccaaataaagcacccaattagcatgaacttgtgcaattggcagagtaatgaagctgaccacaggtgcctggaaagtccgaaatttagttgctagtgttgcaccgtgatggcaggggctgtgacggcatgaataagtctgggctttgggaatgggcagtgagcttccaggcaagcaggcaaattaattatcctctaagcctcagtttccccatctgaaatgggaataataatagtacctttattataggacagttttttttttttgagacagagtcttgcaccgttgcccaggctggagtgcagtggcgctatctcagctcactgcaagctctgcctcctggtttcacaccattctgctgcctcagcctcccgagtagctgggactacaggcgcccaccaccacacatggctaattttttgtatttttagtagagacggggtttcacggtgttagccaggatggtctcgatctcctgacctcgtgatccacccgcctcggcctcccaaagcactgggattacaggcgtgagccaccgcgcccagccatataggacagttttctatatgacatgagattattaatgtgtataaaatgtttagaactgtgcctggcagatagaaagcccttaataaattctagctattgttcttctaggagctgaagaacattagtgactctcttttcctcaaatcccaagagctcttctgcttcagaagagctgtgtgatgagttcttcccatgttatcccttcgtgaactaccttttcccatggtaaggacaagagtagtctttatggaagctcaaaacggggaaaagtgttgcccaggaatatgaaagggcaaggtagcttataatctcgccagacattgagccataatttagtattggtggaggtacaggtatttttcaaacagaatctatttgttctggggaggaagtccttcccttgaacatcttggccccacacttttttttttttttttgagacacagtcacactctgtcacccaggctggagtgcagtggtgcgatctcggctcactagagtttccgcctcctgggttcaagcgattcttgtgcttcagcctcctgaatagctgggatcacaggcgtgcaccaccacacccagctaatttttttatttttagtagaggcgaggtttacgccatgttggctaggctggtcttgaactcctgacctcaagcgatccgcctacttccacctcccaaagtgctgggattacaggcgtgagccaccgagcccaggccggccccacactttttcaaggcttacctggaaggaaggcaactcttcattcagatgatcaattcttaggttcccatggtgaacacaacagatgagctgaggcctgctgatcccagaaagaaagaaactccttttatgatacttactgcagttggcgagttgccaggatgggcccagaaggatgcaattgcagaagctatgtaggatctggtcccagaaatagttaaaggtttggggaaacagtgcatatgcatgacagacaaacaatataccctatgggaaagagcctaggtttggagtcaggtagaatccccgtagccacactctcctagattagccatgtgttttggcgcagtggctcacgcctgtaatcccagcactttgggaggccgaggtgggcagatcacaaggtcaagagattgagaccatcctggctaacacaatgaaaccccgtctctactaaaaatacaaaaaattagtcgggcgtggtggcaggtgactgtagtcccagctacatgagaggctgaggcaggagaatggcatgaacccgggaggtggagcgtgcagtgagccgagatctcaccactgcactccagcctgggcgacacagtgagactccaactcaaaaaaaaaaaaaaaaaaaaagtgaatggtaatacctaagccatagggttattttggggtgtgagtgagataacttggaaaagtacctgataaagtaactgaaatgaacaaaggtccttaataaacagtagctatttttatcacataggaattattcattgttaaaagacttgctttgctatcaaaaacagcgcagggacacagttactgttagaggtcaaatggcatggaattcagagaactccaattgcccagggtcagctgtgagaagaacctacacttctggtttcttagggtctcaaggagaaagacagtctcaatcttctgccactaagttaaggaccaaatgattggcaataggcaaagtactctaagaaggctctggtttgggttttgtcttccttttggctttctcatctcctggggatgatattctgcaggacttagttaaggacaggactcccaaggcctccccaccagcatgcacaccaggtcacttggctcctccagccgacagagacctgtacacaggtgtcccatactcccacgggcctccccaaaagacagtgtctcccccagccttatgcttcactttcctaatttcttctgccccaatcctcaccagaactacagagccactccccaccagtccaggtaccccctttcctatagcaccctctccacaactgtcttgttctcttgaacctggtttcttctctagccaggatatagaataccgattcagttagcaaaaatgtattaagtggctggctacagtggctcacgcactttgggaggctgaggtgggcagatcacctgaggtcaggagttcgagaccagcctggccaacatggtgaaaccctgtctctactaaaaacacaaaaagtagccaggcttggtggcacacacctgtaatcccagctactcaggagaccaaggcagcagaatcacttgaacccgggtggcagagattgcagtgagctgagatcgtgctgctgcattccagcctgggtaacagagtgagactctatctcaaaaaaaaaagaaagaaagaaagaaaaaaaaagtattaggcatgcaatacttcatttattgtttatcagatttttttttcatcaatatgtggtgagcaccatgctaggcactgggcacatacagccagaaacaaaattctgagaacattatggatatatgtacatcgctgcacactgatgcaagcttagcacctggtgatgatacactgtaccattatggacgatacggtcttgctgagggaggtgacctcccagggaccaacccgcagagcctattcaggagctgatagcaggcctgtgtggttggccttcagagggtgagctaaacactggcaagcaatgaagtggccttgttaaggcatttagattttgttctaagtgcagtgggaactagtggggtagtgacattcaacactttttttttttttttgagacatggtctccctctgtcacccaggctggagtgcaatggtgcaatcatggctcactgcagtctggaccttccagggttaagcaatcctcccacctcagcctcctgagtagctgggactacaggcgtgcaccaccacacttgactactctttttttttaagtggagatgaggtcttgatcctgtctcaaaataaataaataaataaataaataaataaataaataagatctttctagctgccacgttgcgggtggactggaggatagcaaaagtggcagcacagagattgctagaataatcatcctgtataataatccaggcccaagatggtggcctggcctcaggtggatgtaggaaaatgggaagaagtaggcttactagatagactatttggaagtagaatgggttagctttgccagtggactggaggaaggtgagggggagatgaatgaaaatgggtcaaaaatggccccctaggattctgctttaagcacctgagtgggtgagccattttctgtgatggggaagggagttaaagcaaagagcaggttctaaaggaaaagctcttctctatctaagagacatttgtcctgctcaccactgtttccctagcacccgctacaaggcctggcatttattaaatgcccccaaatatttgtaaattaattcctctttttagaattcagttgtggctgggcgcggtgctacacttgtaatcccagcactttaggaggcagaggcgggtggattacttgaggtcaggagttcgagacacatgccaacgaggcagtgtggcaaagtgattaggaccatggactctgaagataggactgcctggatttgaatcctagcaccaccattttctaggaatgttcagtaacttctctgatagtttcctcatctggaaaaaatgtacataataactctgcctaccttatagggcagttgtaaggattaatagttaatttatagaaagcactttgaagagagcttcaacctaacaggcgtgatgtaaatgcttgctattgttattaagctgagcgtagatgcaaagttgagataccaagtttgaagtttgatatggggatttggaactagaaaaaaaaaatgtaagtcatcaataagtaggtggtatttaaagccataaacctggatgagactggtggggaggaaggggaggatccaggcccaaggcaactggtagagcatagaaaagcccacaaagaaattgaaagcggttctcagctaggatgaaaaccctgtgagcaagcagctcaagggagcagtggtcatggtgtggtaaatgcttctgggaggccaaggaaggcaaggactgaaaaacaacgccgcccccccaccccggcccccactcctggcaacaaggaagtaaccagtgatcttgagcactttctgcagaatggccagggaggatggaggggttgaggagtgagataaatgaccatgtgtctatacagtgaaattccaccagcctggaaattgacaaggcctgtctccatgtgttgctagaaaagtaagatatattgataagtttcataggtgaggtacagaacagattgtgcagtgtgttcccatttctgaaagtagaccagaggacatgcatatctacagagaaactgggggggaagggggcactcccctgcagtgttggaaatctttaatgcacacacaaatatgtgtctatattcccccctattttgtttttacacaaactgtagcagatggtacacactgctctgtaccttatttttttttccttaactgtagaccttgggggtctttccatatcaatacacagagcagatcttctttattattttaacagctacagaatattccattgtatgcatgtgccatcaatgtcactgctgactctttaggttgtttataatcctatgctgttataaacaaagctgcacttattccagtgtcttaaaataacttcatgactagctgatttttagagtgaacatgaggtaagcctgcagaaattccacatggatggagacacctctttcaagaagtccaggtgtacagggaaacagataaatagggaaccagcaaaggagatgcgaggttaagaaggggcattataaagatgggtgatgcttcaagcaaagaagtataacaaggggcctttcaagaaagggtatggggggtgagggtggaggcagcaaggaaaagcctctaagaaggtgatattttagcaggtatgaaacgatgacttaaaacagtgtgagatcctatgttgggtgctgcgggaacatcaggatggatggacagacactggccttctggaaggttcaactccagcagggaagctgtgctgtttcacaaattggctgcaatattgttagaaagtggttgattctcggccgggcgtggtggctcacgcctgtaatcccagcactttgggaggccgtggctggtggatcacctgaggtcaggagtttgagaccagcctgaccaacatggtgaaaccccgtctctactagaaatacaaaaacattagctgggtgtagtggcgggagcctgtaattccagctacttgggaggctgaggcaggagaatcacttgaacccgggaggcggaggttgcagtgagccaagatcatgccattgcactccagcctgggcgacaagagtgagactccgtctcaaaaaaaaaaaaaaaaaaaaaaaaaaaaaaaaaaaaaaaaaaaaaaaaaaaaaaaaaaaagaaaaaggaaaaaagaaaaaaaagaaaagaaaagaaaatggttgattgtcttagaggtacaggatctacaaacttcccactgtggtccctgctggtgaagtgtgctcagagttccagaagttccctgagttcctgataagacaggaagctaggggagaggagaatattttgcctgaaatgttaagatttttttcccccatagggattcaatgacacgcatgccctggaaggtttcaaaaattggaaataaataaaaattccaagaagaatttatattcctgatggctatgctgatggtcttgtaaattgtatatttaatcaaagacactcaaatgtcttttttttaactattgaagagctatttaaatgtcaacataagtgattccctcccaaatagtgctgtttatacattacttcccctaatagaccataatgattcataaggaggcatttctcgcctctaaattgtaggcctattgaaatataaattaagatgataaataatttgaccttacctgagagtactaagtatttacatgtgtcaaatacgaaattaccctgaacatcatggtccctaaaaaggcagccttcctctcccgggtgaattcattaaatgaaacgggtttataaatttctcttagagtgtggaagagagagagaacacacaaaagaacgggcccggggacccggccgtccccgccctccagctttcccatgaggcccggggggccgcggaacccactccccggcggggagaggcgggtgcagaccgcccccgcgcgcttcccgcgctcccctctccccctccttctgcgacgccgcaggagtttcaaaacatggagtttccacaggaactttgccaggccgagctcgcagccctcccgggctcccgcagcgggattcgccgagtcggcggcgccgcgcggcctccccgccccccacgccctccggggagccgctgacccggcggcctcgggcagctccgcaaaaccgctcggtggctgtagaacctggggaggcgcgggggctccggggctccgcacccccgccgaccccgtccgggccccggagggtggcagcctggcgccctccgcggggccggcgccgagtccgtccgccggctctgttggcttggctccgccgcccggggccggggccgaggagcggaggtcgccggccatggcgagcgaggctgggtacctggccgcccgctctggagttttgttttgaagcccggcgtgggggaggggcagcacctcatcaaggagaaatttcctgttcgcaagcaagactccgcttgcagagtttctgtcctgcccttgacctgacaagtggatctcggctgcgcgggtccccgagagtcgagccagccgcgccaggagcgcgcgggggtgggggtgggggcacccgcgccgaggaccggggagcccggctgagcggggccgacgcctgccctcccggttcccgggcgcacccgggagcgcagagccgagcggtgactaatctgcggctccgggcctcttggcgcgcagcccgggttcgcctcccgccccctcgtctctcctcctccccgccgccctcccagcccagcagcgcagcgctccgccgagcgaatcgtgcgggccagggccgccgccgccgccgcgttcccgggagtgtgggaagcgggtcgaggcgggtggctcgggagccgtctccagtcggcctccttcgacccgggaccgaatgtgcatgtgttaccttccccttaagcactttgatcagcgttttctcctcgcagccgaggagccagagcgaaccggggcttttaaccccctgcgtgccggctccaccgtgggctgagggaagagggtgccgcagggagattggtcgatacagggtgcgatcagtttggtttagcaagcctgagccaggaggagcccggccggatccgaggagcttgcccaagcgcgggacgctctcctgtggagagcaggccgctgaggcccgaggcgactcgttaatgttcaagctctcccaggggcagcgctgtaacgcgacctgcctggccaggcaaggtgcgggcttgaaaggcccggcgggcggaggcttctggaggggcccgggaggccatggcgggacccgccttcacgcacccggttcgttggcgcgtgggtggctcctaaccccggtggaggctttgcgctcgcctcgcggactcggctctggccgccgctccctcccctggtccaggcctcgcttgggagttaatgattgatttactggctccgcgcggccggcgccctcccagctatttgtccaagctgaggagttgctggcgagcagcgcagtaggccaagagagcgggggtcgccggggaagggaagccacgctgccgacgggaaggagaggccactagattagctcccacttggcggctctagctgtgtcggggcaaaccctcaggaagccgggcccgggcgaagggagcattgggaagctccacatgtaaatgggttggcagctggcgattaggccgcccgattttatgagtcataatgggcctcccgcctggccctcaacctgctcgctgtggatccggcgcgcttggggcccaagtggtggaccattccggccgcgcagagggacatgcttctgggggcccaggccgccgaaggagttgagaaggactttctctcctttcttgtagaaggcaacacaaacaccctaaatcaaaccgctccgacaatcgaaggctccacacagacacatcaataaggatttcgcctcccgcgtatgaacgcacagaaacacttgtcctatttttatgcaaatgacaccacacaaatagatctcgcaggcccgggagaggggcgggaggaggaggggcgccgccaccccagccagggggctgtgagaggggaggggcgccaaacccgcaccccagggcccgcgccggctcgggcgcagcggggctggcactggtcaggaggcccgccccgcgggcagtggctccctgccagcgccgccaagtcggccgcgtccccaggctgcctgcagaggcggattagggaaggagcgaagcgagcctgtgactaatcgcggggcctcggaccggagcaccaaggccatgtgcgactgacaggaccgacactagcagaggacacggcgacgcctcgcttaattgcaggcttaaaaaattgccgcctgagcagctctggcgcggagagccacggcttgcgcgtcgagctagggagcgcgcgcgcttgggtgggggcgggggttcctgctctctcgctccaaggttggaacgtttggcgtctcctggaccgagggacctggcccttgcgtcccccactctgctgggtcgccccgccccgcgtgccgaccaagtgtggctgagcccgccaggagagtacgatccagcctccagggctaggtttctgacccgaccctttccccctaaatccgacgtttccccgctttcgccctagatcctatacgggagggggctgtgcagttgggggtgacagattccaacaaatccttaaaataaaaaccacacgcacgaaagaaacactttctcttccctccccttcttcaccgactgatacaaagccccgaatgaccaaagggaaagaggtaagtcggggctgcagggagcaaggtcatcgagtgccaaaacctcggggctcacagacacgcactctgagttcttcacccctggtcacagtctctgtggcccagaccttcctggagcactggggcctctcgggggcgaagggagaagcgtcgggaggccggcggctctgtgttggggagggggagtgggagggagcggagaacccagcgagagaagtttccaccacgctctggccggctactgccaaaatccccggacccctccccgcctgcaccgccttccgttgccaccacaagtttggtttaacgagagctcgggacaaaagcaaacgttttctatagaccccgaaaacaaaggggaaagagacgcgcggggccgcggagaagcggctgctagcgtaatggtgccaggccgaaagcagagcattaaaactgcaaaagccgcgcgggcgggaggaagtgcgaggcgggaggcgggagcgcggggagggcgggaggcgggagcgcgggcgggggaggggcgctgcgccatgtttccgtgtcacccgccgagtcgtcggcgctgggctcggccgccggctcccgcctgcctccgtaacagcagaaagcgtgcgattagcagccagacaggcggggactccgggcccgcggggccgccgcacacgccgcccgcggcccgagcccgcgccccccgcccgccgggtaatcatcctcctcgctgcagcgctgtgtgcactctcattagagtagggaggcttttctctgtgcactcgctcggctcccgctggcaaaacaacgccttcccgggccgggccctgggccaggagagtcggggagggtgggacggaggtggggggtgggtgaggcagggcaagccttgcaggtcagctccgccgccggatctcctccggacacggaggagacggggagcgtccattggcccttccctaggtggagtggcaaagtccgagccccgcagccgaccctacgtccctacgtggaggggggcgggtggagtaccggtgccgccatgacctactcccgtcccccgccggaggctagagtagggctgagggggagatgagtgtgtctggtttggagagcgggggcggacactgggaaggctcccaaaacaggttttgccccatctgttttatgaacgacctcttcaggccagaagccggatcccaggggtggcggcccttcgaccttcgaaaggagacccgggcccccagcaggccctctggcttcgcgctctgtcgcctgcagtgggtgggagatgggggtggccgaggcttggctgctcctggccctgagcttcggagccctattttctcctccgcgatctctgcacacaacagtaggcagcctctcacagcagcacgcgcccagctgcagggcctgggagcaggtgttcctgcccggccggagtggcggctccgcgcccctccggtcccagctgcggagctgcgagcggtgcgggggggcgtgcttatggtggtagcagagggacagggacatctcatcggaccgcaggaagggtcctctcggcttacaccgggataccgcagggcccgggtggtcgcctggggcgaggagggatcaggggtgacgcgcggccagccctcgtctggaacagccctggggccagcggaggccgctcggggcggcgcgagggcttccggtccccgtgactgcggcggcggcggcggggcggccgcgaggagcaccctcccctggctgctgccgccgcgcggctctcggaacggcgccccaggagcctctctgcgtctggcagcgccgctttcggcttgcgctgggatgggggccgcagggtggtctcggcccagcccccacggggaggggcggggaggcggggtccggagaccccgcgggaacggccgcgcgcctcccagcaccccctcctcgccgccgccgccgctgctgctgatatggcgggcacgtgaagcgcagcttggcgccccggcgccagccagggagcggcctgccccgccgactcagcttacccgcgggcccaggaacgcggaaccgagcctggccgggctccgcggagcccgcacctccgcccgcagctcgctgcggccccgcaccctctccccgcctgagcccggccttggggccgcgccaggcggctcgcccgaggggaactcgggctgactaatgggacgcgtgtgggccttacgtgaggcccggctgtcagcggatacccgcttgctcggagcttagaccgcggccaagcttttcggggaagggcgagaggaggggtttccccgctgggcggtttcagctccccagggacaatccgtccgcggcaggccccaacctttggatcttgcagcctggcttggagacggtagacttggcatgtgccggacgccacggtgccgacccggtcgggggcagggggtgggagcctcggggttgtgagctgggggtgggcagaggctaggtcagcttggtctggggcgcccgccttgaggtttgcattctggggctagccactgggccggggggaatttgcagggcgctctgaggtcgtggagtctgataccaaaaccttcctcgacaaagtcttccggaaaccccttcgcgaaattcctgtgcggaaagaaggatttctaaaactccccgagggtccggttcggctgggagctttcgggttctagggagtgtgatttcctttctctccctttataggggcctataaatatcagaagagtttcttcttatttcgcattaacaaccacttcatgttgacatagttatatgaccctcccaagtataactacctgtttagtttgaaggcactgagtgcgatggcgaaacacaaacatcgaccagtaactaagagaaggaaaacccagccgcgagcttgggttggatacaggataaatcctcatcacgcatccctggttttattcagcctaattgcactagtaatcctgccccccgcgagaaagcctgaaatcctgcagtcgaggtgcgacttttcctggggagccccgccaatggggggtgggttgtcagtggaggggaggtgggttttaaatgtcacttccaaatgaaaatctttctttcttttctttttctctttttcttttttgatccagttttcgaaaagagcatttttgcgagataagaagtgaccgatcaaaatcgctaaggggaggttgtaagcagccgctttgccccagcttagcgttatcttatctctcacacttgcatggcggaaaaaaaaattggcttatctttatccccacccccttctcgccttaattgctaaaaaacactagtgtgttaaaccgggaggaaggaggtctctggagtgtcagtggaaaaggaagattcaaaaatgtgggctcccgggggaagcaagggtggcagaatttattctttcccccaggcctttctggtacaacacagggtgtagtccagggtggaaggctgggtggctctttttttaaattattattttaagaacaaaatctgggcttggccttgggtcgtgtggcttccccaggcctcgctttctgaacttctcccctccttcatctctcaaaagctgctggtgggtctgggttgaggcctctcactctgccttcatcctccctcctctagacacatcctccttttggggagggggggatgcaaggctaggacacatagcctgctggaaatcattaaaatatatgcgagtgtctgcaaacacacacttttaaatcatggcgtttcccctccacgctggtctatttaaactccagagcgagctggatctcctccctctcagtcgtttgtctgtgtcaccgacaggccgctaatggccgggcttccaggcgctgtgcattatgcattagcctcctccctccgccgcacacagaaggttctgtcaggccgcaccacacaaaccaccctgagcccccccaccccaccccccgcactcagggccgggggctgcgcggctgctaacgcgctgggaacgcaggtatggagaggaggatgagcaccgagagcagagtggttcggaaggtggaatgggagcgggtgaaatgtgccgaagattacaccgtttggaatgcccagtccgttgtgagccccaaagctttgctcctggctgcgaccttctcgaggcaaccatcccgcgccactcacctctgtgaccgactttgttgggggcgggagggcagaggtatttagagacagatcagcaccgctttcccttctgctggtccgtacccaccttcctgctgcaggcgaggggctggcagagccttctctacccctccagttcgggagtggtaccgcgaaggggttcggggtggtgcgtcttcgcagggacccggtgggagtggaggagggaagctggatacaaaatggctggggccggaggccggcacactgggtccgaaggcgagtagttggtggttccccgccccctctcccggcggttcccactcactgcccccagccgggtaaaatatgcgcagaaggcgccttgctaaataagcagccgaggcgggacgtggcgtccgggtttatctgcaggagcacccggcccagcgcggcggcgtcgagggctcttaagcccttgccgagcgcaagaggcggccagcctcccagaagcctcctgtattatgcccatttggtcgacacccaaccaccctgcgggcccccgtagtgtagatgccagttcacccacacgtgcctgtgttcggggagctcagggcctgacccaaatcgagcccagaccagaaattccaagatggttgctaggaaccacggagaggctgcccttagggccttccttccccaaacacccaataaccctccaaaggctaggaagaagaaagaacagtcatgttcagcctggcgacccttaagtccagcagtcttctgccctgggaggcagctacctttagatgtttccagatgagtgaaatcctgggaggaggatgcgcctcctgtttgttacctcgtttgagtttcagaggggaagccagctgtgccttgtgcttggaggatggggcagcggatgttttttaaagtgccattggataagcccagagttcttgtacaaagtgaccagaagactataagtgtgggtgtgtttttaaagaaaggctacctcacattatgtaaaaatacattatctgtactcatccgagtcccacctgttccagtaccaagtgtcatcgccctgagaacagcctccgaggaggaccatcggaagcctacacatacgttataagctttatgatgtggatcctagtatacgttataaataaatcttgcacacaaggttagaaggccagggtccccccaaacacaggatgcctggcctttcccctaggccagggtggagctggaggtgtgtgggagaggccctagcgggtcttgcagagtcaacctgccttgagaagggcagccaggctcaaggcctgctcctagaagggccagctcgattgcccagttgcagggcctggttagcctgaggtcgagtggtttgttataatcaggagacacttccatgggaagggagattggtggcggaggggcagcccccgctgctccatccgcagcacctctcatttcggcacctatttctttatttctccgtgggctgcacggcctcccctcccatgcactcctttgctcactctctcctcctcctctgttttcattgaaatcctccccttgctgagtgctgggtatagcagcctgacccccgggtcagctcccgaagggcttgtgggagggcaggagaggagggggcaggagaagggccaaaccgccggcacccattgcaggccccgcggcatccccagctccctgagccccttcttaagtgaggacacaagatgggattgcccttcgacagctttctgcttgttttccccagaacaattggaactaaccgggccaataggtgtaatctcccctccccccctctgccttatagcgcctcgggaaaatcccacattttaattcccagtgagtcacgaatcccccccaccactcatgcctcttaggactcccttaataagatatttttgaaatcccacggagttgaaaaatgtatccctaggagatggaggagaaaccctttaatcctaccagcctaccgtggaggcaagatccctagaaaaggtgggggaggatgttgcaaattacgtcaaaggcgaatttactggcctgtttgtctccagcatcaaatttctcccccagtcagccctcccctcggccccttcgcatttacagcacccccaccacccctgttcattttaactctaggacttttttttttctttttcttttctttttttttttttgagacggagtttcgctcttgttgcccaggctggagtgcaacggcgcgatctcggctcaccgcaacctccgcctcccgggttcaagcgattctcctggctcagcctcccgaattctaggacttttaaagttagacaaacaggcctctttgtcagcagccccgggaggccgtaagactctgagaggctgcaggccccgagctcggttcctggattttctaaaagttctggacgtttacatgcgacttcgaactccgagaaaagcctgtgcctgggggcagagttggggagacgaggggaggggatagaaggtggctgggcgccgggccagggcctctgcggttcggcctaaccgagccggaagagcctggcacggctccacactggcccaggccagttctcccgtccagcctgcagcagcagagcggcctcctcgcctggaaccacgttcagagtttccccacaaatacccagcttcagccttcccggttatttttgacttgttttgaataaaaggagtcgcttcaaaaagaaatgttgccacaacacacaaccagaggccttttctccagctgtgtctgtaactcgcatgcgttcaatctaataacttttaatgtctggtcctaaaatgtctttataaaaaatagttttacagcataatagtccaggtgtctttctgcttgttaccggagattaaaaaaatgtgtgggttggcttgcagagatatccacccccagaaagaccaggaagaaaaaagcgtgcattccattctgcaggcgctggtcctggaagcgttcgcggcccagcctggctgggcactgctcgcgggggcacttgctcgcctgtcttttgcatcagttgttataagcagctctggagcatgaagatttaattctgccgaagtttcgggtttcaaacggtagagatgtttcacttctgctttgagaagggctgtttttataactatgtgctgagaactaaaacagaatgaataaaatcgcacctaataccagtcccacagtcagtagtgagtctaatttttaaaagggaaaatatctgctagctagagctgattttggccttgaccttgacttagtaatcaacttgagatgcttttgattatttttggcatggggacactccaggatattttaaaaactttccgtgtggatttacaagccacctccatttcagatttatgtttcatggagcctgcaccatcttgtccttaggcagaaagagacaccccacccccttcccagtataaaaagaccctagtgggcagccgaatggggtcaccattggccgcgaagtccgggcccgcagtctgggcgcggttagtccggaataccccctcccccactcctaccccttcccgccagcttcaccaactagggcttctcggctcgcccttgaggctttgcgctccggggaggccggaacctcgcttctccgcttccccctccctcccgcctgcccccgccctccccccgcgcccagagccgcgccgggtgcgctggagaagctcaatacgtgtcaattgaattgaactgctgcgggcgcaggctgtacgccgccgccaagcaccgatcagcacgacgttaccgagtggaaatttatggggcgaacggtgtaagccaaaagttgctccctgtcaaggaaaataaaacgcgggagataatctcccaacgccggggcgaggggcctgggcagcccctccaaccatcagaggtacagaccgtgaaaatgctcgagaaccgggagaaatacaggcggatctccgctcgccgaccgccccccacacgcctcccggtgcctccacgggctgctccccccttcccccacctccaaacaattcccacacaattgaaacgtccggggaactcgggcgcggagttcaggcggaacggccaccgttgcctggggtggtgttttcaggtagcttttaacaccgaaatgggaaagggctcctctgggaggaaggggcaaactggggtgggggtgagcacgggagcacacaggccacgctccgctgggtctcggaggggacgaggccgggagagcgcagcgctggtggcaagaggcggcggcagcggctgctgccgctggggtttgacagctttggctgagcggagtgcgaggcgctttatggtaattgcggtcctccactggccttctgggtagcgaggggagtctcggcgcgcggctgggagagccgcccccgccgcccccatcccttcggctctggctctgccggcagccctcgccgccgccgccgcccaagtcggtctccggctcgcccaggacgtgcgcccgggtcgggcgtgcgcagccaactcggcccgagctggggaggggaggccgggggacgaggagggggggcgccacccaagtggtccggggttcggatccagagaggccaaaacgtgccgggccgtgcatcgatgacggccggggaaactcgggcaaacctttcctggggaatcacccctcccgaaaccccgccgcggaggcgccgcagcggagggtgagcggagactggcggagctcaaacttgcgagagctggaggcggcggcgggcgggcggctgtcgcccgagcgctgcgcctgcggggggaggggaggcggctgttgggagggagggaggtagggcgggcgggagggaggacgggcggagggagggggaggaggaagaggagggaaccagggaggggggacgcgttgggatcgcggcgtgcggcggcagacggagcctgggctcccagcggcaaggtgaggcagagctgcgctcctcgctgaacgcgggccgagctcggcggctgcgggggagacgcgcaggagcccagaccgcgaccgagagcgggagctaggcgggcggcggcggcggagggggagcccgcgagccgccgggcggagagcccaagccgcgctgtcgccgcgcagggacgacttggccaacactcacacacactcacacacacccagcccgagcgggcgctcgcggcgaaccgtcaacatggcgctggggctcctgcccgagcgcgggcggcggcggcagcgcgggagctgctgagctcggccaagcccagtccagctgcgggagcccggaggatcgcacggggctgtcgccacctgcccggaggccccgagcccgccccgccccgcccccacccggcccagagcccacccctcggcggggccgaccccgagggcagccggctgccagcagacggcgagggagtcgagtgagcgcggcgccgcgagcgggctgcgggcagccggggaccgcaaactttgctgctcgccgcgcttctccggcccggctccttctccgctcgttaacgtcgccaaccccccccacccctcatatctctctccacccacccaaccgccccccgctccttctcgccgcctcgagtccgcttgggggaaaacttcaaagagccggatcgcaggctccctgcctactcccccaccggggatttcaggtcagtgcccggaacacctttcccccgggagaccgcggacgggtgggcgggcgggcgcgctgagggctgcagtcggccccctctcccggggccccctcccgcagcgtaccccgcgaagcttttgcctcgcgcttccctttggctgcttggctcgctttcgtttttatttcatagctatgttatttaaaatgcagccaacctaagcggccccgcgtgggcaccagggagggagggggcgcggctgggggcctggcgcctcccggtgggccaggaggagagcagggagttcgcagagtggaagtttgcagcctgtgtgtgtctgtgcgcgggagcgcggtcgccgctgagcgccgcgagtcgggcggaggggggggaggtgggctggaagctgggaagctgggttcggcgttagctcgcgagcaggaaggggagggcagcgggttgccgtctgctttctttttcgactcgggaaagaactgtaaaaacccccagccgccgccaccgccgcctcgtctcgcctctccgggggccggtcgttcctccaagtggaacgtcggcgtgtgcgtgcgcgagggtgtgtggcgagtgcctcgggccgagccgagctcgacctgccgccgctgccgcgcaactcgggaggggagtcccgttttttcttggcttgccccaaagcacgaatcacgtggattaaaaaaaaaaactactaagaaatcgagcagagcaaggggttccgacttggcccgcccgccagccaggtcagacgctttgttttgtaaatgttcttttaagattataatctgcgatccccctcccgctttccccctcctctccctccccgatgttcagcgtaggttttaagttatgagcccccaggggtgggtgtagaatgtgcttgtgcgggggcagcgtcgtggagggagggcgggggcgggcgagacctgggccctccgctgggcaatggggagtctggtgggtagccctgatgggcgtgtgaaagtctgcggccggaggaagttggtcccactcggagggcgtgtggcaaggaggctgtaggcgaagaggaacttgcgcaccggggcaagatcctcggccaaggcggggagggcgaggcgccgcggggcccgcgctcggagccggcgggcggctgcgccgcagagcctccgccaactcgggggctcgcggcggcggtgacgagcgcctgctgtttacggagagagccttggggcaccgtgtgtggagtagggcggccgaagtcacgcgtggtcccggcgggcttcccgccgctcgcacgctcgagtgggcccttcccggggtcccggagacggacgagtctggcagcgtgtaggccgtggccgggcgaggcgtaatttgctgttaatgaatcttttccagaaagtccgcgatctccagctagaggctgtgagtgcccgcgcgccagggcgcgcgccgccggcgtctggagggtgggggtggggggaatggaagagcgaagaaggaaggaggagggttatgtgtatttagaaacaaaccttaaaaagaaaccaacgcgcttcaaataggtattcgcacagcctcgctgcgtctagactagacagctcggggttttagctgtgttttcccccccttttttcgttttgagaagacgctagaggaggggtagtgtggtatttggttctaggggtagtcttttggagaaagatccttaaaatggcctgggagtaaagactaggaggaaatggcccaccccagaaggtggtgggtggtgagtgcagacagacttgggtatttctggccatctgacacttcctgtggcactggaaacggacaccgcgggccgaaatcaatccttacgaagtgttgggttcggttttgccaacagaattgcttgcgtggaaggcattttaattgtcagcctcaaagattcctgtacgtggacacttagggaatacgctcgttccttgaccctgcccactcctctctcgacctgttatctggtgtgggttttgcagtgttggttttcgtgtttattttgggcagggtttcagcgcgtagagcggagtggggggggaaggcgatgattaatatgccatccaggtttaatccgaggctggccttcagtgtgcgggtatacaccgccacgcacaccaattgccttggggtgtttaggggagcgcgcgggttttgggcagcaggcgcccggccggcaagtcgcggctggggctcggctggccccagcgctgtcctttgaggcgctgtcaccagtaggtgactgagagttaattaggaagtgttctccggatcaatgggctgcacagctcattagcgattctctccagccctttgcagggccgtcctggcctccgcctcccacacaggccggggcctcgctgtccaggctgcggggagcgccgctgggaagtggggaggggccggtagcgagggacggcggggaagcgagtgtaacttcgcggggcggcgcgttgcgtgcggcgcctcgaggcccgcgcagcccgctctttcttcctgcccgcggtcgcctccactgtgtctttaactcgctcccgctcgcgtcgctgcctggctgctcctccccgcctcccgcgcctatctcttgttctctaagcacgacgcctgtgctccccgcccagtttaggattagacaagataaaaataggactgcccagcgcgcggagctgtgactgtgccccggcagccgggctggtgggagcgcggggggccggagctggagaggacccgtggtgcgctcggagcggccagtgcctgtgggccccctacccccaccccgcaggcaccgtcacgctccccgggttctgtccgccgtgaaccgtgcgggccgggggacctgggcagggtctccgcgctctcgcgggtgttgttggtgtgccggtgatagatcggtctagacaggcatgcaggctccctcccggctgaaggactggaggggggggaggcgcggagatggcagcagactctgtgagctgcgagtgagcgagctagcctccgggcccagcgagctgggtggagggaaggccgtgggggtttctcttaaccctttaaaggccgtggtggggtagtgtaatagggaaaggggggcaaagagcctagtggaaattcctggaggcagagtagctcgcagtggggaggagctgtgagtctgggcctagggttttcctttctcttatgtgtgcacggtcacatcttggtgcatcgggctcgattcttccacaaaccaaacgcagctgctagatgatctagtttgaccaggtatttctcagtcggggagctgtgaacacacacaatgaacaccctcactttaaaaactgagtttggaagacagacgtagactcaatgttcccaaagagaattcatgcgggtgttcaaggacgggaaggtctgcacatagctgtagtcgggtggggcctctgactatgactgctgcagaccaaggacctgagcctgaaatgccccgccagcatgtacaggtatgcactgaagagagcaaagcggtctttgagttgtctctatataaatagacatacttttaaccaggaacttgtgaggagttagatatgtgcaaggagacagcctccaaagaggagctggacactgatgtgttgtgagatccatcgtttgtgtgtgtatatatatggctaatattaaattggtctaaaattttaatacacctctgcagacatttatctagttctttcttcagcttgaaatgggcggatgggttaccctatacataaataactcattactaacattccagtctcctcctccctcctcttcctttctttaagagtttgtgatcttaagggatcctctgtttacatttaaactgcaaacccatattggtctggcctgggaaagagccacattataggcaaagcaaaaagaatggaagtagtacgaatgctcagattaagatgtgcgcttgaatgacatgtgctgagacaaatcaagacacttgggctccgttgcccaaatggaacaagagatacataagagataaagaactggccaaggggaatgtaaacatgggtatgcaaatacagagatgtatagcgatattctgagagaaaaatcccagactttgttgagctggaaactggggcagaatttctgtaagtgcgttccagagacaatagcccatttaaaggtgtgaagagggtcacttggaaacacaaaaagcattcatatgcatacatccatgcttagatacacaggctgaatgacaaacactcctcaatgcctgacgaagactttcctgccgagtgagtgagaccgacttgggtacagaagagtgggccacacaaccacattcacacacttattcacagggaaataatgtgtctttggcttgaaggaaactgagggccacgctagcagcctaaaggatggatggtgtgcagtgaactaggattatctctggttatagtttctttcccttctaggggtgaggtggagtgggcagcgggttggtgacgagcaggtaggagcctttctgaagagattttgagttcctgaccttgagtggctggatcgtgtagccacaagaggggtagctttccactttgtggtcagtaggaatggctgttgcactgctggggtccaatttgctaaggtggagcagggcctcagtgggctgggaaggagaacaggaagaagtgcggcctctgggaggaataaaagggaggtatgctttctttcttttcttttttttttttcctctggaggagaccgtggcggggacagcctgtgttgggtggattagcaggcgcctcggtgaccccagacgcgcacgtaaactccggctagggtatggcttgcccgcggcgtcgatttgctgcggtccctctttgtctaagcccagccgggaattccagcttttattgggaagaccgcacttgggtggggcccgcgccgggcggagtggggcagggtccggtcgcgctgggcgggaggcttggagcccgcaggacgttccccggagctgcgggcagccctggcaatgccaccccggtggtttcctcgaggacaccgggcccggcggacccggagaggcgcggcggggcggggaacttcctgggtccatctcggccgccccgccccacccttctccctccggcccgaggccgaaaggagctcacaaggccctttgttaggccccgaggtcacactcgtgccccgggggccgccgatgggtgggagaaagcagtgctgcgggtcaagaggagcctccttattgcctcggtgccccagcccatcttctggatcgggcccggtgggggcctcgcccaaagctgggtggggaggcctgggccggccctgacccgccccggcttctttgccagtgtttatggccgacgggattccgtctgtttgcaaaaccggacgcgctgctgaggcctaggtggtagagccaggagaagccgccggggcgggagtaaatggtctccccccagccgccctggtggtagccgagccgcgttcgtcgcgcgcacttggccgggggcgtccactggtctccagccctgcccgacggctttctctggttgccctcaacgtgttcatcaggaagggatatcttactttttgttgggtggagttcattaacgatgcctttctgcgatatttctgtagaaggctcccttttggggcgcaagctcacctccatgtgtttacaatcgagggtctcagaaacgggggtcctcactccgtcattgttttagagctgtgtctcccacagccggcacccacgggctcggctctccatgattagagaagcggggaagtccactcggagaagatcctgacagcataaaaaataatttgtgatctaaaagacagtttccagtataatctcattatgcaccacagactcccgatgttattttgtggaaggcggacaatgatcaatttacattgacccggggctgggcgagcttttagatggtaattgccatattgatttgcatgcaaaaaggagacctgctaaaattaaagaccggaagctaaattaaactaaatttattgtctaggtgcaaaccaggggaactgttgggggatgggattgactcaggtcagggtgccaggggcagagcaggtgagaagccctggagcttcggaaggtcacaacttgggaagcgatctttgcccttgtgatttcatgtggggagggggaatgtgtttaaggaaaaaagttataaaaagacaattttgcattgaagtcactaggatctttcaatgctaataggaacttagagggagaggagaggtttatagggttataggggtcttccagcaccatttccggcgtcccccctccatttctattgttctgcctggccagacgctcgcagtcgtgctagggacaccaaaaacctcttgcatttgaagagttaaaaaataaataaaagcagcccgtcccccccttcccgccttgctctctctcccctcccccttcccggagcattagacttttcggagagagcgcaccgcgggcaggccaggaccgttggcgctgtagggagttcctccccggacgctgcggtcccaggcttggctggacggcgatcgcttcgggaagccgccctctccaggtggccacagtaggcgggggtggggtggggtggagcaaggcgtctgccctggccgccgtctagcggtgcccgggacttggggggaatcgcctccccggaggggttaggagggccagccccgccccgccccgcccctccccgaactgggtgggggccggggaggactggaaaccctgcccgttcgccaaggccggaaagtttaaaaaagagaaagaacgccacttgcagagggctggcctgcagccaggggtggccggcctgcgggggcgtgctcggctggctagcggggtgagcgccccggcgccgccgtctcccctccgtccctcccgccgccgaggcccctgcacactcggtcgcactgcggagccatttcgcacatccggagcttcagcgtctggaggagtaaccagtccagggccgggaagcccgagtgtccggtacccctgcctgtacccatcgagccgagccggaggtggctttggcaggctctgcgggtgtaggtagttcccggaacatctgaaagcctggggcagacccggaaattggggatagggtggggaggggatgttgggccctgaggtttgctgccggccgcttctgtaaagaaacgttggggaaaggacaagatagcctatcccccggcttgcgcttttgtgggggactctgggtggcccaatagaacatcttgctggcgtcttccatcttaattccctctcccacactactttgttccctggggtttttcctttaaatcctaggaaaggtagatggaggagctccctccaaagggcttttgctctatctagataatttgatttattgctttatgtggcgaaactggggtggcaagcctagctcctagtaccagtagtcagcacttttcccagagacctgaaaggagtcgacccaccttacccctgactattctggggtactggaggaagggaaaggggaggcttgttgagagcattggccttacaccagggtataacagtgtagggagatttgtaggatgtagggggaaatggtgaaagactttgagtggaccaggagatgacttagatacaggagaaactgggttcacggctcactgtagaccaagtaacataggtgttaaacactctttgcctcgttcttgggtacataaggcctaaggaagcttttcagaggagacagtatgtgaaaatcaggatttcaaatggcacaattagaccaataattggctcctctccgcaactccaggactgagtttgaccgtggcccattttttactagctgtgtgaccttgggggcaagttatttatggcctttgagccccagtaagttttttcatttgtaagactgggaataattatccacctttaggatctaaatagaatgcttggcacatagtaggccccaaggatgaataattgctttgaatgacttgtcatgttcctataggttgctcctccattccctgctgcccctgagaccccctgagacttgctaggcctgtgtcctgggacccaaggatgcagattaaatctcccctacgagggtattctaggtccaccttcctgggttcccctttccctttgttaccgtagtttgcattctgccttttaaaggattccatatgaaaagacttgcttctcccctccacccccaagtgggatcattatatggttaggaactcatttcagaaccgtcatctaggtacccttcggcaaggcttcctggcattatttcaggggggaaccacggtgcctagaggggcaagacctggttggaagaggtgagagggggtggcctggtgcagaggccagaggtgctgtggtttgtttgatagggattaagtccggatgttatgagggctcaatgtggttttcaataaagtctgccagggattgcttcttttatatcaatatgtatttaaaaaaattactagcatgagaagaaaaccagacctgtatggatccaggctggtagtaagctactgtgatcaggtttcctactcgactcccagaggggaagtcagtgtttgattgaagctacacttggttcttgactctcaggggatgcctgctctgaaacaggagccctccctccctttctctcctcctctccccctcctcctccctctttttcccttcttcccctaaaagcctttgtgctgaaagagcttcagtaggcacgaatccctggtccctctctaaagaatgccttacagcctttgctgacattgttttgtgaacagtgggttttaccaggccagcagtttccccccgattttagcgcacgattttaaaggtagtgtatggacaagatgcgccttactgcagtgattgcctcagtgtgtagcctgggctggggcttggaatctagagacgccttaacctttgccctaggggccctcctggagtggggggtgaaggtggggagctcgaggactgattgttttcgaggatctgtttgttttgtccagccaccgaggctgaaggtggagttgggcaagtctgagtgtatgttccagctttgggtctgattttaaacttggtttaattggagaaactcctaggcatttaacagttctgtacaaatgcaaacttgaaatagctcgaggcctacgtcatttaggaaagaataaatgaagtacagaaatgtccaaactatgtaaatcctagcgttgtctgccctcccataaacacatgacaagtgccaaggcatttccagtcaaaacacccatggaagcagcagcctccatcctttgtatttattattttattaacagcattttacacagcatttaacaagcacagcgtgcctgctttgcaccaggactctaagcaggcgaaagggtggaaaatggatggaggtgggggaggagtggttgctagaggacatcaactagagaaatctcatcagatgggtagggaaagcagcaccgggggtttatttctactggccacaaggaagacagacatagtgctttggaggaagaaatcctctctcccatcccaggaggaaagttgtacagctgtgatatgtctggtctcagctttgattccagagggtaaaacagggtatgtttcatgatactctgcccatcggttattggtgattttcaaagaataagtatttgtctgctatcgttattctatatcctggtggaaagtttataacgaaaagtaatgcctttcttaagtcataaaatgagccttgtatgcttatttaattaaaatctatttaaggaccgattaggcgtgtaatttgcactaataatgacgattatggaaatgttcaacttaaccaaaaatcataaaggagacattttgatcagtggggcggccagtaagtatttagtgagttgggcaatttccgaaagacaggaggcattccgctgagggctgcagaaagcacagacctgtctggcctctgtgacatggcatggagaggggcagacctccctgtcccggccccggccccagcccggccagaccccactttgctgagcatggaaaccaaccctgcgagtctccacaacctttattctcgtgatgcttcctcgagcttccagaaggagtaaactctcggagagggctgatgagccacacggaaatctctgcgaaatggcggtgctcttttgctttaacaaacagcgctgacaaacgcatgcttccttggctagccttggctggatcccggaggggtagggggagaaggggtcccttgttccggagaaacctgccagctgctgggcttggtgtgaaggcagcaaaggcagacacaatgctgctgttgttggtttgatctctaactgtggattgttagtctggctttaactatgtggtaaggggggaatgtgaaggctgtttacagcgagtgcaaataatgtgacagctgttggcgcgcgagcagcgctgcgcctcctcagcacttacacaaagcgcgcactatgcaggcccatggacgagctgcagaggtggcggccagtttctggccagcgcatccccagatgagagaaagctccacggcacacccgccctccatccccaacacacatctttatgacttcccaggattggggtggggtgcaggatggtttgtatgttgtggtttagggaacttgtggtgaggcagaggtggcgggagaaggcccacggggccgtgagtgtcaccgtgttggtggggtttggccaggatccgttgaactgggtcctcagctgtttatggctgagtttttaagatttgtgaaaataactttcagccctaagtaagcttgttggaaagaatgtgttattaactgaaagctttctggaaattgcagaggctctgaaggccgttgttcccctctgaaatggccctgttattcagacaagttagagacaggcgggtgctgtgttctgtgcactcgacactgtttccagcttggaaatgcaagtgtgcaggttcagtaccctaaggggggtgtattttggggggaagggaggacagattggcttttgattacccacatcccttaaccttttcttccaagccttcccgttttcaagagcacatttgccttcaactgcagcacgcaaaggtgccgtcctgaagcctgcccacagcaccacctactctgacttcatcaactagatgcccacagcaacaggctttctttgagttcctggtaccccgccaggccctgcagagaggcgccagggtgggagggagagcagttggtggtggcagttacccactaggccagtcctggaggttcatggctggcccaagcaggtggacttaggatggccaagaatgtggacctgcctctggaccgtcctggggcaagctgggtgtaaaaattcactcctctcccccatgagtcccaaggttgaagccttccaagccctggcacctgcctggtcctccttgggttttggaagatcatttagggctgactttggtctctgggtgtacagcctacaggatatctgcaaatctacttcattctctcctgtcccccccaccctcagcacctcccctccctaagtctactctctaagttttaacatggacttctacatctagttgggtttccgatggggagctgggagatgcttctggagtgagacatgaacttcggtgccagttctataaattggtctctttttatgacgtgtgccattttctgtaggaatgttgcttgcaaaacgagtttcgccttggaggaaaggcggaaagataaacaagcctgcaacgccaaaacactggcagtctttccctccttccagctctcttaaagcagccgggctgtatttccaggattagacttgtgcatgtgaggagggactcgcgttggctttttttcccccaagcaaatgcaaattagagaaaaataattttctttcaacgatatgcaatgtattagtcacttgttatcgtgctccgaggcaggcctcatttgcgcgtctgccagctcgctcacatctgctcagcgctgttcggggcattttaaccttggcggtgtcgtgtctagtcccatggatcaaggaggagtaattaagccctgaacagctacaaaaattcgtgggcccccatctataccatagttgttccatggctttgttttgggtgctctgagttccatgactgagtagcagacatgggattcctattgttccttgtaaagaaggtgggtgcccctctccttctctgaccctcatcccagcctttctgggactcccaggctctgcacaatcagtgagagactcgcttgcagattgcaggacccctgcattttacacatcttttatgcattaaaagttcctttgtgcttcctgtgtatactaatgatagctgttgttattagccttacggtatagcttgttcccttcggtggtggtggtggtgggggggggtggcggcgacggcgtttgtgttttactcctacaaagccctggtggaaacaaaagtgcattgacacagcctttggaggcatggtgtggaacatttattctggatttgcccccaggttgtgtagattcccaagtggggacccagttctgcagggactagatcaaagggggcaagtggtttctttttgcgtggagggaagatagtaaggagggattcctggcttttgacttgggtttctgttgccgggtggcctcctgtgaagggacacctgtttctaaatttgccctctcttgaatacacacgtggtttcctgactccccgtgtggcaaaaccatgaaggaaagtgaaaagaacaaaaagccggtggggtggcctggacagattatccggggagacgggcaagtgtcccccgttggcctgtgagagagaggttgggggcacctgaccccgggccatgggctctgcctggaggaggggagtgtagcggacaatccaggttcggcagcgaccctcagggtcaacccctgcagattccaccccggaccccaacgcccgagattcgcacccctcccacgttacagtaggcgacgcttggctcacatctttgtaaggggaagcgtccagaggagcagcgctctagtatgatcggaagggaacccagaacgatggcgaggaggggtctgccgtgcccattccccgggtgggctcggcggcgtttcccgggaggtctcggattctccctgcgcccacccaaagtttcttttcgtcagattcgttgatggggagagaaggtgcggcggggcctcgggaaggggcaccatggagagcgtgccaggccgcagggtccgaggggttacctagggtcgggaactgggaaggtcgggccgcctccggggaggctgctggagttcctggaaggcctggcgggggcgcgccgcgagggcgtgagtgtgtgccgtggtgcggccccgcgcgctgggacctccgccgaggagcggggaggaggagcgggcgagccccgagcagcacgggtgtgtgtggtgggagagaaaatccctttgttgccgaccgatcgcgctccgggctgaagcgcctcagcccggggagggggcgcccctccccctttcttcttcgccggggccaagttcactcccagcccaggtggctctccgctcagaccccgacgccccgggaggaggccgggaaggttctgggtgctggaatggtctgggccggcgagtttccccttccccctcccccttactaatgcaaaacttggaggtgtgggcggggacgcccgtgctggctacggctaaggctgtggcttggagtgtgccaagaggcagcacctgggccggctggatcacttccctcacccccaactctctcgggggagggggtcgggaggggtgggaccgggccagccacctccctcgaccacacccctggaagcctgcggttttgcctcccagggacctggggggcagccttggggtatcttactctccagcagacccggaggacccatcccacactgcacatccggaagagctttttcttctcatctcccactcccacacaccccacccccacccctcacatcctaaaataggaacttcttcacccctcccttccttgacacccggagcacagcgctgctgctgtgacgcagtctctgtttggagcaaccccaggaagggctggcgggtggtgagctttgggcttctgtaaaatctacacagttctgctgaagttccctccctgctctgatcccctctctgttgctgcctcagcctcccccgcaggatgaggtggtagtgccccaaagaaactgtgttgtgattctggggcttattacacagtgtgtttattggagtcgggtactatttagcggggttaaacgtggccagcgccagctattgccaggcaaaactcaagtccatagtgcagcttaatcctttggaaaacacagtgccaaatatttacagaggggaccaaggttggagaggttcagccacctgcccagagacacgcggtgagtgagggtgggagccgggaggctgtggtgaccatgttctccacagagaaccagccatgcagtagcgagacccctcccctgaagagtcctctgccagaggaccccagcacactggctgggaatgcctgcctggccacctgagctggaagcccttgcgaacctctccagttcttctggctgttaactgctggatagctgccggtgggggcaaggggaacctagtgagagagatcccaagaaaagaccccgagatgggccaccctcaatgcctgtgtggacagcagggaggcgtgagcagagttagtttggtggccatgctttccaaattgtcagtgccacttgacaagtgtaatgtgcagacttttaactgatcggcgcctcaagggtgggggcagtggaaagtggccctagtgcaagagggggccagggttgggggtggggaaggaaaggggccaaggcttgggacctgtggtctgccctcacatcttttcacagagggtgggtgtgtccctactcagggatgccaaggttggagtgatggcttatgatcttggtccctcgacgccccccttctgccaatcaggccttctcccccgtgtccgggccaagctcaggtgctctcatcataacccttggctgaagagcgaatgactactcagagtctgtccagggtgacccaagctctcctatgtgttccacttccttggtgctaagagctggagaccatgcagtatgcagtgtgcacgcctgcttctcacaagccaggtctctccacttggccctgggtgttcctgcaggcagctggaacagttcccagtctgttctttagagacccacaccctccccatctgacctcttctcagctgtctttcctctccatccctatccagcacctttacccacttctctccactactagaaaaaggggttaaaccccagatccaaggtgcagcttcgcagctcacagtggaacaggttggtgcttgtaaagtgcttttcatgagtgacttcacacatcttggcacttctggaagcatagcctgcatttggaagaagtggggggtggaggtgggcattgaaaaataaaagcaaacgagcttcatctatagctgcaaagcaccctgaggctctgtttgtcattgaaatcaggtcatttgccctctccacagtgttccgctgccaagggtcagcaacatcagtttcgaagcacttggccttagaggtaaaaaagtccccagctatttcaacagcagcttctagaagtttgatgtccctatactttgcctcccagtctctttttgtttcttaccccagtgtccccttcgttgtacatgacagagaaaccagggtgggctgtaggtaatggtgacccctgttcttcagtagaggcttggtgtgagccgtatggcctttgcaaaggaggtccctgcttttgtaggtttggactgctctttgtcacccaggaggagggcctcctgtgagccagggccattgctcattggccctttccactcctctccatctttggccaggaacccgaagagttaaaagtctttagcttgttgcaatgaaattatggctggcagtggcgccgctgtttgttcaacagacctccacttttaaacagttcacaaaaagttcatggggcagctaaagattataagtgtgtgtgtgtgtgcgcgtgtgtgtgtgcgcgtgtgcgtgcgtgcacgtgtgtgcgtaagtccacagcaggatccaacaatgtgttccccccttttgcttttatgttcagccccatcctccaccccttccctcccaaaacacacacacacacacacacacacacacacacacacacacacacacacacgacagtgaaccgctctgctagcctcaaccctccatctgaccctgtgcatttgagaacactttgttctggtggctggtatcatttatctgtgcgccattaatatggaaagccccaaaggaggagccctggagaaggggagatgctttgaaagcacccagtaggcccaggtgcctgtaaaccgcagtcacctttctgctaagtccaggtggactttgctgaagaaaggctctttgaagggaagcagctgctggccttttcggggctgggcctcagtataatgattctgtttcccaagaaggtgccgggaggtcctttgcacaaggtgtctacttaagggaggtgggtaagaggcaggttttttgtttgtttgtttgttttttgagttttgctcttgttgcccaggctggagtgcaatggtgcgatctcggctcaccgcaacctccacctcccaggttccagcgattctcctgcctcagcctcccgagtagctgggattgcaggcacgcaccaccacgcccagctaattttgtatttttagtagagacggggtttctccttgttggtcaggctggtctcaaactcccgacttcaggtgatccacccacctcggcctcccaaagttctgggattacaggcgtgagccatcatgcccggccagaggcagcttttttaaaggggaggccaatttttaagaatggggacaccagaagattgaggttcattaggcacacgcttcttccctcatccttttcttgggggtttggttgagtgaccctttggctcatgatgtaatttctgtatttcatcatggcacagtgagggggtggcatggtgcagtcccactgctgcagcccgatgaccgggacacactggcaccggggaatgatgttccaccttctctattatcctacccagaatgtcttccttttgttagaaagggcagcaggggccggagaggggacactgccactgcacaagggaatgtgccttgtggtctgcccagccctagtggtggccttccccacttgatttgtgtatttgcaagatggaagaaaagcccacgaacccttatagaaccttccccaacagccgagtcggtcctttgggggcgctgtggctagtcaactggaagagccgctgtctggagacacttcctagggaaatagctttccagaaccccatcatgcctgatgcctctgcagatttctgcctttttcttgggccctttacctctcttccagcctcattgttgagctctaactgtacgtggtgtgtcgctgcatgtggattttggttaacagacgttgttctatggggatgggggcccatgggggatgctggtggacaaaagacctagttaggacaaagaaatgagaaagtacagaccggctttgggattccatcccccaggtgtccccttaactcccaccctcagtcactctcacagaagagtccccggacctggtgcctccaacccaaccgacctggcagtctgctccgtgtgctaaagtgtaaaagcaagcatttgcatattttttcctgctaacaaaggaaatgtgtcgacttagggaacatttgggctttcggaaactgtgtgggtgggtgtgtgagggaggagaaaaaagttcccctgatgatctgcacaccaattatttcacacccaggtttgggtcccgtggaaaaatgccatggccggtctggacaagggacactgagatgtgtttgtgagcagggaattgccgagggccatcggtcccaggcattaaaggctcccctacttattaacccagcatttaacagcaggatatgggctgaagcgcagtcaaaagaaacggctcaacctccaaagagcaattaaaatcctgcacgaggataaatcacgcgccgtgataatcctgttaataaaatgcagcttgtcctgacccttcactcatgcagcaaactagaatgtgatgtgggtgggggcggtgggcagaggaggtaaaggggggtgggtggtggtctgagctcctctgccttggcaacctcccgctcccggaacgtggaaaatgggtggcttctgccggctccccatgtgccagcggcttggagcccatcagccagggctgctaagacttctgtgctcgctaatgatttctcgtccccagtgagcaggcgtcattgaattactcagccgcctctctctgcagcttccaggcaaaaccacccgggttagctgcttaatctaatccagggctctggtggggcggctcaccagcccaccgactctttttcacacttgatctgtaagttgcacacacgacagccttggaaattcagccctagaaacgcaggtagtttgagagctggacctgccgctcacctcactgtggtgccttccacccttcttgcacccttttggccccaggaaagatcagttgtgtgcctcccagtgatgcagcatccctgaacctattgtcagagcctccccttgttgaatcaagtcttctttaccttctttaacaagtggcaagaatgaatgaccactgtacactttcagaggaaagggagtgggcgggtgctgtggtgtgccctgaatgtgttctgtgccttggatgaggctacctgtttcgaattaaacttcttccccagccccagcacctcctaccagggaagctgcatgcccctccgctgtcccttcgagtcaggtgtctgtccttggctcccagaccactgtagacagcaggcacagcctgccttccccatctgcatcctttatgaatcacctagaaagaggccttctctagcgccctgtttggctctcctttactgaacctcctgggattttttttctttccttttaacagactagacgcttgaagcaaagctgccatcccagaagacgacatgctctcagcaacccccctgtatgggaacgttcacagctggatgaacagcgagagggtccgcatgtgtggggcgagcgaagacaggtgaatgcgcccatctgggccgggcctgagtggagcccacgcccatgctgaagcccccctcaacttctcacagccaccgtgggcccaaaaggggtgggagagaaagagcttcccgcctagtaggccgctcttgatttacagttttaacaggcaacctggctcagtgaagcattgccgccctttaaaagattagcccctaaagcggcctttcagtgcactttcgtccttaatttattatttcatatttatgaaggagaattaatcccagtctatatactgctttaactctaaatgtcaggagtgtgggcccaggtggagcagcattctatgtgcttttaaaacaaatagtttgctcagtaataaatggggagagagccaccgttttccttcattgaagcccaggatctctcattgtcctctgctgcctgttcccagaggccactggcgcctgcttttggtcgtcagacagctctgttatgcttcctaatcagtaattttggagttgtggggtggaggcagctaagcagtagatgattgaagctgctcttcggggtaatgaggaaacttttcctctgccgcttgtcagcgatttttatcctggggatttggaagttggcaccaagcactttctttatcgatgctctctgataacaagtcccagggcagccgcagcagcctggcacagatgtgcagcttccttttcagcctggaacagctgacatttgtatgatactagtgtgtatccccctgtcattttgacaaaggcagtcaaatatggcttttttatcaccatggaaaccagtttcgtaggacatggtccctaactttgttttggaaaaagttttgaaagcctaccctcctgggtaacacggaagtggttgatgacacgaccagccttccagccccctttggtatttggctgtgttaccacttcatgtctaccctccaggagagtttataagggttggctgggacagccgagctccgattggcctacttggcctctagagaaaaaaatctcgagggagaagtagttgtgcttaatttctggcttacctaccttggggacatcatatttgtgattcatgtcctcacacatgaaagctttgcgtttcctttgtttttcctggtcaagttgaatcaccatttgggggcgactttcaatatgggccattgacagctggtgggggcggagggttaaggacagttttaaaaattgggttagtagaaactggtctgttctggggagatctgtgaaagatggattcagtgaggaatgctttcatgaagttggtgtatctttttaaataggaaaatccttgtaaatgatggtgacgcttcaaaagccagactggaactgagggaagagaatcccttgaaccacaacgtggtaagagattaatagcttctgttgatgccatatctgcatatcagtgatctgtaatcaatcgtattaatttgcatgcccttaaagggtggggaatgggggaggggtggcagttcagagcagggctgagttggaggcctctgcgagaggacaaggcccccacccaagctcttccagtcttgccttcctgcctcgccacacatgtccctgtcccctagtgactggtgggatgtgtactctcttttcttccataagctggatgccacatcagcgctcccagctggataaatttccagcctccaagtagccccttagggtttacctttccagtaaaatacgaaacacaggactgtcacttcagacacaagggagaggaagtcaaaagacacaaccacagtttgacccatggcctctatattgatatagaaatgaggctgctaaagtcctctgttcctgttgtcccatcgaagatcgtttcttgttctgttaagtcatgccttcctgcacccaggggaaatgaagcgaacacccacccccaagcctgacaggcccagggagggttagtgtgaattctgtaccccatgagggtgatgctgagagttttggagttggtgtcctagttgtagcaaagaatttttgctgagaaggtaaaaatcttcagacttttttatttttattttttaattttaatttttttagagacagagtctcgctgtgtcgcccggcctggagtgcagtggcgcagtcttggctcaccgcaacctccacctcccgggttcaagcaattctcttgcctcagtctcccgagtagctgggactacaggtgcacaccgccacacctggctaatttttttgtattttagtagagatggggtttcaccatgttgcccaggctggtcttgaactcctgagctcaggcaatctgcccgccttggcctcccaaagtggtaggattacaggcgtgagccaccgcgcctggccaaaatcttcagacttaatagatgactgaattaatatatgggcctcaagtccaaagggaccaatgttttccctgcttccaggatactagttgagaggtgagaaggcaggcagcaaaggggtttggataagggggtggggaaacagaccccccacccccgccccgccggaagcctgtctttaaccctttgtgcttggatgttaaggctgatggcatgttgaactagttggcagtgtctttgggtgctgctgccttgaaggagtatcccagtaacacccatgttgttcttctgcaaaggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcaggtgagcccccccacctgaatttcagttactttaccagttgtcagttttttaatgtgtaaacaggattgggggagtatggtagggcagggcaccaggcagatttggtgaatgaagcttgtggtaatttgaatatatgcaatgtggccagtaagagaacgtgagtggtagcactgaggcgtgtctggatgctttaagttattctgtagattataagggaactccactcaattgctgataaccgatgttttaattattgtgaagggtatctaaagactgcatgacgtttacctatcaattgctttgatttctctgcctgtaagatagcaaatatacctagaagtgctgcttagaatgccttacttgatacctggtagagatgtgtagcagccgcatgtctgtgggattcatgcaaatttttcaccaaaaagaaaggaaaaaaaaaagaaaaaaggttgcttaaagggatagagtatgtatttaacttgctagtgaattatgatagatgttgtataggaatttccttaagatattttacttttaattaaaagatgaataaagccaaattgttttgcaatgttaagaaaaaaattggtttatgcttataaaaatggatgaagttatctaaatgatccattgagtgcccattttaattacatagatggaaggattacaagaggacagtattttatgtctacccgctgcttactgtgaggtcagttcttcaaatttttattactagaatcttacataaaccttttgagttaaatttcatttccaaatatacaaagggaagtttgtgggccatggtcgtctttattcattgtgtattttgtttcttttctgttgtgtttttgttttgttttctttgcgttgtgttttcgttttgttttatttaccttcaaaagagaatgtctgtctgtatgcaatagtgtatgtgtggatatacatacacatcgcatatatatctatatacacatgactttatgaataaagaatgtgtgactacttatatatagatactcttaagttttatctgttaaactttaaaatatctgagttacatctcataagctgtggttggttttgggcacttttctttgaaaatactttcctttaagataaggcaaatgaaatagcttttatggtaaggtgttgtttttttttttttccatctccgttctctttctagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgtaagtaaacctgagcagtttgcttgtgttggcctcaggtccggttggcatctgcttggagaaatgggctgcttttgccatgcatggaatgaagggccgattgtccttatgaatggtggcaaccaggaacgaggcgtctgtgaaagatagtttcctgggacacatctttttttccaaagaagcactggttctagagttgataacagtctaatataacgcagtgtagcagaggtatggcagtaggaaattaggtgcagggacaggttatattttgtagcagtggaatgacacttcccagccatctcctgccccacccctgtggtgacagtctgatgtggaatgaagagtccttatattctccctccaaaggcatagatgttgttgaagtaggatgaacatggtgaagtcaccataaagatgagcgttacgatttaccgtggggggtgggggagaattggccacagaatcccaaggcagcctggcatgcatgagggggctcttcccaccggacagagggcagcttgcattttggagggcaagtgatgtgaagagaaggctagtatcttcctcagtacactccctttggtccttacagcaggtcccccaccccaccaacagggttgactttgggatttgctcacgagtcttctagggtgctaagatgtgttggcagcaagtggaggtcttcctctttatttcttaaatatgcaagcttgaagctttaggtctgcttgcaacatgagaaacctcactgggcgaaggggaattagggtgtctgggtgaactaactggaggagtaggtgcaaagtcctcctgacacaggacacttggaagtgttgggtatgtttgagagctccccaccatgggccgtcggaggtttgacattcacaacacagttcatcggtgcctgacagagtttgggaagaatgtgtgatcagggagagtgtgcttcttgatactcggagcgcacacccctccctccacttccagctcatccctgggagcagactaaggccacctgccaggatcctgggtaagctaaaccaggactgatttgttgtaagtcattgctgaagaaagtagtttctgctgctaataggtggtggccttactcaagtggcagggactcaatgtacctgaagttgctcactcttcctcaaagagtggctacagggcagtgggaggtccaagccactcttgggtgaagtggcaaagaaagccttcctcctccctgatgattgctgccaactcgcagcccccactctgagttgcctcaacaccagctcttgggaaggttgtcagagggacctgggagaagtgggcaaggccgagttgatggggaaggtgcttctaaaagagggagtgccatacataagaatccctctttgttctgagtagatggctgggggcctggaggaagggacaggaacttagccagcttccagccttcttgcccttgctgtggtttttgagtaacatggccagaccctccgttcacatctgagtaactcggtgtggccaatggggagcagggcccaagccccacatgatgtagaaaggcctccctttccctttctgtaagtccctccaagcttcataccaacaggctgtgttcttggagcacccaggacagggccctgcaagccataagtcaccacgtagtgctcctcaggtaatgagccatggcagggagagcagaagaagagttgggggaaggtgaaggctgctttttaaatactagggccaaggaagagctggggcaccataggtttgtggttgatcaagaggaggaacctagaggaaatgttgtccttgctgctgccactgccatctcatccagggtacagcatgcgctggatccgtttggcttcaaattcactgagctatctcggccatcacgtctcttcatgggtgtcactgtggcccagagccaagctgtgagcatatggaaactggggtggggatttggggcaggcaggggtcacaaagagggtacaggatgcctccccgaagcctctcccctccactcctacagcaccagtagcttctgagatggcaggtgccgcctgtgcggcctcagctgcctgcgtgtgggtgcatcttgttgggagggcttgtttaaaaaaactgaattaactggacaacaccgtggttaggattttcattgactcttagtgatagtatgggttgctgagtttttcatttagaaattgaacaaatgagttaggagtgtccccaaactcctaaggaatgataagtggcattttgaagatggggtagggaacacggaggtgttgggcccttcctttttgtttttagttttattatttttattgattgatttacttttgttgatacatattagatgtgcatattagcccttccttcttgaatttgggtgtctgtctcccttggtagccacttggcttgtgtggacctaggactcactcagtggcaatgcctgagcgggagctggagaaagcgttgagtgaaagtgaaagggtttcatgggacttcttggctcaggaaacttctcttccaggacagcagcccctatgtactttgtaaactactttgagtttgggcagacagatgactaccaatgcctctgctgctggagagggtagaagttataacatggttggcctctgctagaggtgatgttgcctgcagagggagtagatgtcatgggcagtcctcaaaaatctcagtcctctgccatcctgtttagggcttactgggcgtggttataacagtggtgaggttgctttgttgccacggtgacttgtaaatgttgccatggcgatgcttccaggaggtattgcaatggcatagccatggtaaattatgggatgtatgtgctgtgccttataggaccatgatgcaaggagaaagtggtagacggtgtaggactcagccatgttcacatctgcctagatctcatgaccaaaggcacatggcattccactcacagaagggctgtaagtagttgcaatggaagaggaccctgatggttaggacccctatctatcccttcatctctgtctatgcacccatctcctttgccctcaagagtaatttctgtgggtactggtaagaatagccccatttgagggaggtccaagtgaagtgtacaggaaagtgacctggagcctctccctcatagctgtttgccatacgtatcttcggcagtcaaggtgggtgttctttgggattattactggcccatggagggaaaccctagcataaggtttgggggccttcactgaggggaattgggatgtttgccttgagaggctcaggggttgaaggaaggacaataggcctcatttgcggaaagatctcgtttgcggaaagatcttcttgagagcggacaagaagcatctacactgcgtgtgggcaggcatgattgcagtgaaccccagatgcagcagtggagggctcccgataatagttctggactattcaggaggcagaagggggccctgtccggctgaacggggaatggtggggacttggaggaggcatgtgtgtttcgcaccccttatcctagcctgctggcttccccatgaatggggagcagaaggtggtgtgtgcaggggagccctccccacccccactgggcagcttttcctagatggggagccccagagaagacagatggcaagacctccccatatctaatgggggtgctccctagcagagagactaggtccccagttagtcactgcctgttgatgccagtctgtgaaataagtgattacaagtcttctaggtggttttctgtggacaaaatatactggcagtttgggcataaggccaggtaggtgagatataaactcatttcactattaggaagtttgcagtgaaggtcaaaactccaatggaaaactttctccctgagaaagatgccttagacttggttgagattgttacaaatacaggtggctgtgtgagacctggagttcaaatggaagctgtggaagtcaaatccaaagcactagggttgagagattcttaatctgatggggatttgatgggggggggggggtgtctctgggaagggtgccaagacagggcagttcgttctgggtggggccccacactggctaagctgctgcctcattttgacccaggaaggcattgtgacattacctagtcacctctgctttcaaaccacttggctcaaaccctctctcctacctaaagggaggggaaatgagtacactttaaaagtataaaagtaaccttgcatgtggcgcttcgtaacacagtctttacatttttacattgcacccccagcccctcccacagggctttcaggggcggctgattggctccagaaagtcaaatagtatataactaggacaatcagttcacatcttaaactttcataaatatcagggctaaaaatcaagctggtctggggatcatagcgtccttttgtaagtaatttctccagccttaccctctgccctgctgcaccgtgtttatgaagcccaccgggggaggtggcttgcagtaatagtcccactttacaactcaagggggccaaactgtaaagtggcgctgttactgccagagtggttaagacacagagcaactcgagtcgcagcccaccctctttgcgtccccaggccaagctgagcacagtggtcaccacttctgcatagtgtaagttttgggcagcttgtgtgttttctcctgttgctgctgtgacataacaccaccttggccatgtttttggacgcccatccgttgctggttgtacctacagagacctggggtggtattccatggtgggggcttgggtgccgaatcccagtcccagccatccctgtccatacagtgcactgtcgtgagtgaggatgaggaggaacggttggggagattctaccattcctttgcaagaatagatgcagccccatctgttcccccttagaacacccttgaagagaaggtgaatgggtccttgcaccattgagagcacaggctagccaacacccctgtaaagctcacccccacagctgactgccgtgaaccgctggcaatgcccccgagagaagcgggtgagcggtgctggtcaggagtgggagtaatatttgaagtgggttggggagaggaagaatgagatcagcggatgaggcgtgtgcttatttcatctagaaattgacttgtgtgcctcagctcagagttaccaagacaccagactcataaccctggtgatgagagggatcatttcagcgggccaagggctgacaccttaacctcgcagtggtcattaagtagttatcatttatattcattgtgtattagaaaaattgtgaccagcaaagcagttaatgagctatttcttgggctagagcaaaaataggaagtgatgttgggctgaggtgattcaaggaaaagccccaaggcccgtgataggccgagcacagggttcctggaacgagcggttttgcaagcgctggcctggcatgggaaggacacaccaacaatgaggagatgtctgtcgatgcttgcctgtgacagagggtgtgaagaggagtgtcagctggggtggccagcatccccaagggggtccctttgtgttggacaggaaatgggaacagcccaacccattggtttcacatctgtgcatccagcaaatcgagttttttgaagttttctctgaactcgtgtatgtgttaggaaaccttgcctttggctttgccacgcccctcttcccagcagcctgggtctgcctgggttccctgcctccctctggcctggactgtaggcccagagccccccaggagtgagggtcacttctgcccatcaaggacctaggctttctttcaacactcttgtctccagtccattttcatctccccggttggcctaggtgaatattggtgttatcccttcgatagatgacattttggggatatttggtcactttatcctatcagcctgccatttatttcaaaataatgacctcagcaaatgtttccataaagatttttaggtcagccccagcttggttgcatcttctgctgaaaggactatagtgctttaaaaaacgtagcattgacgccccatctttcttggttccctcttgcccccaaccataagaagggagaaggagaaagtcaggagtgtgacatgcacctcactctgctttacttgccactcgtcttcaatgtaccctccctctggaaagttctgtttctgagggttttgtgctaaccatgtgtgaggaccccagtctccaaagaagcagctgtcaatagcagattaccttgggcatggtggtcccacgcactccccagatcctgccttctcatggcgaccttcgggcttcattaatgccctcttgtctcccctcccccaggcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaaggtgagccctgtctgcttcgcccgcctgccggggggtgggcctttgcatgcggccacagtggatggacaggagatgtggatgtgcggcgcgctgcccccgtagacagagtcggtgaggggaagccgtgggggcgcagcagtggagcggacctctccattcccacactgcctcgtgaggttcccaccctggagcccccggggggagccgcccacacctcccctcccccaaagccagaacccagatggccaaagatgattaggccccttcccaaaagcagagaccagtgaccacaccccccctcccccaccccattagtgatgcgtaagacagtttgttcccccccggggggctttttgattaatttgtagttatttctccattagatgactggcctgagagggaaatgacaaacagttcctctaaccacttagaagacccacattatagtgagctgaccaacctgaaggtgtgcattgaattaacagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggtatgcgggggccaccccttgagtgttcaccccgctcctggagggtgggtcatccactctctgtaggaaagggcttttgaggagatcttagaaggccatagcaattgacttcaacgaagatgtggcaggcagggagttctctcttgatgtccttgcccgtggttgcacaggaaggaagtctgaacaccttcattccagcctcaggctgtctccagtctctgggtcctgagcaacccagacccagtgggtagggggcaggaaagcaggaagagccagcttctgtcctctcttccgggccctttgaagcaacttgccacttggcgttttgtgggttaacttaggtgccgtttgaatgtggtataattaaaatattaatgctttgaaaacataattggtgtatctttaaaaactgaagccgctccagtgatcagtgttaacaatgggcttttcttcctgcactggctacaactgtgtaacgcccgcttcttctcccgtctcccatccgcccgccaccccgtcaccccctccgtatttaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtacctcttgaccccggcttccctctggggcctgtgcgaacacatccccgcctgcctgcttcccagcttgaggggacaaagctttccttttcctggactcctcccccacaccacacgtcactcccctgtcctagaggagcatgtcttctgggtggcagcgaagtttcaaactagtaagaatgaaatcccttcccccaaaccctcctttgacaggcaccccccacccccaaaaaaagataaggaataaagtgcctctctccacgcaggtttgtcacgtggggaggaggaggggaagcagcggctgttagaaggacacgggcttaaccgtgtgcgctgcttggttttatgataggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggtgtgtccctgtgggcgctccctggggctgcaggctggggggcggggcctgcggactgtggtgggcgaggggagggacatggagagcagagctcagccccctccacatcggggctgggccggtgctccaacaggatgtttgtgttagccccactctcactgctgtctctttggtggcttgttcaatcgcggtgtggaaagaaaggcctctctgatgttcagttcgtgttcaggcaggtaggctgctacggcatcctccagtctcgctaacttatctctgatataaaatctgacacaacccagggcttggcgactaggggaattttaatgagcccttttggattctgattagcaagggggagagaagttattagctctatctggggctgcttgtactgtttcgggtggaagggtggccgtgtagggggagtaggcaggaagtagctgtgtaggtcacagagggaggggggtggggcagacctaaggtctctttctgagtgggggggtacagtagccttagggctgagggctctggagggagggactgagacttttccctcaactcactgcttctccccagcccccctgctcatcctcctcctagcatgggccatgacaatgatagcttacgttgacggagcccctaagatccaaagtaactcatttcaccctttcatcatctttgtgcagtagtaactaatattattcccgctttcagatgaggaaactgagtcccagaggcgttacatgatttgaacagataataatccagcagcctggctccaaagcccagtctccccccatccccccaaactcggctcctctccaggactggctcccattggaatcacgcttttcacagttcaaaacctacgtctgcccctgtgcgtctccccaccacacacttgtcagttgagatagtgatgtaatagcccacagtgcaaagacatttttttttatgctggcatcagctctctaggagtcgtggtgaaaataaaatgcggttcagcaggctgagtgtgaagtgtggagaagcacccgggcgacaggatccatgccaggccatgctcagctgtgggctcccggaattcagccagagcccaggctcatgcaccttaaccatgctgcagtcagcagtctgctgtgccttgagcctttcctgatggggtgacccagctgccagtctccctttgacccagagcccaccctggggcatgattgtgtgggtgggaactgggatgctggctcacacctgtgggatggtcctttgaagcactagctaggtatttttggttgtatgtgactttgtctattcataccagcttgtttcttatcgatatctctggattatctttgagggaactctctagaaggatttgaaaattagctcagttacttgcagattaaacccaagtggcagccagttggtttcccataagctgagagcagcggcgcctatgaggacagggtagatgcagcgtgccaggcagggccactcattcctacgcatgattgggaaaatggacttgtgcttccagcaaacaccagaggtaagggagggctccagggcagcaaacttgccggccatagcggggtagggctcctggcctggtctttgatcctggcttcatttctgccagtctcacctttctgagcccagagcttcaagagacccttgtgggtgctctaaggaacagtttccattctggtggttttcctatagcaggcctggactaaggaacactgatccatgctttcttaggctaccaggcctttggtgcaagaagccttgagaatgtttatggaaggacaacttttccccttcaaatgtaaatgtcattatagaactttcccaggtcatcagttttgatgctgaatgttttaattactagatgaaagctttcaactttgaatccaactttctgggatttctttagtcagaaattaaaatgttaggatgatagtccattcagatgtggcagtgtaaaccctttaaaataaaagaacagtttgcttaacaggataaggtacggtatgaatgcacagctttgggagaggtttcccaaaacccctctttatcattgtcttctgcttagctaaaaagataccacatgcaataaaaaggctgctcaagctttgttttctgttaatctggttcttgaggtttagaaacaccctctgtcttcagatctgtaatagaccacctgaaaggccagttacagttgaacctgtctgttcttaggctaagatgccaatgtggaaccgcatgtgtgtgcatttagtagtgatggttaagttttctatgaatcgaataaatcatgtttttaaaaaagttaatgaggcatttaattaattaacaatgtcgggtttatggcctttatggttacattttgcggttaatgtcattcagcttatagctgcttaacagagaattgtccaacaaaaacagtttgattttgtttgggaatgggcgggctgcccttcaaacactcccatttccagcgtggagaataaaccaagtaatgtaatgggtagacagacttgtctggcttcttcattctctctgttggtgacagcggttgccacccatttaagatcccatcaccctcccatctaggagagtgtcattagcctgcttgaccccaacagaaaaggtgcaagggatgccggtcatggctggattgcagccctctagccagggcccttgattgggcctttggaaacttcccagcagacccgttgccaaaagacctgagttatgggtctgatactttgtgttaattgaatatggggcttaacctctctgggcctcaacttccttgagtgttgaatgagactcataccacttttccttcctgagatctcacaggtcactgtgggatatgacatacacatttgggaacatcagaagtgttacggtggccaatggcaaaacgtctgacctggttgttgggttactgttgtcttgcctgccatcctccaggataacagagttgacttacccttcagcctcgacatctttcatttctatgttccctcagatcagccctagtagtgatgaaggtttccaggtgaaggccataattgtcagagcaaataaaccctgggttgataggacaccaggccggctgccgggatccgggtagattgatctgtgcacagcagtcggtggcgcttagagctgatccctgagtcacgtgacagggcctctccctggctgggtacacagctcattagcttgcagccgtccactcgagtctggctagtgagggcctgctaaaagagcagcagcttcatgcggtatcctggataccagtgctcggggcaggtggcctgggagctcagaggattgtgggctttctggcaggtgagggcctgaaggaagagacgcatctgtgggcatgccttctctcttcctccccttgatttggaagggagctgccgcagtgtcctgaagcaacagggttaccggccagggttaccagcgtgcagccttaggttcacagggggagcatctagaacattctagttagtgttcaagtgagtgatcacctttgactgatgtgtcttagaaagggcataaaagaattttcagaactcacctcacgtttatgggtggctcaaatgctgcctattttaggttatagatgagttatttaagagttgtcacaaaggagagcctgctgtgacccatcaagctccccccttgccaagtggaacatgtgttgggctaccccacatgttctggctttccccccagtcttcagaacctgacagctctctgctggccatgactgctaggaaaacagtgtaacctgttgtctggtggcagatactgttccatgtgtttgaaaactttcttaatcaaggtaataaaacatggactaaattactgctctgcttactgggagcggttcattttaatgttttaacacgccaaagaagtgagattaataacagtgattctcatgcaaactgttgatgcggaacacattctgcaaagggggaagggaaggattgtcttacttagttcttgaaatgcgtaggttgtggtatgtggtgtattagattcctgtcattaacttaagtaaatatgaaaatatattgattcagccccaagtggggcggagagtgaagcaaaaagaaggtagggttattggaagcgttgatgtcatttgttgatgagtatgataccaacagaggcactgccgcccaggctccaactccgggtctttccaaggggcgtgaggaccagcctaaactcctgggcatcctcctctctgtgaagttgagaaacgttctccagctcatttaattgttcattatgccttgattggccttgcttttatctaaacttgtgtcgtcatccactactacctattggatgaatcgattgagtgaggaggatgtccttgtacttattcatgcgttgtttgaaacattagcaaccaaatccctctgtactcactgtgccaggcactgagctaagggcttgtgtgggtctctaattacagtttcttagcagcctctggtaggcgctgttactctcctccagaggtaggaaaggaagctttggagaattaggagcataactcgcccagggccaggcagctgggcagcagacccctaaatgatgctgtccctgtcatcaggcgcttcgcacatgtgtttccccctcaccaagacatccacagcccgcccgagaggttctcaggttctcaggcctgagggtgtatgtctttgaaagctacagagaggtccaccttacaaggtcattgtgcagtgatctgatggcattcttccctcccctccccacaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggtcagtgatgtgtcttgttctcagcctggctctgctgagaccaagcttccctatctgtgcggtggtggttctcagtgtatacgggaaattccaggaggaaagacagagggtgactgtaagcacactgaccactgggttctctggaattgaatccagcagacctttctggcaaatgtagatgtaaagctcccaattttgatcagtcctataatgttcctgtgaaccaaagcttctgaaaatgttgaggcctgcatgaataattgggggtgttgccttttaagaccctggactcttcatcaccatctatgaagtcactgtatttaaaatatatttgagctgaaagtcccaggagtacacacagagtgccagctgcccctccgctggttcagcaggacctgccattgccacccacatccccagccgtggccctcaccctgtccttgaccctggtttattggtcagagacccaggtctgagtcagcctgaacatcttcctggttgtgtgagtgggatgctgccatgaggctgggcactgggggtttcctgacagtgacagaaatagccaaacggaaatgtatttggtgtttcacactttgcaaatagcattccctcagattgggcagagacccatcttctccctgccaaccccaacccccagctccatggacacaggtaggaggcctctgtatcctgctgagaacacaccccaccaggcctgtttcttctccccaccgttcccttggcttctgggccagaggttaatcactgatctgtgtgaggtcctgggatcaggctttcaggagagtctctgctaatctctttgcatctagtttcttttaaaaacagaggtggcttttttttttttttttttttaatgtgtgacagttgcttgttgtattggcttccatgatgatgggacctcttttatcccctgtaagttaccttcatatggtccatgactacttaaatttgttgaaaatgttttcattttgggcttgacttccttcttaggccttggattaagatagggtttgcagctgggcagtggctctcttgcctgtaatcccagcacttttggaggccgaggcaggaggatcacttgagcctaggagttcaagatcagcctggaaaacatagtaagaccccgtccctacaaaaagaaaaaattagccaggtgtggtggcatgcgcctatagtcccagctatgaggaggctgaggcagaaggatcacttgagcccaggagatcgaggctgcagtgagccatgatccgccccactgcactccagcctggacagtggagtgagaccctgtccacccccacccccacccccgcaaaaaaaggatagatttgggtttgagatttaggcctgaaatagtctcttcatctgccctgtaaagggttagtcatcaaaataacagtgattcattgcttgacgttgagccactcactgtagctcagtttccctatctgtgcagtggcggtgactgtgcacacctcctggatgaaatactgtgcttaggaggctcagtacccaaggtgcacatgtgcccagctttgcctgttgcttttaaaggagacaactgctttataagcaagtgtggcttgcatgagcataattctattgcgcctctcttcctaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacaggtatgacaaagttcaagaaatggtcttattcaaaaattagatgataactcgatacaatagatgattggaatttgactaggcagaaatcacaaaggctgaaactgtaaagcttttaggagagcagccgagtgtttgaacttttgtgtggtttgactttgttctagtgaagctaagtcatctattcaccctaatgttttaaaagatttcctaaagttattcccattttccacacatgcattcttaacttaggtatggctcataggtttacatcttgagtctgggaaaaatgactcaaaccttccatacatgaaattatttggacaggtttatggtgttaggtcatcagataacccattacttaagccctgggcattacaaagtgcctaaagcagaagcacaaggttttcatgagtgtcaggcacctgcagttaaagtccttatcaggcacttcctgccaaagaatgccactaactcactggtgacctgcccttgtttaccttaaattacactcacttgttggaagaagcagcttagttaggctatcaaagaagagatacataagtaggccggacacagttggctcacgcctgtaatcccagcactttgggaggccgaggcaggtggatcaccaaaggtcaggagttcaagaccaacctggccaacatggtaaaaccctgtgtctactaaaaatacaaaaattagctgggcatggtggtgggcgcctctagtcccagcttgggaggctgaggcaggagaatcccttgaacccgggaggtggaggggtggaggctgcagtgagccgagattgtgccactgcactccagcctgggcaacagagcaagactctgtcaaaaaaaaaaaaaaaaaagagatacataagtgtaatgctactttattttgctgagaaagaggaagacaggaaatgaccttccagcctgtcatgaatgtataggaaaaaatgccacgtggctctgccatcattttgttctcagcagtagattttatcttgtttttttatttttctctccctccagattatttaaatgacctccagggtcgcaatgatgatgacgccagtggcacttgggacttctatggcagctctgtttgtggtaagctgcattgtttgctctagttccgtaggaggtgaacaagttcaagtccatttctgtctggtatgggtgagggaaagtggatggtgggcactggaagcaggactcacttgggaaagaatcttgttatttaaactccttgttgttgttgacaactgtggacatcttgctgtagtttactgattccttcctctcttatttgccctccattagaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggtgagcatggctgtcatgtgattgaaaactagctgagctgctcttgaggtgacaggagttagaaatgcgctttgagcagatgagggtgggtgggtgagtgacctccttaactgtccacgaacctcacacaatgcagtagatattttccagaaagggtacacatcagcttccttacacccagtgtggtggggggtggggcacagcatggtataaacctgccctcatcactaacaccaaggcttaagtcactccccagagaagtgggtgactggaactttatggaagggtcagcaccttggatacttaaatccttaaacactttgagaaggtgtcctccctaggactgcctgcaacagaccactgtaggatgttttgagatgtacggactacactgataaaccaccttgtgtaaggttaggacaatcattgtacatgacacttaggatattggtgtgtcatcagatttagttaatcccctctgccccctatggttgagcccctattcgccagtgaccaatcatcttgggtgtacttgtcaagagactgctctgctgtgtgttgacagagctgcttgatgagtaacatcctcctcagccctgaagctataaacatatatgccattacaaacagtgatggaaatcataaagtatggtaggttgtatgcaaggaatgtaacaccttccttctcaaaagtgtcactcccaaaagaatggaaggatgggagtggacatgcctgaatggagagacagccttgtgtgtttataatgctgttagtgagggtctgaggagagaagagatcaaagaaatggggatacagacttactctcccagtgactgttgatagcagggcacttggataggcttgaccctagttgtggtcacagctgaatgagcaggactttacccccagaaaggggagaaatggggcttattcagatggtcctccctagatggacagatgagtccagagttcctactgctagaagtagttactctgcctcaccttagaaaggaatggcgatggccgggcacggtggctcacatccgtaatcccagcactttgggaggccaaggcgggcggatcacgaggtcaggagattgagaccatcctggttaacatggtgaaaccccatctctactaaaaatactaaaaagtagccgggcatggtggcgggcccctgtagtcccagctactcgggaggctgaggcgggagaatggcgtgaacctgggaggtggaacttgcagtgagctgagatcgcgccactgcactccagcctgggcgacagagcgagattccgtctccaaaaaaaaaaaaaaaaaaaaaaaaaatggtgatcagagagtaggtatggtgagaaatgaggggtgggagcagaatgaaaggacatagaggctggtccacttgggttggtagttaatattaatagttgggcgcacttttcattttactggaaactcaaagcattttcctttctgttttgtaggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaattga

SEQ ID NO: 4488 - DNA, 114365 bp, human
gaagctggccaggccctctgctgctgaccctggaaatcgggtcacactagacaaggctgcatgtgcggggagaaggcgggggggctcctttgcacgcggctgctcgcgtttccccaaggcctccaaatagtctaaaaactcacctcggaggaggagaaagagcgtgaagtggctctttcgatctgagacaccccctcccggagaactcgccccctcccccccagcccagagcggagtgaaatcttagaagccgtggctgctgggtttgaacggaatgctggagtcagtggaagacggagctggtcggcccgaaggtcagcgagttgttttgagttctcctacccggaaggtagggggtggggtggggtggggagcagggagtagaggacgccagggcccccgagagaccccgcgtcagagcaaaaattgtttgtgccccggaacaggcagctcagcggaagccgcgacgggggcgggtcacgtgcggcggtggcggcgcagctggcgggggagccgggctgggacaagggccgggccgggcgggggtggcgcggggcggcggctctcgcagccgaaggtggaaccggctgactctgggcgctgggagcgagcggctccccgagcccggagcgagggaggagcgcgagttatggagggaccggtgtgggagccagggcgcgcggagctccgcgtggtgcggcacgggccggacgaggaatcgttggggggcgggggcagggacacggaagcgggctcccggggcgagagcggaaccgacgcggaggctgcgagggcgtctgaaccccaagaatggagtcgccgctcttgtagtcgccggccttgttttcttcttgcacgcaaatcccggaacgaccggaaccgccatccccgcctgcgtcccaggggcgccccattacgcatggcgggggggcccgcggggctactccgggaggggatccgtgaggccgaggccggggagggctgcgaggtggctcgcgggggtgcaagccggagcggggctacacaccacacaaacagcctccctttcccccggaagagcgggcgagggaagacgcgggctagctctgggggctccccaggactgtgggagccaggcgaggaccgcaaggcggaagggagtgctgcagacaaaccatcggccccacctggaagacattggtggcctcgtggccggtggtgaacggtctcacgcttccccaaagtggcgtgcgctactctagcgtgggagggaaaggacacaaacttggccatctgccagaacccttgaagacgcctgtctttggtgtccctccgccccccgcagtggcccgaaatgtactctccctcccgtagtccacgaggttcaggtccgaaacctggaaaagtagggtagcgtggtctggcctcggacgggaaacccacccacgttcttctgaggtgccacgcggggaaggcgcggaacagtcttcttgcaaagtttcccgcccctcaccccagtcgagtaagggcggctcttccggaggtgggggcggggaacggtctcgtagcggggagtggtgctagttcctcttccctgcgaccgctcgggccgcctgcgcgttcgcgtccccagacgctgcaccccagtttgctgcaacgtctgcttggagtcgcggtagcgggtgctgcgcggagtctaggacgacgcgagacgccatttgcatcccccctccctcctgcaggttggcgagggcggcggtgtcgcccgccgcggaagcgtattcctggcagtgacactgattagatgctgtgtcgatacgtgcacagaatcggggtgggccttcacctctcgtgtgcgcacacactttctgttggaaaagttgcgatattttttctccccctctcgccgcacagctgctgtctcccgggcggaattaggcgaccacgtttgctcaacccgaaggagagaggatcgcgcgggcgctgggcggccgccgggcccgggccgcgaaaatccagccctggctttgcgtcgagctgctgagtgccgcgcttacgcgcgcggggccagccggggcctggtttccatctgccccttttgcctccgtgttaagttcgccggggaaaacccaacgatccgtgctgagcccctcggaggagagcccccgccccaccccacccccagcccgatcccgaccgatggaaaaaatgacagtataggtcagaacaggctgcccgcgagtattaatatggacggcctccgttcctggtgcttggggaggatgggcgcttcgccaggaaaccgccgaaggaggcgccatgagggccgcctgccccttctcgggctagaaaacgtggattctcagagggaccagacaaatgtggtcagatagctgcaggaacttaccccatctaaatacaggttgcccgtgtatattccaaccaagatcatttttgtttcaatctaatacacgttgaatcaattagaaatactgtgagaaactgtggtcaaacggtagataggaaacttgctctttgcctaacattaaatgtatgctcaggaggtgcggggctgagcactatcggcgcagccagtctgtgtcctaagaagacagggtcccctttgcgttccaccttccaggaccttaatagaacgcgaagagaggaattattttagttgtagtttctattagagggttgcttactccttgcaaactcccgcctggggttgtcggtagttagtagtagatggttctgcgttttggcttttacagtccacgtttttctcttggctttttcttttcctgcgtacacgctgctgggtacggggagggggctgcccagacgtgtgctgccgccgccctcgggctctttcttgcgcaccacgcggcctcggaggaggggaaatgtgaactctccgggtggcgctcgagaactggaattctgatttagggctgcgggtttgttccggaggctggctgggagcgtcttgtaggggccggaggctgtgaaggggaagccccagaggtgaccctgaggcctcagaagcaaacctggaggcgcccgtgttctttgtctttctcggggctggcagcttggcacgcacagttccgataaggatctactgagagctagagcgcactgccagcacatttcagtgattaggcaaacgccggtagccacttaaggcaaaggccatttgcgttgtgtttgaaaaggaaaaggcagcctcacctaatgaattatgggtgaccctggagaggccaagcaggggaggccgaggcctccctaggctcttatttgccgcaactcctcccctttttgccagagtcgccatttcaaaggtaatgggaagccttttgaaattagaagtctgaccgattctgtctacagaagtggtatttgcatctgtgcaccagtaaaatgtggcccgccagcggcccagggacaaggcctgccatacgccagccctgcaccagtgttagaccaaagtacatcccagaggacatggcttttggccaactcctccgagaactgatttaaagaggtggccttcagccatcaaaaaaggtgtcctggaagagtaggctggaggtcctggaaaccagcgctcttccccagggctgcagggagagagtgggtaatggtgcctgagccctgacggaacttgctattaatccagtctaaatgagcaccattaaaaaggactctccctcctatccaccaccacacacacacaagcctttatgggacggtctagtggagacctagacagtttgagggcatttggccttcacttttcagtggccatacaatagtgccctttccaccctgccaagaccactggctccatgtaaacttccaggaactttaacccggaactttgtactccctacccatccaaagggagtgccagatcatagtaacaaacacacgtagcattgtactggaggcagcgttctaagcaccttatgtatggaggcatgttatcctcagaacaaccctacgaggtagataatagtattggtcttattttacagatgaggactccgaggtttcgaactgttaagcggtttgcccaaagccgcacagcttgggataatagggcctggattgaccagagggagagatagggcctggattgaccagagagagaaatagggctgtgttgcctctctagcgttttgtaatgaaagtgatctgtttgggggttgtttcgagaggactgcctggaccccaaccttccaaaggaaaatatgaagagactagaaggcccaacatttggcctttattttgcaaaagaaagttctggagagtcgtacagaggcatcttactgtggctcctccgcggcaaggaaggggtcagggaaggcaatgcaaaggcccccctggcccacctagctgcatagcatccggcggtcacgtccgccggaggtgactggggactggggacagccgattgccgaggaactccttatcgcccagtgtcagtgctcccgggtgccggagctaaacgtccgcctgcgggggcggctagttcacaccagtcccctggctcccgacgcgcccccgggcttctcccgcggagctggctagatgcccggcggcggctccgaagctccgggctccccgccgcttgtcccgccagcccgaggcatggagccccacggcccaggactggagagcccagttcgtcagtccaggttgggactgctggttccgggttgctcacgatcactctcccctcaacacccgtccggccagggcgcgcgcgcagacacataaacacacacggcttccaagcgcgcagcccgcctcccgggcctccgcttttccttcctcctccccgctcgggcgcttcggaagcccgtggcggttgtgtgctgcgccagggaagagtccgggtcggggagaccgcgctgccctctttccccccaaggtctgcgcgcacgctagtatccttaggaagcacagtcaggcttgtgggttcccatcttcccgggaaatgacggctgctggcgaggacctgttcgctccgtgtttcgcaatggcccggggatcagaggagaggaccgggcggtggggcctgcgcgtggatgagggtggcggtaaatcccctctcccgcgaaggtggctgagcctccggccaccgctagtagtagtctaccctgctcgtcttgcattggccgcagcttgactcccctgcgtgccgcgggtcggtgtgggtgtccccactccctcaagcctttactttcagctcgcgaaaccccatggatccgcggctgggctgggcagcgcagacgcccagctgccctcgccaaccccaggcccagagggggccaggctggcctgggggctgggcggcccggctgcacttgccggcgttgagagaggctctgtgagccggagccggccgccgagccgagggagagagcgcatcagcccgcgcgccttaaggcagaacacacgcctttcccggaaccttgaaacccaggggagccgctgccatcttcgcgtgacgagcagcgagacgccggtgattaagtgtttctttccggctccctctccgggttgcggctctcctcctttccacagggctggaagaataaaaacctggggaaaaaccacacacaactgcgctctggtctcgctcgccatgtccgcactggtttcttagggtgcgcccacgcggggcaccccctgctcccctactccacgcctggccggggtcgagggctgcgtgcctcggtttccatccgctctagcgcaaatctcggagtttaatggggagggggcacacattgctgaagccacccgacccccattctccttacgccccccccccatggggattaaacctaaacacatgaatcccccacccatacccgggactaatccagccgcgcctcctgggattaactcggctcacaggtccataaaacacttccggcgcggccagagggtctgtctgcagaaacactttaaaattgtcctcccgggcctggagtcggaattgactgggtggagggaagtgagtaaacagacagttgtaagagacaatccgtgaggtttgcaggctgtgaaaagagctgcttaaaatatgggctgtcggggttgcctccagcaggagggtggcccgggtcctagcagacagatccaagaaaaggatgcaatatattctaaatgacattgacctggaggaaggagggtgtaggcaggagcaggctggcttcacatggcttctggctccagttcagtgaggaagactagcttccagaaatttgtgggggcgagtggccagtctcttcatgtgtaaaatcagaacagtaacacctactctgtccccctcggatgggtttctgaggaccaaaatgtgaaggcactttgtaaatgcggctcaacccttctgcttcactgtggttaatgttcagtctctcttaggtagaaaaaccagtgacttgctgattagaaaacaaagtagaaatcagccctttctcaaatctacgcaacaatgttcgagataaagggaacccaaaagcaacctaatattttgaacctccttttacatcatttcgagataagtttctgaagtaatgagagaatctttggaatgttctaagaaaatctgtcaaaaactggaggttaatggggaagaaagggaggctttaaattgggtcaaatcacattttaagaaggctgggcgcggtggctcacgcttgtaatcctagcactttgggaggcgagatgggtggatcacgtgaggtcaggagttcgagaccagcctggccaacatggcgaaaccccgtctctagtaaaaatacaaaaaattagccgggcaaggtggcgggcgcctgtaatcccagctactggggaggctgaggcagaattgcttgaacccggtaggcagaggttgcagtgagccgagatcgtgccacttcactccagcctgggcaaaagagcgaaactccgtctcaaaaaaaaaaaaaccaaaaccaaaacaaaaccggaagaagaatataaatttatagtagcttcctggctatatccccttctgttagtctgcagaagagatgcccgttggtagccattcccccagccccaggaccgaaggacgtcttgactcaggcttggtctgctaggtgcaaggtgttgttggcgtctggggtggggacagtgaagaaaggcgatcattttgctttaaatgaacatcagaagacccaggcctgctactgcgtcttgaaggcctggagttgttaaaactctgtgggagggggtgcctcgtgacctccttcctcgcagatgggctcaggcagcgtgaccggccccaggtggtgcccaggcgcgctggggatggaggcccaggctgcgcgttcaccctgcctcgcagatagcgagtaggggcctccggctggaccgcccaccggccttactctcccttccctggccttggggccttggaccagggttaaccctggtcccgtctccacctcattgccccccgtgcagcgccgtccccgccctggctcccggcccagatcccgaggcctccctcgcccagcagtctcggttcttccccctcgtgattcatttagcagcggtgcagaaagcctgtttacctccgcagccctgggcgactcgatctgcgtaaaaagccccaacgccagctccgaccagtaggggggggattgtcctatagattatttctcctcctggtttttgtttttgtttttttttaaaccagaaggcttggttgaagagggggtggggtggcgtgttgctgctgttttttaaaacaccgtatttgaaagagaaacaaaagccacacaaaagccgtttaggaggtaccaagactgtttttacatataaaaagtgcagcgaataccaaggggcccccaacagtgataaactaaatggttggccgatttcgacaattaacagttaatctgttatctgcgatcagcaaacaagttttgaggctcgaaggacaccgaattcctgttccagtcgatagcgttgtactcgaatctgttgagcacatcagatgctccctgtttctcctagagcgaatccagctttagcaaacatgggtttcccaggttgaaggaccgacttgagccagagaaaattctcttgtgcagctgaggagcctctgtctgcatcgcccctcgagcccgagctcatctgtttggtttagatttctccaaattggttttcaccccgatttcgcggacctcctaattttgcacgtaataggcctccgataaatgtgtactgaatggcagaaactaaagtgaggccctcggcctggaagacggcctgacgcacggcctcgcccttggaaccccactcgggttcccagagcccccaggccgctgcagcctgcgcgcagcttcgccctgcgccggccagggcgggcgggcgggggaggccaggaggcacgaagcgcctggagcctgcacgatgataaatattgcgcagacagcccataaataatttgcattatgttcagctgacaacgcggggcgattaattttaatagctacatatttgcctgggctgctgctttcgtaggccccgtaatgaaaggcgagaggccgccctggctccgtgctcgcggtccaggaaggcagccgggggtgcgggaaggcccgatgtggcgtctcctccaggcagccccccggggagccccagccccttggcccccctctcgccctccgtgccttgtggaggtgaggtgtgcgcgcaccgccggagcacccccgaggcctcgagcaacaggagccaccataatgacactgcacatttgtctgtgtggggagagccacttgtggactgggagaccctccacgtagctttgtgccccacccggaccaagtccggagtttcaggttccacttaggctaggaggggggtgtttgccgccgccaattcgccagtgggccccagctcggccgaggcttctccgccctcccggcagaggcaagagacaaaacaaagcccggctgtccccgcgtcctctccgcgcgtgtagggtcctgagttctgcctcccaggagctgtccggcgctccgcggaaggcccccctaaaatgcttcctgagctccttgatgcaaaaggaccgcacacataaaggacggaagaaaagaaagggtctggaggagctctttaaaagagggggcagggaaggaagcgcagcgaggaaggacgcggctgccgcggtcccgtggtggccgggtgcgcgcgtgtgcgtgtctgtgtgtgcgttccgatgacaaagccccgccgccgccagcaagctcctggctgccagagctctggtgggggaggggaaagggaggagaggagccagcgctagcgtaggtagcggggaatcgaagcttcccaggagaaagagttcattcatgagctgtaggaggcctcgcggcccggccaggtggagcctcctgaagccaacacctgtgtattttcctttttggaaacaggcgagcccatcgatcattaccatattttaattgcctttcgcaaaggtcatctctaattatgggttgcgaggagggttggtcaggagtccgtggccctttattatctgtgtgggtgtgtgtgtgtcgccgcagagacaatgcgcccagctcttatagaaatgccaatccgagggtgtccgtgcgcgcctgcgaggcggtcacgacgtgctggatccacgcagaccaggctgcgtgcacaataaaagccgagcaggcggctgagggccgcgcagacccacgggttttctttttagaaacagtggtgcgaagagacttgacaataataacacgcagcaggattaaatcagggcgggaataaggaaatgtattttcgtttctagaaccgcggactgtgtttaacccatccgatcctcccctccccagagcattttgtgcacacgtggagttccgcgcagggacaggcgccgggcacagagtggcttgggactgcccgatgacgttccagggcagccacgttacgttcatattaatctcttcccttaattcggcatggttgtcagttacagtgacgtgaaacagccttaacgatgtctgttttatgggaaacaatacctggctagttgaaaaagagaaagcaaacgttgaggttttttaacttttgaaagtttgcatttccttagtttttatcactgtcagaaacccttgtggcaaaagcctattttaacttcctccgagggagaagagcagtggagaaggtagatggagggtcaggggttcttgggaggatattttggagatggagggaggtggagatcagtgaagagctgtgagtcaggggtggtcagcagccactctgaacttgattttctcaaaggagcctggcacttctgagccccgatgctgtttctggtagtccagcctgacaaagtcagaggctggggtcaggagcctcagagagttggagagttttgtactggtcctgcttcctgcctgcccccacacctggcctcctggcctcaccagcagccagctctgccctgaggaaggcagagccagatgactggtccaaccccccagagaccgcctggctttctcctcccctgtaatcataaccagatgcacttaagcgcctttcatcagaggaagcccaaagccctttaacaggcttcaataaaagccttttgagggcctaccagcctgctcagcgttggggcccctgtgcccactttccacctgagccagcctggggctgcagtcagggtctagcctctcccctggggccccagaagccaaggaagtttactcaactaaggcaacctctccaagcaggtagggtgccaagattcctgccaggtgtgtgggttcagacctcattaacaggaggaaagaaaggcatgggagggaagccagcagctagtgtctgtcttaaggaaggacaagaaggagcagcctatgagaaggaaccagaggggctaggaaatagagccggggtgaaggggcagtgatgatggagatgttcacaaagactcccatggtacttccaccaacccgaattcagaggtcagagctgctgtcccactgtgttgcagtctgtctcccttactaaactgtgaactccctaaggggagggactgtcttattcacctttgcaggcccggcccgggacctggcacaaaataagtaatcaagatgggagatcacaagctacgatggaaaactctggatcaagatgcatacgggcttaagatgggagctctgcccccagtggttgtgtagcctatctgagcctcagtttccttatctacaaaatgggtatgagaatgcctacatcaaaaaattggagaaagatccgatgaagtagttgcaggtgaagcaccaggaagatgataataaagtttttaataaatactgtgccctagctgggtgtggtggctcaggcctgtaatcctagctactcgggaggcagaggtgggaggatcacttgagcccaggaggtcaaggctgcagtgagctgagattgtgccactaagtgacagagtgagactctctcaaacaaagcaaaactagatagatagatagatagatagataatctcatgcccttgctcttgaaggagtgaagagaggatttggactgatattgtttgaattgtaagtaggaaggtttgtgttacaccctagctaggcacaggtctctctggcctgggatttggatcagaagaaggaattgtttctaaactgtgtgaattggagccacaggaccccactgcactgtccaacagggcaagcagctccaaagctgtgaacttgggaagccaagccagccttggtctcaggctctggggaaggggcaggtcctagacccttggactctcctgcacagggctggttgtggctggggcctagttgtgcactgcggaccaggctgctggagatgagtggctggcagataatcccagttggtgctggctttctgtggtcaagaggagaactgccccttcagctttgacctctgctccagtaatcatggctgtattttatttttggcgggttcatcctctggcatttggcagggcggggaggggaagcggggttgcctgcgtctctttgctattccttctggtctgctcagtagctccccacctctcatcccccaccccaccccacacaatgtggcctggttttctccccattgcaagctgctttatcatttttgcctgttccctggctgctctgcttgtttgagagtgggggtaagacctgggctctccccattcccctcctcggtccatcacattccagatgtctttcagcccctcctcccatctccctgagcttggcacttccccaggagggcagcctgagggtcagggtccatgggccgcctgggcatcaggggcctgtgagtgcctggctcagagaaggaggaaatggtgggggacagaggccagctgcactgctgcacattcctagctttgtgaatggaagctcatggcatttggtgtgtgacacaagtctggtagtcggggtcagaatgaaaaggtgtgggatttgtaggggaattgggaagaaaatgaagtaagctaacacttcttgcataattcatccctccctatccctgagatgagcaccctccaggagaggcaagaaaaacaagagagaagagaagagaagggagagcaaaaccagcctggtggaaatgctttgcccctctcccttcctgcctagggaactggctcccttgtgcagccaatgtaggtcaggaggggacaatagttagggtcctttacccagatcctctagggaaaatgtgagatcagatttgaggaagacacaggtcactgtcctacagggatttcagaaagaataagacactgcgttatcaaaggtgggggatttgggttatgatcagaaatttccttaaaaaaaatttcctgcctgtcacacttttgtttttaacccagttcaccttcttccatggatttagcaataagttatgaaattgatctcttcccctatagcatgtcagctacaagggagctcagaagcaatttaattctgctcctggaatctgtgggtccagaatttggtggactcaacagctggaggctggaagcatccggaggggtctttactttatgtctggctgttggctgggacctcagctgtgtcccatagcatgagcacagggctctctatgtggcatgggcttcctcacagtatggtgccttgagggtaataggactttaagttacaaatcggcagctcagggctccagaaaaccagcattgcagtaaataaggctgaagctgcatcaccttttttttttttttttctgagatggagtcttgctctgtcgcccaggctggagtgcagtggcaccatctcggctcaccgcaacctccgccttccaggttcaagagattctcctgcctcaacctcctgagtagctggaattacaggcatgcaccaccatgctcggctaatttttgtattcttagtagagacggggttttagcatgttggtcaggctgttctcaaactcctgacctcaggtgatctgcctgcctcggcctcccaaagtgctgggattacaggcgtgagccaccgtgcctggcccgctgcatcaccttttctaatccacccttgaagtctatattcattggttgcgattgtggtcacaaacccatccagattcaaggggaagggacagagatcctacttccacttgggaggagtgtcaaagaacttgtggccatggtggggtgggggtgggggtgggaaggtggtaggggaagccataccaggcacctttgagagctaagcttaattagcagtagctctaaacagactagtctacattgtaataggggtttctaccctcaagaggcctcataaattatatgggggcagggggactcagagagctaaaattaggccagggtaaaagaaatagagcctataaagcaaatatggattttaggaaaaatagaaaatatatcaagacagctgtctctatgatcttgtccaatgtgggaaggactgagggagaactgagtggtgggatcagatgggttttaggctcttctgcattgaaagggaagcaggtaaaagattagcattctatctgccgccatccttagcctactgtcttggggaagatctagtaacccttcatcgctcccaacaacattattttcactattgccttataagtcaccgccccctctaccaccagtatacagctatctttatatggtacaaagctaggaatgtagtcaatgcatttcctgtagtgtgtatggaaaaacaattaatacttactatttgtgccctccctgaggtgtggttttaaatatccagcatggatagtgttgtgactgaaagggcctgggtacatctctagggccccaggttcccattatccttgtctctaacccctgaatggagagtttgacttctaatttcatgctagaggtttcacgggcataattgtatttgcctctgcctttgatctgctatttgatctgctagtttattgtgggttcgactaggagacacagatagaaacgtggtggaaaacatgattttgttttgcttgggaattggcagttattattttctatggctcccttaacatgacacatcttccctaaatccaaaatctaatcattttcccatttttgaaaatccaaaaggcatgtgtaccctctggcctgctttcctctcccctcctgaagatttcattttcagtaagactttggaggcatgacgttcagattttagacctcagtgcagattggagccccgaattagtgtaatacacctgggtgaactctgccacacctgcccctttcctgacctcaccacggcttcccaggatgtatctggttcaccctagcctcccttgaggtgattttgggtctgcagggccaactcctatcctgagacccaaacaaagaaacccagattcagcaggtgggtcagaactaagcgacattcaggggatggcccttgaaataagctggcttctcaggcagggtcactgtattacattgtacagtttgtgtactgcacaaaggtccccagccaaaacacagaataggctactggcagctctgttctcagggcaaaggagaaagagattatgtctctgatccagaagaaaagagaaggtgacacaggacagatagaggtcaaaagggtttcttgggagcacactggatcagcctaagactggaccaagccagtgttgacccagcatgttggcgcggtaggcctatatacactctctttgttttgttacctctcatctgcaggcactggttcgtaagttattgggtccctcctaggccttatttggagtgtgggtgggagaaggacaggagtgtcaccctacttatgtgtcttgtttagccagcaagatgggatttgtttcttgggcagagggagtttctttggtttatgaatatgaagattttaaggcatattgttcactgcagaccgttatgtacttgatgtaggtgtttgagtgcaagaccctaacagggctaggcgcggtggctcatgcctgtaatcccagcactttgggaggccgaggcgggcggatcacgaggtcaggagatccagaccatccaggctaacacggtgaaaccccatctctactaaaaatacaaaaaattagctgggcgtgatggcgggcgcctgtagtcccagctacccgggaggctggggcaggagaatggcgtgaacccaggaggcggagcttgcagtgagcccagattgcaccactgcactctccagcctgggctacagagcgagactcagtctcaaaaaaaaaaaaaaaaaaaaaaaggggagaatcggcctggtttctggctcacacctgtaatcccagcactttgggaggccgaggcgggcggatcacgaggtcaggggtttgagactagcctgaccaacgtggtgaaaccccttctctactaaaaatacaaaaattagccgggcatggtggcgctaatcccagctactcaggaggctgaggcaggagaatcgcttgaacctggcaggcggaggttgcagtgagccaagatcgcgccacttcactccagcctgggcgacagagtgagacgacgtctcaaaaaaacccaaaaaacaaaaaaaaaccccaaaaaacaaaaaaacaaaaattagccgggcatggtggcatgaacctgtagtcccagctactctggaggctgaggtgggagaatcgctccagcccgagagccagaggtcaaggctgcagtgagcccagatcgcaccactgcacttcgacctgggcaacagagacagaccctgtctcaaaaaatatgtaaataaataaaaattaaaaaaaaaaaataaaaaaggccgagttcggtgactcacgcctgtaatcccaacactttaggaggccgaggtgggcagattgcctgagctcaggagttcgcgaccagcctgggcaacatggtgaaaccccgtctctactaaaatacaaaaaaaaaaaaaaaaattagccgggcgtggcggagtgtgcctgtagtcccagctactgaggaggctgaggcaggagaattgtttgaacctgggaggtggaggttgcagtaagccgagattgtgccactgcactccagcctgggcgagagagcgagacaccatctaaaaaaaaaaaaaaaaaaaaaaagtagaggatcatctgaagaaagaaattccaatcaaaattaaacaactccaaaaaggaacttttctagtgtcagtaatgggctggttgaggaggtctttgggagccttctttttattgattgactgattttttttttttttttttgagacagggtctcgctctgtcgcgccgctgcactccagcccagcctgggtgacagagtgagactacatctcaaagaaaaaaaagaaaaagtaatccggccgggcgtggtggctcatgcctgtaatcccagcactctgggaggccgaggcgggtggatcacgaggtcaggagatggagaccatcctggctaacacagtgaaaccctgtctctactaaaaaaaaaatacacaaaattagccgggtgtagtggcgggcgcctgtagtcccagctactcgagaggctgaggcaggagaatggcgtgaatccgggaggcggagcttgcagtgagccgagatcgcgccactgcgctccagcactccagcctgggcgacagagccagactccgtctcaaaaaaaaaaaaaagtaatccatgtcaaccatctgatggtggagggggatttcagatctctgtaccatactttcccttctccattcttaccatagcactagagcacaatgccttactaaattcatatccagtgtttactttgtaaccacatatatatcattcattgctgagccaaatgagcttcagtgattgcagttcctttcttgtaagatttttttttcctggagttaataattgcctcatttttatatttgcctaattttctttgacctatgactacttttcccatactttccaacctctgtacaattaatctgaggacaattttctgcatgtccaaatcttgaagaccatctgcaaatgggctgatctttttttgctttgtgtttctttttttaatccctattttctttaaatctgaaaactttttcaaaaagtttccaatcttccatttagttttattttctaaaacttttggccgggcgcggtggctcacgcctgtaatcccagcaatttgggaggccgaggcgggtggatcacgaggtcaggagatcgagaccatcctggctaacacggtgaaaccccgtctctactaaaaatacaaaaaaaaaattagccgggcgcgttggcaggcgcctgtagtcccagctactcgggaggccgaggcaggaaaatggcgtgaacctgggagccagagcttgcagtgagcggagatcgcgccagtgcactccaacctggacgacagagcgagactctgtctcaaaaaacaaaaaacaaacaaaaaaaacacttttatgaaatgcggtgggagtttttactgatttcaaatggggtattgtgttttggtgggaaattgtgtctgtcccacccagctaatgtcaagagctgagaaattaatccagagtttctgatatttgatattttgcttggttgaaataaactttcatcatttttcctaaacaacaacttttcagaagtaatgactgttagccccgggaaccgtggaaatattcagtattagtaaatctttaccctcccctcccccccgaactgattctacatttttagaaataaagattatttttaaaataattggcctttacccaggccatttactgcaagattcatgccctttatttacgttcacctcacggtgccttttatttgtgttcagtcatttacaagtctgcctttccaactagattgtaaattacttgagggggccaaaggtgtcttttaaaaattcacttctgtacttttggatccccctaggtcctaacacagcgcctcgcccttagcaagcgctccataaatgcatgttaaattcaaaaagtggacaaataaagttccagtgttctccaatcaggagccctaaaccgtggtaactctcaaatcctctctggcctcaacagcgccctgtgaacggtgggtaggcctcgccccccacccccagctgcctcggcaggttgcctctggggacagagttctggggtgcgcgggagaagcgataacacgttgaccatcgcgggagtccgggaaccagaggtcgtttctcaggattaaaatccgctccagcgtttcgaggaggggcgacactacaggccacgctttcaccagggacggccgccccatcgtccccgacctgggtcagcgtggcccgcagcggggaggggggcctcgggagggagcgccccccggcagcccgggaacgcccgcgcggcagccccggcccagcctgcggctccgcggtcctaccgccgggggcagcgccgcctgcgcagccgggccaagatggcggccggtgcgcagccgcccgcgtccgggggagaagcggcgacagccccgtgtcagccggggcgcgcgctgtcccagggcgcgaagccgctcctcctttacccacggggaccccgagggccagtcctgccacttcgtcctgacaggccccctgcccggagccctacctggacgggccccggctgggatcgggacggccaggaggatggccgcctggctagacatggtggacaggggaccagcggggaccactgggtgccagccccacacccaagccatttcttccagccctgggacacctctggtgcgcaattcgacattagtaaccgcaggtagggcttcatgccccgtaaaaacacagggctcaaagcacttgaaatcaggaatgtcttggaaaatctgctacttctggttgtgaaatccacggtattctctagtaaaggcagtaaaggctacagaatatgtgcggttcctcacatttgctgtgacatcggtatgcgcgcagtgtaggctgcctgcctcctaggacactccaaaacctgaggtccaatttaccagaaatggcattgatgaatgcggtgcattctgagtgatctcccgctgggctcaggttgggaggtcagaagggcccccaaagggagcagctaatgcaggtagaatcacaatggtagaaacagagaagtacccagaaacggttccccattaccctttgtaaactgggttgacacctcccactggttcaaggttccaaccaaagtttgcatgttgtttatcagctcagcttgagaggcagaatgtgaactttttggttttgttttggtgaaatagtctttctgcataacatttgcaccggcttgttattcttatggaaaacacttcctccacctaccctgggcagcagccacaccagcctttacttccttctgcaggccctcttaattacctctctcttgctccagtttaggcagcccccggcactttgttcaagtacagcaataaacccaagactgggcctaatcctctgtggtcctgaccttccccacagcgggcctggagtctggagggcctggagtctggagggccttcctgctcccctgattagggccaaggacgcagcttgatgtgttttgtgttttctcccctctgcacacttggtacttttcagagtgcttcactaaaaaatcagatacaagaaaaagttcacatcagccctttggagccaggcctccgtgagctggggtcaccccaccaccaagccaaccattcgacttctaaactgtagccagggccaatgggttaccgctgaccttttgcacaccgaattcctctcctagcgttagctcgggtggccagggagcctcagctgcacccacctcctgcccggtccagtcccgatgcccctcgcgggaagcgcggtaaccttaaacggcacgacaggcggctggccgagctggttcggtgacgactccctggagacagcggcttcgagcagcaggccccatctgcagcgcagctgaacgagttaagctgccccaggcgtgagcgtaccaggctggggcctggacaggagagaaccggcggggggccccggggcgcctaagccctaggatttccaagttgcagggggaaaggtgaacctgactcccctcccgaagggctgcgtggggggctcagaagactcctgtcaggggttggggaggcgcctcgaagcggggcccagagtgaggctgctgaaagggggcctggggggtaggcggtgcgccctcgaggccacctggtcagtaaaggcgcttctgtgctgtacaagcaagacagcagttgtagcacccgaccctcgggctccagtggcccacggtgcaggcgggcaggggaagagtggctctgcgcgcagccccgggtgccctaaggtcacctcctcatcccctgccgctgctgtgccgccccagccctacccccgccccgaaaaaacccggccgcgcgggccagagcctaagctgcacgggctcctgaccccggctcgccaggctcagcccagtccgaccccgcctcggcttcacaaaggccacgtgcggccagggccgacaaggaacgaccacgactctcagatctttaattacgctaggagtccctacccttccccccaacccatcgccggcttccagccctttaatcaatttcacgatattaaatattaatttcctgccagccacggtttctcggaggagggggaggggatgggcagggcagctccgaggctggaatggctttgcagggtgtgaccacgacagcagggcgcggaggacgcgcggattcctaagtgagctgtgcccagaactcggagccactgggttttcgctctgtagctggggaacttggagagttatgagcgcctgggtgcaggcctccaggaggggcagcgaggtgcgcggagagtccgggtgtgctgggcgaccgcctcctgctccgcgcgccccccctccccaccccagccgcgagtcagcctcacgcgggcccgcggcgcgctgcgatgatggatcgcgcctggcgggggtgatttggtgttgatcgcacattatcactggcaggttggactggttgctgatggacgacttctagcggcggcggcagcagcgtcttcagacaccgcgctgggactcgctcgctcggcgagggtctttcccccccccacaccccctccctacttccaggcgccaggagggcctgagagtccgagtggggtctcctcgcgtccaaggccgcccgctcccgtctgggtccgggtgtgggctgttggctgggtgaggagaggagccaggacgcctctcccacttcctcccactcctccttcccttgccgcctgctccccacccccttcctgcttccccaccgaaacccggaggccctgggtcactccgcgggtgatatccacgccgcctgaccctggccgcgggggtgcggactcctctgctccgcagcccccgaccctctcccccggtcgcagcagccgcggcactgcggtgcgccccttctcgcctctttttctaaagtgcctgcagatacaaaagcggtttcgtaatgccttccgtctgcgagagccggaggaccttggctgacctttcggaaactgattgcaactgcctgttaacagcccgtactgaccgcactgagcggagcggaggacaatcatttaagtgacagacggcgaggtggccccggctcagtcgagcggcctggttaagcccgccccgcccctcccccgaccccctcccctcccgcagctactcccccagccccgggcgcactgcgggccgcggcgggcgctcgggcaggcggagaggacgcgcgcgcgcgtgcgtgtgtgtgtgtgcgcgcgtgtccacgattaccggccgacgggttaaccctttgccgagcagccggtccctttgaggccgggtgctgccggattaatctgccatctgcaaaagaggaataacagggccgtctccgccgactttccctaatgggtaaactgtaccctgttagcgtgacccacgctgcgtccctgctgctgccagggaaagatccggacccttggctcttctgccgcggccctgggtcccctccctgcactgcccttcctctgcacagacacagacacaaggaacagcacgaggggtccaaaggctcccaggggctcgcggtgcagtggacgtgggtgttcccggtgttttctattttggaaactggagaaaggtggggtgggggggacgtagagaaaagccgaggtgggggaggggaggctggtgacagggcacctcgggcttcgctcgctccctctctcgggagagatcgccagctgctctccaacaggcagcgccctgaaatctatttaaagagagggaaaggggaggagaacaaagggggaggagggggacggcgagcggagcctgggcgagagcgagcgagcagggaggatccgccgctccgcgggcacatcaagcgctcacatctgtacactccgcgatcgatggggagaatggataatatttgtcagctgcagacctttctcttcccggttcctggggaggggagggggcgaggagggggaggggcgggcaggccaggcgagagaggccgcctcaaggacagcgcgcttcccgctgcagccacacggaaacccagagccatgaaagccgggggatttttctcttattatcattattaattattttttattattccagagcagccagcgaacgctcggtggcgcccctcccccgccgcctccctttgttgattctcagctgctagagcggcgggcccgagccgccaccgccgcagagcacgatctgctcttgcgccctcggtcgcagctgcggcccaggaagccggggctgcgtccccgccccctgccccccacggcgcggcagccctcgcaccccctcctcgcctcccgccacgaggccagccctgcctctccactgcctctcgctgcggctccgagtccccaacgcagagcagaggcactggctgctgcggccccgagcctccggccgcgcgggggcctttgccaccccctaacccccgcggctgcactctgatgccgccgtcctcacacatggtcttcattttgcacactagcggcgtgcttcctctcagctcctctcctcggggcttttcggagcgaggagggaggtttagaggaagttagaaacccagcgagcccaggggaaagggggaaaaccctcgctcttagtctcagcttccgaggcagagggagcgccccgcggggggtggggcagagtctgggtgccctccccttccttggatgcaggaaaggttaagtgaggggtggcggtcggaggagcgacagatttgcttttgctcatccacatgcctgctcagaccggcctgggtatcactgacccggcactctcggaacggcagaacccggatgggagcagatccgccaagcggtcatcaaacaagaccaaagacatttcagctgtcccccaccctcgggccttgggcgagggtgggggtgccccctgggtctttgcttcctcgcgcaccccaaggttggaaggccaaagccgacgcctcacagaccgggggtccgggccccctctctagggcggaggtgtgcagaaagctctagtgcgagtttacttgcggcctggctaccccctccccccgccgctgtcctgcgattccgggccagcctgcggcggcgtccccgactgctccgcggtcctgggcagggcaggaagctggcacggccgacggctgggcaggcgccacttggccgggcaggctgctcgctggaactcgcgcggcaccttcgcgccgaatcgggttcctgggtctccagcccggtcaccctgagcggtttcaccccccactttgaccatcggcctcccgcggaagtctccctgtctcctcccgccctctcggcttttcccttcctcattctgtctcgggagctccttaatgcagtcaaccgcctttcccgagattcaaaaagaagttttgtgtttccccgggggcagccgcctaatgcttcccttgttttccggaacaaagcagacattcagtgaggagggggcaggcgctgactccctcccctccccgcagcaccccgcactcctgcagattcagaacgctggctccggggcccgggtggcctgggggtggggtggggacccccttcccctaggcttggccacaaaagcctcgcccggtagccggagagaaagcggcgtggtgtttgggtgaggttcccagcccgggcggggagggcgtgcacgcggctgtttacagtgtgcctgtgctgctggaagctcacccgccgccgcttgacagcgtggggcacccgctggctgccagctcagaggagatgcgcagcggcgagccctccagcactccacccgaggcctccgcagcgccagggccagggcgcgctgggaagctccaggtctccaaccccgagttccttcggcccacatacccctccccgtaacaatggcctagatccggtagtatatcaaagggacggggtggggaggggtgaagagcgcacaaggggcgctcagggctgtcgaagcgcctgggttctgagcatatccccgccgccgcctgtccccttgcaggactaaattccccggcccgagtgagcgaaagacaaatactctagtgacttggaggtgtttctctctccggatacccccctgcaaccccaccaacccctacccaccgtgcccagtgaacttctctccaccccaccccgtggggaccgctgcactagctgtgcccacgagcgccaggccttctcgtcggcgcagcgctgccttagatcccgctccacctcttcccctctcctgggcctgtggccggcccctggcgcctccagcgcggcctgaaacttgatctcacgtcgaaaggacagtgtgtaaacaccaggcgcgctccgagaacccacgggaggggccgagcgagggccgccggggcagctcgaggccccgcgcccccgcctgcctgctcgcccgggacacgatcggcggggccgccgtctcgctctctgcctccccagttggctcagctaattggagccgccgccgccgccaccgctgcggcctcttgttgaattttctagatcgcaaccgttcagtcgtggctgcctgtcgctcccctcccccttccacagctgttacctctgccggcaacttggtggtggtggggacccgtccccccgctgaccctggcctcaggctccgagttcaccccagcagttccagggggtgtttttcttcgagacgtgggaagggaggtaaagccttatcggaactgtgaggcttcgtgccagaatccaaggctcgggtactagccagaggatcctcccggcagaaggccatggtcctccctgtcttacaccaggaggtagtgacagtcccggagggaggggctccaggaacaactctgctggcgacttctgttcattccaggaaaacattacagaagggtgaggtgatgggaggcagaaagatcccccctccctcctgcttgccccaatccctgtcagcacttgggcatttgggacttggtgtgtaggttccttctgcagcagagctcacctgcgccttgggcctaatccacccacatgccacaaggatgcttttcctcttggtttggagtacctggtgggtccaggggggaagtgccacccttagtgggttctggaggtacaactcccccatgctgggtcagttctatgcttgtaccaggaggccctcctgggccttggtccttcccagccatccccagccttagcctcctttccccttggccagctgtctcatgccttaaccacacatctgtgctagctgcaaaaggtcccgcctgtatggatctgtaagaggcccagagctcggccccatggttgaggtgggaagatgtgaagcagtttgctagtgcaggaatcatgaagatattgttgatgatggcagagcagttcctggtctccagcattgccttagaatggcttttcctcgtggtagaactttcgctagtgggtttcacaggctcagggcccaatcttgtgaaagtagctacactccccagcccggaaacacataaatacacataggcaaactcccaggaggctgggtgtaggaaccaccaccggggggatctgcagcagccagagaatgtctgcttttcctgtgatggttctgagaagggcgcctgttccctccctttgatggttctctgacaactgttaggtaacaaagagtggaggccacaggctcattaactgtcattttccacctctttcctccgcttctaacttttacccaaattactactttggagttttcctgaggtgttctctccatctatttataactagagcaagatttccaactcaatccttattgatttaaactatgataaaaatgaatccataaaattattattataatttggtgtctaagatgacatttcactaggtcaagttcacacagtttttggcatctaaaatcccccaggcctttccaatcagataacctaagtgtgtttcccactgtcagtttctcttccctttccgtagtggaaaaaaactgaatcctctcaaagatgtttattctccttcactcctaccccatcagtctgtgagaaccttgtttctgtttagggtaaggtatatttctatgttttgataaagaagagagtaatacatgttcctcttcaggcctgaaaagataattatgcatcctgggagcttgctcttctcctggctgtttaacggacaatctggattctggctctggagcaggaatgcttcgatgtcccagtctccttctcgtcccctttcctctgtcaccactcagccatcaccaggcctttaggcgggtcacacggcctgaggatttctgttctgaaggctcagagtgcctcagaagattgcagctcagagcctggtatcatgcattcacatttcttttactgtgcaaagcatattcggagccattgggattcctgttccatctctctgaaagcttatgccaagagctccccatggggcctatggtgatggatgtcatgaggcccaggaaggagccatcatggtgggaagagttgagagcctgcatgtaagactcagactcgaaccaaacctaagtgcaaataacaaggaaaaaaagcaactccgcgcacctggctggtaccctgcttggaaacaaaccgtacctccccaccctcccatctcaaagctagtagagcctaggggcacaccattcctttggcttccctttagcttgacctgggaatggcgcagttaagcatatcaggaagctgagatgcatccactactcctcacttcccctggcgctgggctcagcttggctgaacttgccgttcctgtctttttagaagagctggttgtgttcccgaagcaggatcgcactgtgccgcctccccaggggtccccagctattgatttttaatatccgtattcaatattgtgtattaaacattgaatccatgcacaagaggatgtgatgcaaatcaccagccgtgcctgagactttaatagttgttttattgcccggaaaccacagttggacgcaaggcatcctgcagccgaggctgggggtggggatgacaggctgagaagagagctgagcggagcggagcagagcagaggatacgagatctctgaaatccgcactactgaaggcacagccaggcactaacagctccccccaggcaggctggtggggggccggctccaggctgttgtggaaagagcaggggctgttgtgtgagacccgggcagaggaagaggtgtggggctgtgttcttccttcctggacttccctaactggactgtgcattcctgtccggcagtccttcccctccatgcagatgctcacccagaaacacatacacaacgatggaacaggaaagttaactttggggcaggaaaccccaggcctcgggcctcttccaccactcttcgcgctgtgaccttagcacagacctctctcaacccgctgggccccatttccctcctttgccaatgggggtgatgctatctgtcctacttccctcacagcgctggtggtgaggctgccgcggcacatgagataatattcggggaaaaggcttttgtaaattgtcaggccccacgtaggcaggctgagggattagtgctggctttccctttatactccctctctcctgcaggctgtgtctcctggctgccttctttctcagacatgggcctcctcccccatgaagggccctctcttctgtttcctcggccacctctgcttgatctctcaggcttcctgctctgcctggactctgcattcaggctaggcaatccggtttggaggaggcccagcagggagaaaggaagggtgagaacgactgagtgtgtggtgggggtgagtgcagcaagtgtgtttaaagccaacagcctcgggagggaggagaagcacactcggtagctgcggccctgggttgcggagcccgcgggggtggggccgtgggtggggggcgttgatccgccccgtgtgcggacaagcgggagaagggttgagggaaacctgagtctaggagtgtcttcacgttacactgttgctggttatgggaagtccagcttgaatcccgattgctggaaggctagggtgtgggcagtgccttcagggtattgcaattgcgaaggccaaatggaaatgcggtggaaagtggcagccctccagcgccgccaagtcagataaaaagttgcccgaggccctgagagtggaggcaccagctctctgatggccttgtagacgccctgagaacagtccgagctcctcaaacccgctacctttgtcctgggctcaaggagggggcggaaaccagaggggcccggattcttgaagacctcccctggggaccccactgtctgctgggaaggcctcagccaactgtaggcccaagccctacagagaccagctctggcaggaagtcatgccaagagtctgtgtccgcgtccttaggcgtgagaatggggctatgccaggctgggcctggctgcgcacgcctccgcttcgggactcgggcggctgctgctgccttcgttttcgggtcttcgaccgagcctccctggctctctactcccgctttgtcttgctgtcagcttctcgcctgtcctcgccagtctcctaggtcggcgggtcgcgctctgcctctccgagtgcgtctttgcgcacatgtggcggtcttcctgcaacctgggtcagctcggcctcttcccgcggggtacttggctttgcctttggatcgctgcgagtgtccacttcttgcgctctccttctccccacctcgccttaggcagacgcatcccgggcttggcggtcccccaaacagaaatatccccgggtttctggtttagctccaccaaaacaaactcgagggattggggtatccttcacttgcgtttcccgcttctctcagccctaggccgaaactggagggtttttttgttttgttttgttttaatgagacctactttgcagagttgacggggaacatttctgcggcagacttcgaggtctgtggcgctctcccaactttcaagactgtaagccgccaagaaagagaatttgggtacatgattttgccgctgatgtgggctgggacgagggtatccagagtgcacgtgcatgtgcggatcgcagggactctcggtggattagccgccaaaagctggggagcgccgcgtatggacgctagggctgggggccagcggggacctacaaacaccccaggcggccgagcaggtgaaggaaacgttccgagcccgccccctcctcccgggcccgcacgccgccggcctttgcggcggaaacacggtccaactccttgaaagtaaacttgccgccaggggctaggggcgcgaagaaaggagggggctgacagcggtgtctgcgtcggggaggccaggaaggcttgtgtcaaatttcagcccccaatgacactcggtggcgaggtgccaaggccctgggaacggcggcgggggttctgggtgagagtgatcgcgccgcagggcccagcttgcgaaccccgaggcgcccgcagggcctagggaggccacgggggcgggcgcggcgggcggggagggggcgctcctagagcctcctgagcggagcggacgcaggcatcttccgcaatccattcatgcactgaagcgcgtgcagagctgctgatcgctgccattgttactcgcgggcggtgtgggagctgagcctccactctggcgagagataaatggcctctgacagcccctcctcgccaagagagctcctcggatttcaccgcgcggcggctctcaggtctgtgcctcgctcgcttcccggtgagaacctttaaatcagcctctcggccctccctcctcccggacactgtcccccgcccgctcaggccccggcagggccccgggcgcgctgtgtgcagtctcggggtcctctccccacctgggggttaaacagagtgggggcgcagggaggacctcagggccgtggggggaggcaccgggctccccagccccggctccgcgcctccgcgggagcggagccccgcgccccgcctccgcgcccacgagatggatcaggctaccgtgcggagagcgggctgtaaatatttaaaaagtctctcgcgcgccggcagtaatggctttcgcagtcggaatgtgtgctaggggaagaggaagggcgacgtgtactgtgttgcagggtggggaattgttcctacgcttccccttaggtccggggtgggctgcatgttcaggcttcccgatttcccgccctccgcctctccgccgccgcgtcccacgatagcatcgagaacgccagtcgacagggaacttgagcatagccgggcaacagaggcccggtcgaggtgaccccggagccaccctccccaccggggtctcccaagctcgtgggttgcgaatggtcccagacccctaatccgggtccgcttctcgctgctgcacaggggagggcgggaaacgcacagattggagccccctgagtttgggtggtcgcaaaagcctgggccggggtttctgcagagggggcctggaccctgtttgtgcctttgctaccctccccagccgctcttaaaccttgatccgctctccaggagacccccacccctatctgaatctgaaagtagctttgtggctgctgggaccgaaacctgggaggaggcagcacggagagtttggggcggggagggggtagcctccaggcttagtggaggtcacacgtggacctgaacggggactcttttgcctttctggtgagtgtgggcctgggatctttaaggccaagccctgccggatggtagaggtgggggagggggattcagccttctcggcttggctgggagagacttaatgggcccaccacagggtgtgtgtcgggtgaggttgtcccctttgccagcggccactccctagcggggcggaggggctgagttgcccagagctggggcgggccgggcgccgcgggttcgcgcggaaggttccaggggtgtgggcccagtccggagctgttcgcctgcgccccgccggctctgggacctgccaaagtgtgggtgctggcggcgtgtcaggacgcgccaggctgctctccgcgttcgagcgctgggagctcccgactcctggcagctccgtgcagtcctcttccaggggcttgtgttgcgcccttctcgcttgtttgtctcgtgtgagcctcgtaaaccgccttgatttattacccagactaaatgcttaatttgtgaatatgaaacagattaaaaggggcggggggaggggggttgaggtcggcatattttagcaatcagaccaaagcagctcggcagatgtttcaaatttgtcgacattttcaggctcatgtggaaagccagccagagtggtcaagaggtcctttctccttccttcaacctgagaacttggcagtgatcaaaaggaggtgattagtagctacagagaaaaaacaccagcaggcaaggagttaacagagactgagccgttcacctccaggattgggatttggcggggagggggggcggtcacaaaggcaagaggaatcctggctaaacaggcgcaagtcgtggaagccaactctgaagaacaaagtggagggtccgttaaaagttaattcagtaaataaacttcattggtgataaaacaaataagaaagatggaaactccaacttaaaatagccaaaagataagaaaaataaatcgcttttatgtggcctgaacatgtgcatgtgtctttggtcaggtccccgcaatgatccacctaacaaaggcctctcctgagtaccctctccctttgaataccccacatgtatagccagtgttttttggcgtttgtcattttggggcaacttcacacatcaaaggcgagcaccgttttcttttcagctccctggttccagccacccagtgaagcagatacaatttctataaattggccttcttctccaggtttcgattgatcatcaccatatgagattactgaaagtctaatgtcttatttcactttctccaaggagtgaggaggggaacagtttattgaaagtcaggccacgtgaagactctggtgttgtgcaatagtaatttccattagcctggatttatcagcctcctgatactgccacctgatactgcagtctcctgcaggttccttgtaccaccttccctcttcccctccaggtctcagcatctgtccccatgaacaggtagagttcaaaccggagccttcctattggtaaggagaaaatggctgatgaccaaaaattaggaaacaaaagatttgttgttgtttctcaggacggagtcttgctcttttgcccaggctggagtgcaatggcccgatctcgactcactgcaacctctgcctcctgggttcaagcgattctcctgtgtcagcctcccgagtagctgggattaccaggcacgcgccaccaggcccggctaattttttgtatttttagtagagacggggtttcaccacattggccaggctggtctcaaactcctgacctcgtgatccacccgcctcggcctcccaaagtgctgggattaccggcgtgagccaccacgcctggccaaaagatttgttttttaacatatttgttataacttaagaatcccctctttggcttttgtttcctactccaaagttttttgttcccctttggccttgataccatctttcgttttattaaagttgattatggttcctctgtcttgtccctagccagacaaaggcttaggagaagtcaaaggacgtgttaattatgtttcttgtaaactgacttttcatttccccctaacacatttagttggcttggtgtttagtttaacaatcaattgctacaaatatgctgcttaaaaatgctgcttttattaaaacaaataaatgaattcaaagacctttctaatttcaactcgtgtgggctagaaacagaagagaaaatcgaaagcaagagagagggaaaggcggcagggaggggagagaaaggagaccaggaaacacacacagacacacacacacacacacagacacacagcattcctgctgccatccctccggaagccatgttaaactggtccatacaattgtccctggctgccccctgcagctcgccagtccttctggattttccatcacttggcgcctaaggcgatcattagctgagaatggacaacctcctctacctgccggcagctcagctcgtcatttaccagccaggggaggctggccccatttgctcaacccgagaggggtccttggtttttgcccctgggtgcattggtgcctaattaaactctatccagggcaacgtgcactaaatatacgtaggctgagaggaagctgggaggaaaaagcagtcattacctaggaagagaaagtgaatcttccgagagagaggaggaaggacccctgcgatggtgctttctgtttaccctcagcagagccttggagtgcatgttcacttgggtgctgaaatcaaggagaaatggaaatcgggaaaaaaatccatagcccacacatacctgaacagggcctatgtcaccacagagcaggagggaggtctgctgtagctccagacagtgttggctgcagaaaaatgactcaggtgcccttgtggcatcggagttattgctcatgtgccacggccccctcacgcacaggagctggagctgtataaatggccgtggggacagaaaggaacagatgtgtcaagagtccaaggactaggtgtgtgttgtaaagccaaacagatggtggaggagcaggggagaaccttcagctgaaggctaaagaccctactagcacctgggcccaggcaggatcgaagtgacccaacctgaagctaaaatgacagccggcaaacaagaatgtatgcagatgtcatacaagagccaccagggctttaattgagctctgtttaacccagtggaggaaatcagttgagagggtgaaaacactagctcagggtgacatgtttgtggcaaaagagaccagaacccagagctcccagcttcagaaaacagccagaggaggaaagtgactgctggttagagaaagatccagagtgctcttggtcactgaagaggcctggtattttagtcatttggcatttattaagcacttgctgtgtgcaaagcactatgctggcatcaaagggggctaccagcactatgagccctcaaaggactgagcagggaagactctcccctttatatgtgcctggtgacaaaggccatgaaagacagtgggtgaaggggctggggaatgggaggaggaagccaaccactctgggttccactcttgaagatagcagtttacaggtgggcatcgaggccagagggcaacctgtagcaatggacccctctatggcctccctgagccaaaccctacctggctaagcacctgcgcctgtaagattgtcctcccagtggtgggagtgcgagagaggccatcttcacttccccttccttggagggcctgactttgttgccctaggcaggccaggaaacttattctaatgccaacgaaggaggcaacttttctagctagaaaagcacacgctacagctctctctcttgccctgaacaagcagaagagcacagcttatccccaaaagctcctggacaaatgtaggctctctgggggagctggtaagggaatactgcctcccttaacaaaacaaacctgagaatctccaaggtttagcactgcacacggagtctcccagcagagaagggggctagcttaagtgccccatgcattccacctgccccttggggcgctctcagtgtgatcacaggtgcccttcctcaagccatctggcctgggcccagcctctgctcttggtttccctaagcagaggcgaaacacgctggaaccttcaaagcacattcctaaacactaagagagagctgtggggaagtgaaaacaaagaggccaaggagcgctggagcagttcagcttccagagtctgtgggccaacagggctggctcaagttcagtcagacttactggccctgggccaaccagagctggcagcgtgccctcttcagcccactgctcaggccccgtcgccccccaaaaacctgggcacaccccagagcaagcccaagccccaggaagccctgctgccccttggcagccctctcagaccaccccctcccccttctagttgtgggttgctagttccagagccagggaatggcttccaaaatcccttcacccagagcttcccaagagtgagtgggttgccaatgggtcaagacggggatcccccagcccctcagagtgaaccaggggtgacccaattccttggctggcagcttcaggccatgttgggcaattgtggacactcggtcactgtttaactttgtgcaacagaaaaatatcacattctgtgctgagaatcactgctcacttgtcataagtgtggcatccatgctccaagagttacccacacatacgaataggaaggatattggaccacatggtccttcgtggatggtgaacacagcatagtcagtgattcaactagcattcgttcaagcctctcttgtctgtcctgcactgtgcttgtggctgttggggtggctcggggaaacccccggttaacaagacccaggcccctccttagagaacataaagtctccccaagagagataagccccatggagctgaaaacttcattgtgcttacactaaaaccaggagaaagagcaatccctggtattactcctcaggcatagttttttggtttttttgtttgtttgtttgtttgttttaaatggggtctccatctatctcttgctgaggctgtagtgcagtgaggtgatcacagctcactgcatcctcgacctcccaggctcaagtgcttctcctgcctcagcctcccgagtaggtgggactacaggcatgtgccaccacagctggatcatttttcttttttttttttttgtagagactgggtctcaccatgttgcccaggctggtctcgaactcctgggctcaagtgatcctcccgcctcggcctcccaaagtgctgggattacagccgtgagccactgcaccccgcttaggtatatatatattttttaagccaaaggtctgatggtgtgtttctgcccactttacacataaagctgggaaactaaagactccctcatactcccagcagctgacctgctgaatgggacttgggagctgggaattccgtgctttctctccaaagggtccgcccaggtgacatcaagttcatggcagatgttatgggtaacacctgcacttggcagaaaattctaaggctataaaaggatgtttggtgcctctcccacccgcatttctcagtcactcagtttgcctctctgaaggcaaccagtgctcccagtttattgcttactcttcccaagatagtctattaaggctgattttttttttttttttgagacagtctcgctctgtcacccaggctggagcgcagtggcacgatcttggctcaccgcaatctctgcctacctggttcaagcgattctcctgcctcagccttccgagtagctgggattacaggcgtgtgccacgacgctgggctaattttttgtatttttagtagagacagggtttcaccgtgttagctaggatggtctctatctcctgacctcgtgatccacccaccttggcctcccaaagtgctgggattataggcgtcagccactgcgcctggcctattaaggctgatgcttaaaaaaaaaaaaaaatatatatatatatatatatatatatatatatatatatatatgtatatatattatatatatatatatatatatgtatatatattatatatatatatatatatatgtatatatattatatatatatatatattttaaattttattttgaaaaaaatcccaaacccacagaaaacttgaaagagcagtacaatgaacacccatatatgaaggcaggttttcaaaagcattatatttattcaacacgcctacccttggaaagaattcaaaaccccttcaaaggtctgaattagtttaactttatcttaaactgttacttaggagtacttttccctcatagacatgttgcctgcttgttcatccccctcctcccagcccccagcaccttattagtgtgcctcgtgcatagtgggcatttcctaaagcttgcaggattaaatagcgaagactatgtcgtagttagtatgggggagccagactgtctgggttcaaaacctggctctacaacttgaccagctgtgtgacctgaggcagttactctcgccaccttacttcccccatctgtgaaatggagggtagtgatacaatatatttaatgatgttgggaggattagttgatggacataaagcatgtaaaatagtgcctgggccagacacggtgtctcacgcctgtaatcctagcactttgggaggccaaggcgagcagatcacctgaggtaaggagttcaacagcagcctgaccaacatggcgaaaccccgtctctactaaaaatacaaaaattaggcaggcgtggtggtgggtgcctgtaaccccagctactcgggaggctgaggcaggagaatcgcttgaacccgggaggcggaggttgcaatgagccgagatcgtgccactacactcctgcctgggtgacagagcaagattccgtctcaaaataaataaataaataaataataaaatagtgcctggcatctagaaagtgcttaataggtgttagggacacttgagacttaaacacacttggtattaactttgctttggtgattgcatgtaagtcatttggccgagttgatggcctccgagttttccttggtaaccatgagagagacccaagaaaaccgggaatgtggcttcgtagtcgtccctcgcctgagaggattgcctacgctcagcacataagtagcaggggcttcttgtgaccagtttccactcatggagagtttctagctgtgcttattaaaaagatatttgaggccgggagtggtgactcacgcctgtaatcccagcactttgggaggccaaggcgggtggatcacctgaggtcgggagttcgagaccagcctgaccaacatggagaaaccccgtctctactaaaaatacaaaattagccgggcatgatggcgcatgcctgtaatcccagctactcgggaggctgaggcaggagaatcacttgaacccggaaggcggaggttgtggtgagccaagatagcgccattgcactctagcctgggcaataagagtgaaactctgtcttaaaaaaaaaaaaagatatttggagggaaagtcgccccccgtccacttcccttttatagcctggctagttgctgccctgctaatagaaccatctttgaagaaagagctagcatttgttttacccacagaccggtaagatcttctctctcagggtgaagcctaggctcacaaaagcctgagatcagaaagtcaagggttagagagagcaagtaggtgcaaccccagaaacctccactgtctggcaagccagagagtcttggggccccccaacagacaaagttgtctggaattttcttcacataggaagtgtagaatggtagatgtcttaagagccagaggcaagagaggactggggaaagataaaggaatttgtttattttattttatattttattttattttattttattttattttatttttgagatggagtctcactctattatctaggctgcagtgcaatagctccatatcggctcactgcaacctccgcctcctgggttcaagtgattctccagcctcagcctcccaagtagctgggattacaggtgtgtgccaccacacgtgacaatttttgtatttttttagtagagacggggtttcaccatgttggccaggctggtctcgaactcccaacctcaggtgatctacctgccttggcctcccaaagtgctgggattacaggcgtgagtcaccgtgcccggccaggaatttgtttaaaggtatactctgtgctataaaatactgcacctaatgttaggctttgacggctataatatctgactttgacattgaggtgtatctgccatataatttaattaacgtgtgatgccggcacaatgccagagagtcaaacattctgacagctcttggaagccacataagtccctttgaagttccccccagtgaagtgacacacagagaaacctcctatggttgaggacagcccctgatacggtatccagaaatttagctgcgtcttggttatattggatggcactggcaaagccacctgctggtttgccacagttctggaggtctgctgtggtttctaagggccccaaccatggagactggctctttggggaagaagaactcattcttcatcagggacaaaattgggaggtctcctgtttgcatattttgttctacaaaatgtttttttcttcctcaactttgcttagtgcaaagtcattgagctgcacacaggaacgtaaattaggtaagaggcatattaaccaaggagaaaaaagaccatagacatctattttgcacataattatttaacacccaccatacgcctaccaaagctttggacatttatagcaggaacaaaaacaatatcttggacatcataaaactacattttactggggagagaaaaagtacatgagcaataaaaatatataatattgcaggttgtaataaatactcggaagaattaagaagggtgtgaggctacagagagatggaatgttcttttatgtagttagttatttctatctacagcaggtagaacgagtgttcttttagatggtaggttgtgcagtatgagccttgggttgaccgagtaacgtgctcaggcgatatatcaataagctcttgtcacaacactgttgtatcacaaaccacctcaaaacatcagtaagcacttatttcctacatacatgtcagtgggtcacctgtggttcactggtctagaatgtgctcaacagggcttgactccaagtgtggattggatctaaagctgctccacgtgtccctcatcttctacggacaagtgggctacctgggacatgttcttctcatgacaatggcaaaagtgcaagagggtagagtgcaaatgcaatgactcttaagtccgggactcaaaatttgcacactgttacttctgcctacatctattggccagaagaagtcatgtggcctgacatcggtgggatgaagaggcatgctctacctctaaaaggtgtggacacagggggaggtgaagcactgggaagagtaatgcaatctgaaacaggtgtttcaaaccaaaactatgtatctctagctgtgacatttatatatacaaacacatatatcaaatgataaaacgacccttgttgaaaccttcagttttagattaaatttaaataaatccatgcaataattacattaccctccccgagatggtttatgatgtcaccagaggcttctgggtcattgccgccaatctcaggaaacctgggaagatgggccaccggccatcccaatgctgagagacaaaaaggccatgaagggccgggcgcggtggctcacacctgtaatcccagtactttcggaggccgaggcaggcagattacctgaggtcaggagttcgagactggcctggccaacatggtgaaaccctgtctctactaaaaatacaaaagttagccaggtatggtggtacacgcctgtaatcccaggtactcgggaggctgaggtacgagaatcacttgaatccgggagtggaggttgcagtgagccgagtattgtgtcactacacttcagcctgggcgaaagaatgagactcttttctcaaaaaaaaaaaaagaaaagaaggaaaagaaaaaagccatgatggaatggagacctttcttcctacaggggtttcccttgcaggaaaggtacaggtgggaaagctcagaggagaccccagaccgagcaagtttccttgcttacctctaagcatgtcttggagatgtggcataggatccaggaggtgtgactaaaagctagacttttagccagtctcgcaggctgtgcaggacacaccttcatctgttgtatgaaggtatatgagctggccaaagattcgcgttcttccttgcagctccttttccccccagttctgcccacctttctcttgctgtccttgaataatgtgggggggattcctaagtgtctctgcagaaagtgatgatttctaattttgggcctcctttcaatgaattcctccagggctctgcagtcagccaagtactggaacctagcccttccctttaggaaggaaagctcttggttcaattgattccgatggttaatggaatctcatcaccgttgcccagagtggttctaatcaaaggaatccactgtctaaaaattcaaggtagcagcatcaaggtttacatcttgtaagcaaagagactggggcactggggcagatatgttttatggtggagccccatggggattcagtctcttatttgggagaattctggctcctggctccaaaggtgtgtgagttgatccatcttctgtaactaatcctagcctggacttggaagggggactgccttttttattttttggtgtttggtttttgagacagggtctcattctgtcacccaggctggaatgcagtggtgtgatcatggctcactgcagcctcaacctcctgggctcaagtgatcctcccacctcagcctcccaagaagctgggaccacaggtgtgcgccactacacccagccaattttttatttttagtagagacaaggtctcattatgttgctcaggctggtcttgaactcctgggctcaagccatcctcccgcctcagcctcccaaagtactgggattacaagtgtgagccaccacgcctgaccatgtccttgatctgtaaatgacagtagcttttggaaactgagaaaataaaaatctggatcagacttcaagtcccctgacccctctctgatctggtcctcgtcttcccctctcctctggttccacagctgccacagagcacacccctggggcagcccagtgagtccctctacccattcatgccctcctgcttgttctgccctgggagggagcctcagcccctgagccccctgcctggagtgatccccctgctcaccctgactcccagctccaggccccacctcctctgcggagcccctcccaaatttctagggggttacatttcagtctaattctcccagatgcctttgtgcttattgtcacagccacaaaacttatcatttggttgctctgaaatgactttacgccttatctcctcgcttcagttgtaagttcttagagcacagggaccacagagcctagcaaggtgttaatacacatgagtgtacttactggttggatagcctcccatcaatttctgtctcttagtggtgtgggagtagaaaagactccccagatgttagggccaagaaggttgaaattgaggccgggcgcggtggctcacgcctgtaatcccagcactttgggaggccgaggcgggcagagcacgaggtcaggagattgagaccatcctggctagtacagtgaaaccccgtctctactaaaaatacaaaaaaattagccgggcgtggtggccgtcgcctgtagtcccagctatgcggcaggctgaggcaagagaatggcatgaacccgggaggcggagcttgcagtgagccgaggtagcgccactgcactccagcctgggcgacagagcgagactccgtctccaaaaagaaaaaaaaaaaaaaaaagttgaaattgaagtagatggccgggggcggtggctcacgcctgtaatcccagcacttcgggaggccgaggagggtggatcacgaggtcaggagttcgagaccagcctgaccaacatggtgaaaccctgtctctactaaaaatacaaaaatgagccaggtgtggtggcatgtgcctgtaatcccagccactcaggaggctgaggcagcagaatcacttgaacccaggtggcggaggttgcagtgagctgagatcatgccactgcactccagtctgggcgacagagcgagactccatctcaaaaaaaaaaaaaaaagaaaaaaagaaaaaaaagaaattgaagcagatgagctcagatcatgagggattttctgaaactgctatattttgaagaaaaccttgctggtcccctccagttttctgtaataacctggctgagcagtgggtttcactgtccggttcacgcactaactgcttcagggtcacctggggtgccagttcagaattcagagtcctggccccacgcctgaaaatactgactcactaggcctggggtggggcctggaaatctctatctttaacacgccactgctgactctgacgcacagccaggtttggaaactagtcgagtctgaaaagaatgttctcttcttggaagtgagaaaatgttaggggggcaccgtgagaaggggctatgatttggattctgagagaccaggtttgagtctcagttctgccacttaccaggtgtgtgaccatgggcaagttattcagcccctctgcacctcagtttcaagtgggaacaccacggatctgttttgtgactagtgccatgcaacaaattaccccagaactttgccacttaaaacaactctttggccgggtttggtggctcatgcctgtaatcccagcactttgggaggccgaagcgggtaggtcaattgagcctaggagttggagaccagcctgggcaacatggggagaccctgtctctacaaaaatacaaaaattagggtgagaggattccttgagctctggaggtcgaggctgtggtgagctgagatcccaccactgcacttcagcctgggtgacagagtgatactgtctcaaaaacaaacaaaaaaaaccccaactctttgattttgttcacaattctgtgggttaggaattctggaacggactcagctgggtacttctcacttgggatatctcattcggttgcagtcacacatcaacaggggctgcagccatcggaaggatatccgagatggcacactcctgtagcaatcagttgatgctggctattggctgggagctctgctgggctgttgactgtggcacctatgttgtgagtctctgccatggcagtagacttcttactgacttctctcagagcaagtgccccaaaaagagccaggagcaagctgcatggcttcttctgcctttgtcttacaagtctcagagtgtcacttctgttgtgttgaaagcagtcacaagcccacccagacttctagaagtagagacagagaccacacctcttggtgggaagagtgtcgaataactagcgggcgtgtttaaaaccaccacggtatctcatggggttgttatgaggattcagtgagatgatcttgctgaagtgctggacaagcatgagttcccctcctccttctaatttgaggcctggaggctaacagggtaaagccagtgccaggtgccaggtctccagtcgcttgcagttgttcatgtctactgggccatagggaccgtttttctcagtcttgtctcctcttctcttctcttctcttttactgacagagtttcgctcttgttgccgaggctagagtgcaatggcgcgatcttggctcactgcaacctctgcctcctgggttcaagcgattctcctgcctcagcctcctgagtagcttcaattacaggcatgtgccaccacgcctggctaattttgtatttttagtagagatgggatttctccatgctggtctcgaacccccgacctcaggtgatctgcctgcctcggccttacaaagtgctgggattgcaggcgtgagccactgcgcctggcctgtttttctcagtttctagtcatttctagtccttttggatagtaaatgcagggtgcagtgagcaccttctcattctgaccagctcagctctctcaggaggttgggactgcaagatctgtggttcactgtcacccccatatcagccttacccatgtgcctgatctcaagtgcaagctcactgggctccgaatgggaacacctggctgagtactgagtgttttcaggtcagacaacctggtttggggcccaggagggtcatctgttgcaatggtggcctgaggggcagctggagagaaagagagcagctttggttggcgtgggtcttctgtctcacggtcatgagtgggccccttctctgaccttgctttcttcacctcaggtctggagacagtggaggagctgaggaaaggtcacatggagaccactggggccagcaagccagctccccagggaaggtggggggtggcttgcatgacagatgcctcaggatgaggggcattaagagggtggctgggttccaggggctgccagagtgggtaggatttgccaaatagggtacccttggaaggcaggacacaagagggaggagccattatgtgcctgctgcaattcactggcatttgtggagggggtcgtttgcccctctggcccacacccttattcctgaaaaaggcagttgggcctgtgtttagcactccgaggaacctgctctctctggtcctcttcttttccttctggggctcctgaacctccccaccgacatgcttccctcattaccaccaagcctcacatgcagcagctgccttgctgagagcagacaggggtaggcttggagctgcacagcgatgcgacacatgatggggctccttctatgtgccccacacctagccaagggctaaaaatggtcacacgtctccatgatctcattgacgaactcacaccatgggcctgaaggagtgatgtgtgagtcagcaccccggaatccctggcagagcgggtcttggaggaccaggaagaccaggggaaacctcccagattgagtcattaggataggtcatagtgcaggctgccctcccctcagtctccatgcctcagtttcctcacctgtaaaaggagagtaactaagtgcccacctcatagtgtgaccacaaggagggaattggggtgcacccttaatcaggctgctctccacctgttgaagatttagatgaagagggacagggaaggagggcaggtgcatagggagttgctggggcaggggaggcagagtcatggaggagaaggcccggagggtggtagaggaggtgcctgctgcacgggtgaagtctgttcttcttcttttttttctttttggatggagtctcgctctgttgcccaggctggagtgcagtggcatgatcttggctcactggttcatacaattctcgtgcctcagcctcccaagtagctaggactacaggtgtgcgccaccacgcccagctaatttttgtatttttggtagagacggggtttcgtcatgttgtccaggctggtctcgaactccggacctcaagctatccgcttgcctcagcctcccacgcctgctgggtttacaggcgtgagccaccgcacccggcaaggagtctgttcttagaggcagagccaccactcctgctcccaaggaaaggacagtgaaacagctttcgcccataccccaacccccacctccctaaggccccgcagctcctccctccctccgtctggactgtttccccttctccctaagacatttcctggaagctctgcccacagttcttccttctacttatatacctggcctggccccagccctgccactgaggcctggcccccccattatgtgaccagcttttcctcttcttctttttttttttttgagacggagtctcactgtcgccaggctggagtgcagtgacatgatcttggctcactgcaacctctgcctcctgagttcaagtgatcctcctgcctcagcctcccgagtagctgggactacaggcacgtgccaacatacccagctaatttttgtatttttagtagagacggggtttcaccattttggccaggatggtctcgatctcttgacctcgtgatctgcccgcctcagcctcccaaagtgctaggattataggcgtgagccaccatgcccggctaacttttcctgtttctactcacttgggctgagatccccgttctcctatgtcaccttccttaaacatcacaccttggctaagaggaaagactgtccatttgggagtctatgcccactagctctgcgacctcaggagagccgcttaacctctctgagtctcagcttcatcatgtgcaaaatagggtcatttagttgtgactagtgcctcattttgaccgtacttccatgaggattgaataagggaatgcattgaatatgcaacaagtacatagtaggtacttaataaatggcagctatttccatggtgattctaggcctgtgtatccagagagtatttgactaatagacatctgcacgcctgtaatcccagctactccagaggctgaggcgggaggattgcttgaggctgggagtttgacaccagcctgggcaacatagttttttacaaaaagccatctgagggtatgacttgcatagggagccacttattattggagggcagataaagaaaaggaggtattcctttctttcccctgatgattcaggcaaggtggtccctgctcccttttatttcctgagttacatctatgctgtgccctagaattggaatcagtaagcacagatgccattggagtttttccccaatattcttttttttggagacagggtctcactctgttgcccaggctagagtgcggtggcgtgatctgggctcactgcaacctctgctttccgggttcaagcgattctccagcctcagcgtcccaagtcgctgggatcacaggtgtgtgccaccaagccgagctaatttttgtattttttgtagagacggggttttgccatgttggccaggctggtctcaaactcctgagctcaaatgatctgcccgcctcggcctcccaaagtgctgggattacagctgtgagccgctgcacctggcttctaacccaatatacttttttgtttttttgtttgttttttagaaggagtctcactctgttgcccaggctggagttcggtggtgtgatctcagctcactacaacttcctccttccgggttcaagagattctcctgcctcaggcacccaagtagctgggactacaggtgcatgccaccactcccggctaatatttgtatttttagtagagatggggtttcaccatattggccaggctggtcttgaactcctgatctcgtgatctgtccgcctcggcctcccaaagtgctgggattacaggcgtgagccacagcgctcggcctcttccccagtattcttgctgccttttttttttaaatttatttatttatttatttatttatttatttatttatttatttattttgagacaaggttttgctctggagcgcagtggcatgatcatagctcactgcagcatcaaattcctgggcttaagtgatcctcccacctcagcctcctcagtagctgggactgcaggtgagagccaccactcctggccagattttaattttttttttttaagacagggtctcactatgttgcccaggctggtgtcgaactcctgggctcaagtgattatcctgcctcagcctcccaaagttctaggatcacaggtgtgagccactgcctagtcaacagacttgcttctaagacttttggatggaaactcttctagagtatatttcaatgagatatatcagtttgctattgctatgtaacaaaacactctaaaccatagtagcttaaagcaacaatttcttcttctatcacaattgggtaagttggctgggctgttcctctgctggttacatctgggtttactcatgcagctgcagtcagctagccaacagctgtggggagatccaagatggcctcatgaacagtgtggcagttggtgccagctgtcagctgcagtgaactgtcactcttctccctgtggcctcacatcctcaagtatgtgagactggcttccttacgtggcagcctcagaactgcctgagagggtgaagcaggaagctacaaagtctcttaaggcttctcctcagaagtcacacagtgtcacttctggtgcattctattggtcagagcaagtcatgatgccaactcagatcctcgaggaagagatggagattccaccctagattagtctgctggggctgccataacaaagtaacatacactgggtgactcaaacaactgaaatatattgtcttactgttctggaggctgcaagtccaagaacaagttgtcagcagggttggttccttctgagatctctctccttggcttgaagatggccaccttctttgttgtgtcttcacatgttcttcccaatgtgtgtgtgtgtgtgtgtcctaacctcctcttttttttttttttctttttctttgagacaggctggagtgcagtggtgccatctcagctcgctgcaacctccacctctcaggctcaagcaatcctcccatctcagcctcctgggtagctgggaccacaggcgcacgccaccatacccggctaatttttgtattttcagtagagacagggtttcgccatgttgaccaggctggtctcaaactcttgggctcaagccatctgcccaccttggcctcccaaagtgcgagccactgtgcccagccagatgattcttttttgttgttgttttcgtggttttttttcttttcttttctttttttttttttttgacggaattttgccttgttgcccgagctggagtgcaatggcacgatctcggctcactgcaacctctgcctcccaggttcaaacgattctcctgccttaggcacccaagtagctgggattacaggcatgcaccaccatacccagctaattttttgtatttttagtagaagtggggtttcactctgttagccaggctggtctcgatctcccgacctcaggtgatccgcccaccttggcctcccaaactgctgggattacaggtgtgagccaccacccagccccagatgattcttttttttttttttttttgagacggagtctcgctctgtcgccaggctggagtgcagtggcacgatcttggctcactgcaacctccgcctcccaggttcaagcgattctcctgcctcagcctcccgagtagctgggactacaggcacgcaccaccacgcccagctaatttttgtatttttttttttagtagagacggggtttcaccatgttggccaggatggtctcaatctctcgacctcgtgatccgcccgcctcggcctcccaaagtgctgggattacaggcgtgagccaccgcgcctggccgactcccagatgattctttagtgacttcttctgtctgcctggaggctgtgagacatgtgccctctaggcttgccattaacttctgtgaacacactcagctgtgacagctctgagggaactcacccacccccatattagttatctaatgctgcataacaagttgcccaaaaatgtagtggcataaaccaacaataacaatgtattctatctcttgatttctgtgggtcaggaattcagataaagtacagcagggatggattgtctctgctcacaatgtttggggcttcaggtggaggagttgaagctgggatgctggatgatacatttccatggtggctcactcacttggttgggcgtgagggaggaaaaatgtagtgattagaagagactgaagaggtccagatgtggtggctcatgcctgtaatcacagcactttgggaggtcgaggcagatggatcacttgaggtcaagagttcaagaccagcctggccaacatggtgaaaccccgtctctagtaaaaatacaaaaattagccaggcgtggtggtgtgcacctgtagtcccagctactagggaggctgaggcgggagaatcacttgaatccaggagacaaaggttgacttgagctgagatctcgccactgcactccagcctgggtgacagagtgagactccacagtcaatttctcccataatcaaccaccttctccaggcagctgctggagctgctgccccaatgcatcacttcctggcacatagcaggctgcagggaccacctcatctgcctttgccacctctcttcccacttgttcagctgcccttgagcagactggatggccttccagaacaggacaaagcaggctggccacgtgtgcttttatgccctcctccccaacccgcccccccgacgccacacacacccctccatcctctgtctgacccaacactccccacaagatgcctagaatgtctttcccagggcggcctcccttaagggtatgtcttacttattttcatagctctgtacatatatgtaaggggtgtttcagaagggtttgtgggccagtcacagtggccctgtaatcctagcactttgggaggctgaagcaggtggatcacttgaacccaggaatttgagaaaatacaaaaaataccaaaaaattagccaggtggtggtggtgtgtgcctgtagtcccagcgactcgggagactgaggtgggaggattggttgagcccgggaggtcaagtctgcagtgggccatgatctcgccactgaattccagcctgggtgacagagtgagacccccctctcaaaaagaagtgtttgtggaatagaattgattttaaaacctttttaaaaaattgtaagggctaggtgccgtggctcacgtgtgtaatcccagcactttgggaagccgatgtgggcggatcactcgagcccaggagtttcagacaacatgacaaaatcccgtctctacaaaaaataagaaaattagccaggcatggtgatgcatgcctgtagtctcagctacttgggaggctgaggcgggaggattgcttgagcccaggaggtgaaggttgtagtgagccaagatcgtgccactgcactccagcctgggtgacagagtgagatgctgtctcaaagaaaaaaaaaaatgtatatagagatggggtcttgctatgtttcccaggctggttgtgaactcttgacctcaagcgatcctcctgcttcagcctcccaaagcactgggattataggcatgagccaccctgcctgaccaatagttcaaaatctttatggtccgcttaagtccgtagttcaccatattcccctgagttctctcaattcccaaagttgcaaagaggccagtggggattctgaaggtttctcctatcagcttctctggtgctcattctcccgctcccaagggccctggccttttcccaggattcattacatggtggccctttctcaccatgtggcatccttaaaagcatggggtttgaacattcagcctgagttttgcttgctatggattggtggaatggtagtgctgggagagaggaaacatttctgcttcctctgaaccctcttatgcgtgcgcgcgtgcacacacacacacacacacacacacaaccaggaaaccttctcttcccctagcccacgtctcctcccagtctgtgctcttgcacttccagagccagataaatggaggaaaaacacagctgcagatgtagccaccccaagagaaatcagaaagtgtggaagaaaaaaagaaggccgggcgcggtggctcacacctgtaatcccagcactttgggaggccgaggcgggcggatcacaaggtcaggagttccatatcagcctggacaatatggtgaaaccccgtctctactaaaaatacaaaaaacttagccgggcatggtgatgcatgcctgtaatcccagctactcgggaggctgaggcaggagaatcgcttgaacccgggaggcggaggttgcagtgagccgaggccgcaccattgcactccagtctgggtgacaagagtgaaactgtctcaaaaaaaaaaagtgtgcttaagtgactgctgtacccctactgactatacaccaccctcccctccatattgctctgttggagggtccctaagaccccttctcaatccttgttctcactccctgccactgcacacagagcttgatggcaagccgaatatggtatctccttgaaagtgagagaaacagttgcatttagaaggggaattcacctagcaggttaaggaaatggcccaaatggagatctctaatccccatgcctgtttttaagttgccatttgacccacagtggacatctctacaggaaggccagtaagtgcccgagactcccaggcctccgagctgccccagggcccaggaacgaggtcagatgtgataacggctctgatgtggccaaaagcttccatcatgctaagcagttccaaacagtcccgctcgtcaggcaggcccggggcagtggtgggtagcgacagtgtgatgctcggccttgcccccaaagcttaagcctttgatggcaaaagcacactcggctctgtactgagctgactgcctgaaaatattatagaaaacatctctcccttggcggggagagatctaagccccagtgaccggggagtttaaattttcgggatgggtgaccgaaggctgctaagaatatccagtcacaggcctgaccacaagccagttaacgccccgagtggcggcttccatggtccttggggcatgggaagaaggagccgactgggcagccagtacttgtggagtccctcagcaggaattgtgcagacacaaagtaaggagtaaaataacattaaagaaaaccaaccacctgatcgtgccctcaaggaataatctgagaagggaagacattgacctaccatggggtacttactgtgcgttaacagatcaaaacaaggacaaccatgcagaagggaacagtctccgagacaccaagtgccaacaagggaccccaggctggcttcccacagccagatggggtagttcttgtggcctggcagctggcagcctgacagaaagtcaggtaggcccagggtacacattctaccctctagccctcagtttcctcatctgcagagtgaggggtttgggagtcctgtttcgtcaacattttgggtgtctgaggccctctgggactctgatgcatgtacccctggcaaagtggacatgtgcacgagggccaccattttcacagcatttccaggggtgtccggccccaagtagaccagccccagatctcaagtgagggctctgaggtttttgtatagaggagagactgttcttggagggctggaagtggctgggaagagttcatggagaaagcaggatcgaagtttgggcagaaatgagatggctacaccttcattcaatgaatgccatgagcttcaacggtcagcaagcccaagggatggatgcgatgacaaagagaccagagaggatctggaatcgtgtgcagcaccgtttccagctggagagagagagcccattctgctccagccatgtgggctgtccttctcttcctcaggtggtccaaggttggtcctccttcagggcctgtgcacttgttgctcggctacctgaaactctctttcccccatactcatgcagctggttccttctcagctcaatttttcaaagaggcctcccaagccatcctggctaacactgccttccctcccactactctcagccacactgctctgtttcatcttctgtgtggcacatgtcatcatctaaagttaccttatttgctctgtttatggtccatctcccataggataaggaccttgtcagtcctgttctccacggtgccctggcacccaggacagtgcttggcacagagtaaacaactgccaaatttgcaatgaaccaaatgaagtaattatagccttaacgctagatggctgtgcactggggaggcctgtggcgtagaggaagggcagggtggtttgagagggtgaggctgagccactaaactggtctggatgactgtttggggaaggtatcttggaggaagtgctgtttgaacagagttgtgaatgactaagtgaagcgggtggagggatcgcaaatctaagccagctcccggtggcaacggctggatgtgggaaggggctggaaacagaagcccagagccaaggtctgaggggcagggcccagtagggtggctgagggcttccatctttatctcaatagtgaaagccactggagcaccctcgctctggctgcaggatcaacccccgccccccttttacctgtctgatcattcttcctcttttgcaatctggccaccctagaatcctggttgttccttaaacacagcaggcagtctcctaccacagggcctttgcactggctttgcctctgcctgcaaaactctcacctcagaaatcttggcttgctcccccggctccgttgagtctttgctcacatctcactttcccaagagacctcccctgagcaccttaatcctgcaaatccttctccccacaccctgccttccaggtgcttctttcctgctcccacttttctttccatggcatacatcactgtccaccatccatggtaattttgtgacctcttacctttattgcttatcgcccatctctctccttctggaatacaagtaccccgaggacaggtatttgttttgtttcctggggtgtgtcgggagcctggagcagcacctggcacccagcagcagtggttatttgcgggtgtggttgtggctggtggctgctgtgggggccatggactgcagaggggtaggagccagaggagggggcccagtgaggaggccattgccatggcgtaggtgagaagctgtgctaggcagtgcagggcgctggatgtgggggaaatggatggactcctaaaactgcgcagagaaaagaaaacggatttggtgaagggtcggtttggggagtgaagggattggagaggtcaagggtgattctcaggtttctggaatgtataaccaggtggttggtggggaccagggagaagaagcagttttaaggggaggaagagagaaggggcattcctgcagggaacatgcatgggccacaatggggaaaggctgtgtctgctccgggcatagcggaaaacccaatttaggctggagtggaagttcctgcagagaaggtgaggaagacagggtgggggcctaggcaacccgttaatgctgccaactccacgctttcactctggaagcctgggccatgcctagggctgccatgatgaagtgctgccaagcctccaatacggcacatctgcctggcgcatcactctcaccccgctcctccccccgccccaactgtggagcagtaagtttgcttctattcacgtgattttattaacaaaatttgcttccttgctgtctctagaagcagcacactgccctcccccaaccccccaacttggctcagagcaaccccacactcctgctatcaggtcatctgcccagagtgtgattgcagttttaaaactgattcctccctggtttattatttttttttagtttctattttttattttctggaagtacagcacacagacagaaaagtgtacaaatcctgagagtacagcttgatgaattttaacacacccatgtaaccagcttccagatcaacctgcagtgttcccagcccccaaggagtcccactgtgctccccatctccaaggataactccatcttgactcctcttcttttttttaatgagacagagtctcactctgtcacccaggctggagtgcagtgctgtgatcacagctcactgcggcctcagcctcctgagtagctgagactacagcacgcccaccacacccagcttatttttgtagtttgtgtagagatggggtttcaccatgttgcccaggcagggcttgaactcctgggctcaagcgatccacccacctctgcctcctaaagtgctgggattacaggagcaagccactgcacctggcccatcctgacttataacaactcagattaaaacctttgcccactttaaaacttgacataggcaaagcgccactgcactttagcctaggtgacagagtgagaccctgtccaccccccaccggcaccaccaccaaaaaaaaaaaaaaaaacaacacccaaactagatgtaaatggaatcctattgtgcatattcttttgaggctggcttcttttcatttgcaaggtgttgtgtgtgcttgcatcttaaaaaacagagtctcaggccaagggtgatggctcatgcctgtaatcccagcacttcgggaggccaaggtgggcagatcacctgagctgaggagtttgagaccagcctggccaacatggcaaaaccctgtctctactaaaaatacaaaaattagctgggcgtggtggcgcatgcctgtaatcccagctactcgggaggctgaggcaggagaatggcttcaacccaggaggcagagattgcagtgagccaagatcgcactactgcactctagcctgggcaacagagcgagcctccgtctcaacaacaacaaaaacagagtctcccaagcagcctcccacctgaggcaagggatcagggcccagtctcaggaggcccctgtagcctgtggaatactcagtagaggaactagggggtcagtggagactttgtgtggggcagaggacagcattggtgttttaagcaaatgacatgctaagcattgtgttagatgctgcctggatacaaaagtggaagatgcggttaagagggggtgaagggaagataagactggatctagagtcggccaggttgtaagaatgtcttgggctgggcacagtggctcacacctataattccagcactttgggaggccgagacgggtggatcacctgaggtcaggagttcgagaccagcctggataacatggcaaaaccccatctctactaaaaatacaaaaaaaaattagccaggtgcggcggtgggcgcctgtaatcccagctactcaggaggctgaggcaggagagtcacttgaacctgggaggcggaggttgcagtgagctgagatcgcgccactgcacaacagcctgggggataagagcaaaactctgtctcagaaaaaaataaataaaataaataaaagaatgtcttgaactgcaagaagaggaaagaaagtgaaagctcacacctgaggggaggacagaaaggtcagaagggttgtgactccccgcctcccaaaaagatcccctcagtgctacccttaaagtcactttcctgaaagggggggtccttgccttgggggaggagacaatttcagttctattatctcagtcatccagaaagacttctctgtgcctgtggtgtgttagagagaagacagatagggagggaggaaaaggggtggggggggtggagagagagagagagagagagaaagagtgcgagcatagtatacttcctgggaaactatctctcgaatagtagttctaggaagcctcatgccagagggcagtagtactggcctctgccttcttgatggtgcccttggacgtcagaaagaggaggaagcctcagggattggcagagacatttgagagtttcagaagctgaagtccagagagggtgagcgacttgcccaaggtcacacaccaagaaagcaagcattagaaaggggatcgagtgtcccctccatggtttttccatgatcgtgtaccaccctttcactttacaaagagcctagtgttgccaccaaaatagctgaattacctcatttttgaaaggcgttatgaattcacttctattatgtggaatggggcagagatgttgtgagcaggcatgacattataattcatattccacttcttctatttatctttgctgggttttgtgtatctttggaagcagccttaaatcattattggaacaaagtagggagaaaaataataatatgtaattacaaatgaggaatagaccgtatgatcctattaattgccttccctgcaatctttatttttggtattttcagaataattaacggcttaggtctcgattggtggaggtggtgggttagcactgaactctaaacagtaacatcacctactccaggaatggcccagtgcgatctgacacctgggacgctttcagggcaacaccaagggcaatgctccagtctgtatttactctcttctgaggagaaactctggcagcagctggaaaataaaacccaaagcaaggaagaagccgaaaagaagaaatactcaaatacgaggcgcattaatcatcggtgtcagatctagagcagaggacaatggctggtttgaagaaagactgaacctaaattatcttggaaactgatcttctctcctccgggttccctgtgcctgcaagcaggggtcccggtgcagccactggcatggaaccgatgggggcatccactggctgaccagcatgctttgtcacaggacaggttagagatgaccaccttctgtctgtggatcatccatagcttctgcttaggaagctacagaagagaaaaggcctctcacagggacctgcaggacaaattcattgcccatcgtgtcctcaggggacatcatttgcatgccaggatgcagtaaggccactgccttcagatccaaataaagcacccaattagcatgaacttgtgcaattggcagagtaatgaagctgaccacaggtgcctggaaagtccgaaatttagttgctagtgttgcaccgtgatggcaggggctgtgacggcatgaataagtctgggctttgggaatgggcagtgagcttccaggcaagcaggcaaattaattatcctctaagcctcagtttccccatctgaaatgggaataataatagtacctttattataggacagttttttttttttgagacagagtcttgcaccgttgcccaggctggagtgcagtggcgctatctcagctcactgcaagctctgcctcctggtttcacaccattctgctgcctcagcctcccgagtagctgggactacaggcgcccaccaccacacatggctaattttttgtatttttagtagagacggggtttcacggtgttagccaggatggtctcgatctcctgacctcgtgatccacccgcctcggcctcccaaagcactgggattacaggcgtgagccaccgcgcccagccatataggacagttttctatatgacatgagattattaatgtgtataaaatgtttagaactgtgcctggcagatagaaagcccttaataaattctagctattgttcttctaggagctgaagaacattagtgactctcttttcctcaaatcccaagagctcttctgcttcagaagagctgtgtgatgagttcttcccatgttatcccttcgtgaactaccttttcccatggtaaggacaagagtagtctttatggaagctcaaaacggggaaaagtgttgcccaggaatatgaaagggcaaggtagcttataatctcgccagacattgagccataatttagtattggtggaggtacaggtatttttcaaacagaatctatttgttctggggaggaagtccttcccttgaacatcttggccccacacttttttttttttttttgagacacagtcacactctgtcacccaggctggagtgcagtggtgcgatctcggctcactagagtttccgcctcctgggttcaagcgattcttgtgcttcagcctcctgaatagctgggatcacaggcgtgcaccaccacacccagctaatttttttatttttagtagaggcgaggtttacgccatgttggctaggctggtcttgaactcctgacctcaagcgatccgcctacttccacctcccaaagtgctgggattacaggcgtgagccaccgagcccaggccggccccacactttttcaaggcttacctggaaggaaggcaactcttcattcagatgatcaattcttaggttcccatggtgaacacaacagatgagctgaggcctgctgatcccagaaagaaagaaactccttttatgatacttactgcagttggcgagttgccaggatgggcccagaaggatgcaattgcagaagctatgtaggatctggtcccagaaatagttaaaggtttggggaaacagtgcatatgcatgacagacaaacaatataccctatgggaaagagcctaggtttggagtcaggtagaatccccgtagccacactctcctagattagccatgtgttttggcgcagtggctcacgcctgtaatcccagcactttgggaggccgaggtgggcagatcacaaggtcaagagattgagaccatcctggctaacacaatgaaaccccgtctctactaaaaatacaaaaaattagtcgggcgtggtggcaggtgactgtagtcccagctacatgagaggctgaggcaggagaatggcatgaacccgggaggtggagcgtgcagtgagccgagatctcaccactgcactccagcctgggcgacacagtgagactccaactcaaaaaaaaaaaaaaaaaaaaagtgaatggtaatacctaagccatagggttattttggggtgtgagtgagataacttggaaaagtacctgataaagtaactgaaatgaacaaaggtccttaataaacagtagctatttttatcacataggaattattcattgttaaaagacttgctttgctatcaaaaacagcgcagggacacagttactgttagaggtcaaatggcatggaattcagagaactccaattgcccagggtcagctgtgagaagaacctacacttctggtttcttagggtctcaaggagaaagacagtctcaatcttctgccactaagttaaggaccaaatgattggcaataggcaaagtactctaagaaggctctggtttgggttttgtcttccttttggctttctcatctcctggggatgatattctgcaggacttagttaaggacaggactcccaaggcctccccaccagcatgcacaccaggtcacttggctcctccagccgacagagacctgtacacaggtgtcccatactcccacgggcctccccaaaagacagtgtctcccccagccttatgcttcactttcctaatttcttctgccccaatcctcaccagaactacagagccactccccaccagtccaggtaccccctttcctatagcaccctctccacaactgtcttgttctcttgaacctggtttcttctctagccaggatatagaataccgattcagttagcaaaaatgtattaagtggctggctacagtggctcacgcactttgggaggctgaggtgggcagatcacctgaggtcaggagttcgagaccagcctggccaacatggtgaaaccctgtctctactaaaaacacaaaaagtagccaggcttggtggcacacacctgtaatcccagctactcaggagaccaaggcagcagaatcacttgaacccgggtggcagagattgcagtgagctgagatcgtgctgctgcattccagcctgggtaacagagtgagactctatctcaaaaaaaaaagaaagaaagaaagaaaaaaaaagtattaggcatgcaatacttcatttattgtttatcagatttttttttcatcaatatgtggtgagcaccatgctaggcactgggcacatacagccagaaacaaaattctgagaacattatggatatatgtacatcgctgcacactgatgcaagcttagcacctggtgatgatacactgtaccattatggacgatacggtcttgctgagggaggtgacctcccagggaccaacccgcagagcctattcaggagctgatagcaggcctgtgtggttggccttcagagggtgagctaaacactggcaagcaatgaagtggccttgttaaggcatttagattttgttctaagtgcagtgggaactagtggggtagtgacattcaacactttttttttttttttgagacatggtctccctctgtcacccaggctggagtgcaatggtgcaatcatggctcactgcagtctggaccttccagggttaagcaatcctcccacctcagcctcctgagtagctgggactacaggcgtgcaccaccacacttgactactctttttttttaagtggagatgaggtcttgatcctgtctcaaaataaataaataaataaataaataaataaataaataagatctttctagctgccacgttgcgggtggactggaggatagcaaaagtggcagcacagagattgctagaataatcatcctgtataataatccaggcccaagatggtggcctggcctcaggtggatgtaggaaaatgggaagaagtaggcttactagatagactatttggaagtagaatgggttagctttgccagtggactggaggaaggtgagggggagatgaatgaaaatgggtcaaaaatggccccctaggattctgctttaagcacctgagtgggtgagccattttctgtgatggggaagggagttaaagcaaagagcaggttctaaaggaaaagctcttctctatctaagagacatttgtcctgctcaccactgtttccctagcacccgctacaaggcctggcatttattaaatgcccccaaatatttgtaaattaattcctctttttagaattcagttgtggctgggcgcggtgctacacttgtaatcccagcactttaggaggcagaggcgggtggattacttgaggtcaggagttcgagacacatgccaacgaggcagtgtggcaaagtgattaggaccatggactctgaagataggactgcctggatttgaatcctagcaccaccattttctaggaatgttcagtaacttctctgatagtttcctcatctggaaaaaatgtacataataactctgcctaccttatagggcagttgtaaggattaatagttaatttatagaaagcactttgaagagagcttcaacctaacaggcgtgatgtaaatgcttgctattgttattaagctgagcgtagatgcaaagttgagataccaagtttgaagtttgatatggggatttggaactagaaaaaaaaaatgtaagtcatcaataagtaggtggtatttaaagccataaacctggatgagactggtggggaggaaggggaggatccaggcccaaggcaactggtagagcatagaaaagcccacaaagaaattgaaagcggttctcagctaggatgaaaaccctgtgagcaagcagctcaagggagcagtggtcatggtgtggtaaatgcttctgggaggccaaggaaggcaaggactgaaaaacaacgccgcccccccaccccggcccccactcctggcaacaaggaagtaaccagtgatcttgagcactttctgcagaatggccagggaggatggaggggttgaggagtgagataaatgaccatgtgtctatacagtgaaattccaccagcctggaaattgacaaggcctgtctccatgtgttgctagaaaagtaagatatattgataagtttcataggtgaggtacagaacagattgtgcagtgtgttcccatttctgaaagtagaccagaggacatgcatatctacagagaaactgggggggaagggggcactcccctgcagtgttggaaatctttaatgcacacacaaatatgtgtctatattcccccctattttgtttttacacaaactgtagcagatggtacacactgctctgtaccttatttttttttccttaactgtagaccttgggggtctttccatatcaatacacagagcagatcttctttattattttaacagctacagaatattccattgtatgcatgtgccatcaatgtcactgctgactctttaggttgtttataatcctatgctgttataaacaaagctgcacttattccagtgtcttaaaataacttcatgactagctgatttttagagtgaacatgaggtaagcctgcagaaattccacatggatggagacacctctttcaagaagtccaggtgtacagggaaacagataaatagggaaccagcaaaggagatgcgaggttaagaaggggcattataaagatgggtgatgcttcaagcaaagaagtataacaaggggcctttcaagaaagggtatggggggtgagggtggaggcagcaaggaaaagcctctaagaaggtgatattttagcaggtatgaaacgatgacttaaaacagtgtgagatcctatgttgggtgctgcgggaacatcaggatggatggacagacactggccttctggaaggttcaactccagcagggaagctgtgctgtttcacaaattggctgcaatattgttagaaagtggttgattctcggccgggcgtggtggctcacgcctgtaatcccagcactttgggaggccgtggctggtggatcacctgaggtcaggagtttgagaccagcctgaccaacatggtgaaaccccgtctctactagaaatacaaaaacattagctgggtgtagtggcgggagcctgtaattccagctacttgggaggctgaggcaggagaatcacttgaacccgggaggcggaggttgcagtgagccaagatcatgccattgcactccagcctgggcgacaagagtgagactccgtctcaaaaaaaaaaaaaaaaaaaaaaaaaaaaaaaaaaaaaaaaaaaaaaaaaaaaaaaaaaaagaaaaaggaaaaaagaaaaaaaagaaaagaaaagaaaatggttgattgtcttagaggtacaggatctacaaacttcccactgtggtccctgctggtgaagtgtgctcagagttccagaagttccctgagttcctgataagacaggaagctaggggagaggagaatattttgcctgaaatgttaagatttttttcccccatagggattcaatgacacgcatgccctggaaggtttcaaaaattggaaataaataaaaattccaagaagaatttatattcctgatggctatgctgatggtcttgtaaattgtatatttaatcaaagacactcaaatgtcttttttttaactattgaagagctatttaaatgtcaacataagtgattccctcccaaatagtgctgtttatacattacttcccctaatagaccataatgattcataaggaggcatttctcgcctctaaattgtaggcctattgaaatataaattaagatgataaataatttgaccttacctgagagtactaagtatttacatgtgtcaaatacgaaattaccctgaacatcatggtccctaaaaaggcagccttcctctcccgggtgaattcattaaatgaaacgggtttataaatttctcttagagtgtggaagagagagagaacacacaaaagaacgggcccggggacccggccgtccccgccctccagctttcccatgaggcccggggggccgcggaacccactccccggcggggagaggcgggtgcagaccgcccccgcgcgcttcccgcgctcccctctccccctccttctgcgacgccgcaggagtttcaaaacatggagtttccacaggaactttgccaggccgagctcgcagccctcccgggctcccgcagcgggattcgccgagtcggcggcgccgcgcggcctccccgccccccacgccctccggggagccgctgacccggcggcctcgggcagctccgcaaaaccgctcggtggctgtagaacctggggaggcgcgggggctccggggctccgcacccccgccgaccccgtccgggccccggagggtggcagcctggcgccctccgcggggccggcgccgagtccgtccgccggctctgttggcttggctccgccgcccggggccggggccgaggagcggaggtcgccggccatggcgagcgaggctgggtacctggccgcccgctctggagttttgttttgaagcccggcgtgggggaggggcagcacctcatcaaggagaaatttcctgttcgcaagcaagactccgcttgcagagtttctgtcctgcccttgacctgacaagtggatctcggctgcgcgggtccccgagagtcgagccagccgcgccaggagcgcgcgggggtgggggtgggggcacccgcgccgaggaccggggagcccggctgagcggggccgacgcctgccctcccggttcccgggcgcacccgggagcgcagagccgagcggtgactaatctgcggctccgggcctcttggcgcgcagcccgggttcgcctcccgccccctcgtctctcctcctccccgccgccctcccagcccagcagcgcagcgctccgccgagcgaatcgtgcgggccagggccgccgccgccgccgcgttcccgggagtgtgggaagcgggtcgaggcgggtggctcgggagccgtctccagtcggcctccttcgacccgggaccgaatgtgcatgtgttaccttccccttaagcactttgatcagcgttttctcctcgcagccgaggagccagagcgaaccggggcttttaaccccctgcgtgccggctccaccgtgggctgagggaagagggtgccgcagggagattggtcgatacagggtgcgatcagtttggtttagcaagcctgagccaggaggagcccggccggatccgaggagcttgcccaagcgcgggacgctctcctgtggagagcaggccgctgaggcccgaggcgactcgttaatgttcaagctctcccaggggcagcgctgtaacgcgacctgcctggccaggcaaggtgcgggcttgaaaggcccggcgggcggaggcttctggaggggcccgggaggccatggcgggacccgccttcacgcacccggttcgttggcgcgtgggtggctcctaaccccggtggaggctttgcgctcgcctcgcggactcggctctggccgccgctccctcccctggtccaggcctcgcttgggagttaatgattgatttactggctccgcgcggccggcgccctcccagctatttgtccaagctgaggagttgctggcgagcagcgcagtaggccaagagagcgggggtcgccggggaagggaagccacgctgccgacgggaaggagaggccactagattagctcccacttggcggctctagctgtgtcggggcaaaccctcaggaagccgggcccgggcgaagggagcattgggaagctccacatgtaaatgggttggcagctggcgattaggccgcccgattttatgagtcataatgggcctcccgcctggccctcaacctgctcgctgtggatccggcgcgcttggggcccaagtggtggaccattccggccgcgcagagggacatgcttctgggggcccaggccgccgaaggagttgagaaggactttctctcctttcttgtagaaggcaacacaaacaccctaaatcaaaccgctccgacaatcgaaggctccacacagacacatcaataaggatttcgcctcccgcgtatgaacgcacagaaacacttgtcctatttttatgcaaatgacaccacacaaatagatctcgcaggcccgggagaggggcgggaggaggaggggcgccgccaccccagccagggggctgtgagaggggaggggcgccaaacccgcaccccagggcccgcgccggctcgggcgcagcggggctggcactggtcaggaggcccgccccgcgggcagtggctccctgccagcgccgccaagtcggccgcgtccccaggctgcctgcagaggcggattagggaaggagcgaagcgagcctgtgactaatcgcggggcctcggaccggagcaccaaggccatgtgcgactgacaggaccgacactagcagaggacacggcgacgcctcgcttaattgcaggcttaaaaaattgccgcctgagcagctctggcgcggagagccacggcttgcgcgtcgagctagggagcgcgcgcgcttgggtgggggcgggggttcctgctctctcgctccaaggttggaacgtttggcgtctcctggaccgagggacctggcccttgcgtcccccactctgctgggtcgccccgccccgcgtgccgaccaagtgtggctgagcccgccaggagagtacgatccagcctccagggctaggtttctgacccgaccctttccccctaaatccgacgtttccccgctttcgccctagatcctatacgggagggggctgtgcagttgggggtgacagattccaacaaatccttaaaataaaaaccacacgcacgaaagaaacactttctcttccctccccttcttcaccgactgatacaaagccccgaatgaccaaagggaaagaggtaagtcggggctgcagggagcaaggtcatcgagtgccaaaacctcggggctcacagacacgcactctgagttcttcacccctggtcacagtctctgtggcccagaccttcctggagcactggggcctctcgggggcgaagggagaagcgtcgggaggccggcggctctgtgttggggagggggagtgggagggagcggagaacccagcgagagaagtttccaccacgctctggccggctactgccaaaatccccggacccctccccgcctgcaccgccttccgttgccaccacaagtttggtttaacgagagctcgggacaaaagcaaacgttttctatagaccccgaaaacaaaggggaaagagacgcgcggggccgcggagaagcggctgctagcgtaatggtgccaggccgaaagcagagcattaaaactgcaaaagccgcgcgggcgggaggaagtgcgaggcgggaggcgggagcgcggggagggcgggaggcgggagcgcgggcgggggaggggcgctgcgccatgtttccgtgtcacccgccgagtcgtcggcgctgggctcggccgccggctcccgcctgcctccgtaacagcagaaagcgtgcgattagcagccagacaggcggggactccgggcccgcggggccgccgcacacgccgcccgcggcccgagcccgcgccccccgcccgccgggtaatcatcctcctcgctgcagcgctgtgtgcactctcattagagtagggaggcttttctctgtgcactcgctcggctcccgctggcaaaacaacgccttcccgggccgggccctgggccaggagagtcggggagggtgggacggaggtggggggtgggtgaggcagggcaagccttgcaggtcagctccgccgccggatctcctccggacacggaggagacggggagcgtccattggcccttccctaggtggagtggcaaagtccgagccccgcagccgaccctacgtccctacgtggaggggggcgggtggagtaccggtgccgccatgacctactcccgtcccccgccggaggctagagtagggctgagggggagatgagtgtgtctggtttggagagcgggggcggacactgggaaggctcccaaaacaggttttgccccatctgttttatgaacgacctcttcaggccagaagccggatcccaggggtggcggcccttcgaccttcgaaaggagacccgggcccccagcaggccctctggcttcgcgctctgtcgcctgcagtgggtgggagatgggggtggccgaggcttggctgctcctggccctgagcttcggagccctattttctcctccgcgatctctgcacacaacagtaggcagcctctcacagcagcacgcgcccagctgcagggcctgggagcaggtgttcctgcccggccggagtggcggctccgcgcccctccggtcccagctgcggagctgcgagcggtgcgggggggcgtgcttatggtggtagcagagggacagggacatctcatcggaccgcaggaagggtcctctcggcttacaccgggataccgcagggcccgggtggtcgcctggggcgaggagggatcaggggtgacgcgcggccagccctcgtctggaacagccctggggccagcggaggccgctcggggcggcgcgagggcttccggtccccgtgactgcggcggcggcggcggggcggccgcgaggagcaccctcccctggctgctgccgccgcgcggctctcggaacggcgccccaggagcctctctgcgtctggcagcgccgctttcggcttgcgctgggatgggggccgcagggtggtctcggcccagcccccacggggaggggcggggaggcggggtccggagaccccgcgggaacggccgcgcgcctcccagcaccccctcctcgccgccgccgccgctgctgctgatatggcgggcacgtgaagcgcagcttggcgccccggcgccagccagggagcggcctgccccgccgactcagcttacccgcgggcccaggaacgcggaaccgagcctggccgggctccgcggagcccgcacctccgcccgcagctcgctgcggccccgcaccctctccccgcctgagcccggccttggggccgcgccaggcggctcgcccgaggggaactcgggctgactaatgggacgcgtgtgggccttacgtgaggcccggctgtcagcggatacccgcttgctcggagcttagaccgcggccaagcttttcggggaagggcgagaggaggggtttccccgctgggcggtttcagctccccagggacaatccgtccgcggcaggccccaacctttggatcttgcagcctggcttggagacggtagacttggcatgtgccggacgccacggtgccgacccggtcgggggcagggggtgggagcctcggggttgtgagctgggggtgggcagaggctaggtcagcttggtctggggcgcccgccttgaggtttgcattctggggctagccactgggccggggggaatttgcagggcgctctgaggtcgtggagtctgataccaaaaccttcctcgacaaagtcttccggaaaccccttcgcgaaattcctgtgcggaaagaaggatttctaaaactccccgagggtccggttcggctgggagctttcgggttctagggagtgtgatttcctttctctccctttataggggcctataaatatcagaagagtttcttcttatttcgcattaacaaccacttcatgttgacatagttatatgaccctcccaagtataactacctgtttagtttgaaggcactgagtgcgatggcgaaacacaaacatcgaccagtaactaagagaaggaaaacccagccgcgagcttgggttggatacaggataaatcctcatcacgcatccctggttttattcagcctaattgcactagtaatcctgccccccgcgagaaagcctgaaatcctgcagtcgaggtgcgacttttcctggggagccccgccaatggggggtgggttgtcagtggaggggaggtgggttttaaatgtcacttccaaatgaaaatctttctttcttttctttttctctttttcttttttgatccagttttcgaaaagagcatttttgcgagataagaagtgaccgatcaaaatcgctaaggggaggttgtaagcagccgctttgccccagcttagcgttatcttatctctcacacttgcatggcggaaaaaaaaattggcttatctttatccccacccccttctcgccttaattgctaaaaaacactagtgtgttaaaccgggaggaaggaggtctctggagtgtcagtggaaaaggaagattcaaaaatgtgggctcccgggggaagcaagggtggcagaatttattctttcccccaggcctttctggtacaacacagggtgtagtccagggtggaaggctgggtggctctttttttaaattattattttaagaacaaaatctgggcttggccttgggtcgtgtggcttccccaggcctcgctttctgaacttctcccctccttcatctctcaaaagctgctggtgggtctgggttgaggcctctcactctgccttcatcctccctcctctagacacatcctccttttggggagggggggatgcaaggctaggacacatagcctgctggaaatcattaaaatatatgcgagtgtctgcaaacacacacttttaaatcatggcgtttcccctccacgctggtctatttaaactccagagcgagctggatctcctccctctcagtcgtttgtctgtgtcaccgacaggccgctaatggccgggcttccaggcgctgtgcattatgcattagcctcctccctccgccgcacacagaaggttctgtcaggccgcaccacacaaaccaccctgagcccccccaccccaccccccgcactcagggccgggggctgcgcggctgctaacgcgctgggaacgcaggtatggagaggaggatgagcaccgagagcagagtggttcggaaggtggaatgggagcgggtgaaatgtgccgaagattacaccgtttggaatgcccagtccgttgtgagccccaaagctttgctcctggctgcgaccttctcgaggcaaccatcccgcgccactcacctctgtgaccgactttgttgggggcgggagggcagaggtatttagagacagatcagcaccgctttcccttctgctggtccgtacccaccttcctgctgcaggcgaggggctggcagagccttctctacccctccagttcgggagtggtaccgcgaaggggttcggggtggtgcgtcttcgcagggacccggtgggagtggaggagggaagctggatacaaaatggctggggccggaggccggcacactgggtccgaaggcgagtagttggtggttccccgccccctctcccggcggttcccactcactgcccccagccgggtaaaatatgcgcagaaggcgccttgctaaataagcagccgaggcgggacgtggcgtccgggtttatctgcaggagcacccggcccagcgcggcggcgtcgagggctcttaagcccttgccgagcgcaagaggcggccagcctcccagaagcctcctgtattatgcccatttggtcgacacccaaccaccctgcgggcccccgtagtgtagatgccagttcacccacacgtgcctgtgttcggggagctcagggcctgacccaaatcgagcccagaccagaaattccaagatggttgctaggaaccacggagaggctgcccttagggccttccttccccaaacacccaataaccctccaaaggctaggaagaagaaagaacagtcatgttcagcctggcgacccttaagtccagcagtcttctgccctgggaggcagctacctttagatgtttccagatgagtgaaatcctgggaggaggatgcgcctcctgtttgttacctcgtttgagtttcagaggggaagccagctgtgccttgtgcttggaggatggggcagcggatgttttttaaagtgccattggataagcccagagttcttgtacaaagtgaccagaagactataagtgtgggtgtgtttttaaagaaaggctacctcacattatgtaaaaatacattatctgtactcatccgagtcccacctgttccagtaccaagtgtcatcgccctgagaacagcctccgaggaggaccatcggaagcctacacatacgttataagctttatgatgtggatcctagtatacgttataaataaatcttgcacacaaggttagaaggccagggtccccccaaacacaggatgcctggcctttcccctaggccagggtggagctggaggtgtgtgggagaggccctagcgggtcttgcagagtcaacctgccttgagaagggcagccaggctcaaggcctgctcctagaagggccagctcgattgcccagttgcagggcctggttagcctgaggtcgagtggtttgttataatcaggagacacttccatgggaagggagattggtggcggaggggcagcccccgctgctccatccgcagcacctctcatttcggcacctatttctttatttctccgtgggctgcacggcctcccctcccatgcactcctttgctcactctctcctcctcctctgttttcattgaaatcctccccttgctgagtgctgggtatagcagcctgacccccgggtcagctcccgaagggcttgtgggagggcaggagaggagggggcaggagaagggccaaaccgccggcacccattgcaggccccgcggcatccccagctccctgagccccttcttaagtgaggacacaagatgggattgcccttcgacagctttctgcttgttttccccagaacaattggaactaaccgggccaataggtgtaatctcccctccccccctctgccttatagcgcctcgggaaaatcccacattttaattcccagtgagtcacgaatcccccccaccactcatgcctcttaggactcccttaataagatatttttgaaatcccacggagttgaaaaatgtatccctaggagatggaggagaaaccctttaatcctaccagcctaccgtggaggcaagatccctagaaaaggtgggggaggatgttgcaaattacgtcaaaggcgaatttactggcctgtttgtctccagcatcaaatttctcccccagtcagccctcccctcggccccttcgcatttacagcacccccaccacccctgttcattttaactctaggacttttttttttctttttcttttctttttttttttttgagacggagtttcgctcttgttgcccaggctggagtgcaacggcgcgatctcggctcaccgcaacctccgcctcccgggttcaagcgattctcctggctcagcctcccgaattctaggacttttaaagttagacaaacaggcctctttgtcagcagccccgggaggccgtaagactctgagaggctgcaggccccgagctcggttcctggattttctaaaagttctggacgtttacatgcgacttcgaactccgagaaaagcctgtgcctgggggcagagttggggagacgaggggaggggatagaaggtggctgggcgccgggccagggcctctgcggttcggcctaaccgagccggaagagcctggcacggctccacactggcccaggccagttctcccgtccagcctgcagcagcagagcggcctcctcgcctggaaccacgttcagagtttccccacaaatacccagcttcagccttcccggttatttttgacttgttttgaataaaaggagtcgcttcaaaaagaaatgttgccacaacacacaaccagaggccttttctccagctgtgtctgtaactcgcatgcgttcaatctaataacttttaatgtctggtcctaaaatgtctttataaaaaatagttttacagcataatagtccaggtgtctttctgcttgttaccggagattaaaaaaatgtgtgggttggcttgcagagatatccacccccagaaagaccaggaagaaaaaagcgtgcattccattctgcaggcgctggtcctggaagcgttcgcggcccagcctggctgggcactgctcgcgggggcacttgctcgcctgtcttttgcatcagttgttataagcagctctggagcatgaagatttaattctgccgaagtttcgggtttcaaacggtagagatgtttcacttctgctttgagaagggctgtttttataactatgtgctgagaactaaaacagaatgaataaaatcgcacctaataccagtcccacagtcagtagtgagtctaatttttaaaagggaaaatatctgctagctagagctgattttggccttgaccttgacttagtaatcaacttgagatgcttttgattatttttggcatggggacactccaggatattttaaaaactttccgtgtggatttacaagccacctccatttcagatttatgtttcatggagcctgcaccatcttgtccttaggcagaaagagacaccccacccccttcccagtataaaaagaccctagtgggcagccgaatggggtcaccattggccgcgaagtccgggcccgcagtctgggcgcggttagtccggaataccccctcccccactcctaccccttcccgccagcttcaccaactagggcttctcggctcgcccttgaggctttgcgctccggggaggccggaacctcgcttctccgcttccccctccctcccgcctgcccccgccctccccccgcgcccagagccgcgccgggtgcgctggagaagctcaatacgtgtcaattgaattgaactgctgcgggcgcaggctgtacgccgccgccaagcaccgatcagcacgacgttaccgagtggaaatttatggggcgaacggtgtaagccaaaagttgctccctgtcaaggaaaataaaacgcgggagataatctcccaacgccggggcgaggggcctgggcagcccctccaaccatcagaggtacagaccgtgaaaatgctcgagaaccgggagaaatacaggcggatctccgctcgccgaccgccccccacacgcctcccggtgcctccacgggctgctccccccttcccccacctccaaacaattcccacacaattgaaacgtccggggaactcgggcgcggagttcaggcggaacggccaccgttgcctggggtggtgttttcaggtagcttttaacaccgaaatgggaaagggctcctctgggaggaaggggcaaactggggtgggggtgagcacgggagcacacaggccacgctccgctgggtctcggaggggacgaggccgggagagcgcagcgctggtggcaagaggcggcggcagcggctgctgccgctggggtttgacagctttggctgagcggagtgcgaggcgctttatggtaattgcggtcctccactggccttctgggtagcgaggggagtctcggcgcgcggctgggagagccgcccccgccgcccccatcccttcggctctggctctgccggcagccctcgccgccgccgccgcccaagtcggtctccggctcgcccaggacgtgcgcccgggtcgggcgtgcgcagccaactcggcccgagctggggaggggaggccgggggacgaggagggggggcgccacccaagtggtccggggttcggatccagagaggccaaaacgtgccgggccgtgcatcgatgacggccggggaaactcgggcaaacctttcctggggaatcacccctcccgaaaccccgccgcggaggcgccgcagcggagggtgagcggagactggcggagctcaaacttgcgagagctggaggcggcggcgggcgggcggctgtcgcccgagcgctgcgcctgcggggggaggggaggcggctgttgggagggagggaggtagggcgggcgggagggaggacgggcggagggagggggaggaggaagaggagggaaccagggaggggggacgcgttgggatcgcggcgtgcggcggcagacggagcctgggctcccagcggcaaggtgaggcagagctgcgctcctcgctgaacgcgggccgagctcggcggctgcgggggagacgcgcaggagcccagaccgcgaccgagagcgggagctaggcgggcggcggcggcggagggggagcccgcgagccgccgggcggagagcccaagccgcgctgtcgccgcgcagggacgacttggccaacactcacacacactcacacacacccagcccgagcgggcgctcgcggcgaaccgtcaacatggcgctggggctcctgcccgagcgcgggcggcggcggcagcgcgggagctgctgagctcggccaagcccagtccagctgcgggagcccggaggatcgcacggggctgtcgccacctgcccggaggccccgagcccgccccgccccgcccccacccggcccagagcccacccctcggcggggccgaccccgagggcagccggctgccagcagacggcgagggagtcgagtgagcgcggcgccgcgagcgggctgcgggcagccggggaccgcaaactttgctgctcgccgcgcttctccggcccggctccttctccgctcgttaacgtcgccaaccccccccacccctcatatctctctccacccacccaaccgccccccgctccttctcgccgcctcgagtccgcttgggggaaaacttcaaagagccggatcgcaggctccctgcctactcccccaccggggatttcaggtcagtgcccggaacacctttcccccgggagaccgcggacgggtgggcgggcgggcgcgctgagggctgcagtcggccccctctcccggggccccctcccgcagcgtaccccgcgaagcttttgcctcgcgcttccctttggctgcttggctcgctttcgtttttatttcatagctatgttatttaaaatgcagccaacctaagcggccccgcgtgggcaccagggagggagggggcgcggctgggggcctggcgcctcccggtgggccaggaggagagcagggagttcgcagagtggaagtttgcagcctgtgtgtgtctgtgcgcgggagcgcggtcgccgctgagcgccgcgagtcgggcggaggggggggaggtgggctggaagctgggaagctgggttcggcgttagctcgcgagcaggaaggggagggcagcgggttgccgtctgctttctttttcgactcgggaaagaactgtaaaaacccccagccgccgccaccgccgcctcgtctcgcctctccgggggccggtcgttcctccaagtggaacgtcggcgtgtgcgtgcgcgagggtgtgtggcgagtgcctcgggccgagccgagctcgacctgccgccgctgccgcgcaactcgggaggggagtcccgttttttcttggcttgccccaaagcacgaatcacgtggattaaaaaaaaaaactactaagaaatcgagcagagcaaggggttccgacttggcccgcccgccagccaggtcagacgctttgttttgtaaatgttcttttaagattataatctgcgatccccctcccgctttccccctcctctccctccccgatgttcagcgtaggttttaagttatgagcccccaggggtgggtgtagaatgtgcttgtgcgggggcagcgtcgtggagggagggcgggggcgggcgagacctgggccctccgctgggcaatggggagtctggtgggtagccctgatgggcgtgtgaaagtctgcggccggaggaagttggtcccactcggagggcgtgtggcaaggaggctgtaggcgaagaggaacttgcgcaccggggcaagatcctcggccaaggcggggagggcgaggcgccgcggggcccgcgctcggagccggcgggcggctgcgccgcagagcctccgccaactcgggggctcgcggcggcggtgacgagcgcctgctgtttacggagagagccttggggcaccgtgtgtggagtagggcggccgaagtcacgcgtggtcccggcgggcttcccgccgctcgcacgctcgagtgggcccttcccggggtcccggagacggacgagtctggcagcgtgtaggccgtggccgggcgaggcgtaatttgctgttaatgaatcttttccagaaagtccgcgatctccagctagaggctgtgagtgcccgcgcgccagggcgcgcgccgccggcgtctggagggtgggggtggggggaatggaagagcgaagaaggaaggaggagggttatgtgtatttagaaacaaaccttaaaaagaaaccaacgcgcttcaaataggtattcgcacagcctcgctgcgtctagactagacagctcggggttttagctgtgttttcccccccttttttcgttttgagaagacgctagaggaggggtagtgtggtatttggttctaggggtagtcttttggagaaagatccttaaaatggcctgggagtaaagactaggaggaaatggcccaccccagaaggtggtgggtggtgagtgcagacagacttgggtatttctggccatctgacacttcctgtggcactggaaacggacaccgcgggccgaaatcaatccttacgaagtgttgggttcggttttgccaacagaattgcttgcgtggaaggcattttaattgtcagcctcaaagattcctgtacgtggacacttagggaatacgctcgttccttgaccctgcccactcctctctcgacctgttatctggtgtgggttttgcagtgttggttttcgtgtttattttgggcagggtttcagcgcgtagagcggagtggggggggaaggcgatgattaatatgccatccaggtttaatccgaggctggccttcagtgtgcgggtatacaccgccacgcacaccaattgccttggggtgtttaggggagcgcgcgggttttgggcagcaggcgcccggccggcaagtcgcggctggggctcggctggccccagcgctgtcctttgaggcgctgtcaccagtaggtgactgagagttaattaggaagtgttctccggatcaatgggctgcacagctcattagcgattctctccagccctttgcagggccgtcctggcctccgcctcccacacaggccggggcctcgctgtccaggctgcggggagcgccgctgggaagtggggaggggccggtagcgagggacggcggggaagcgagtgtaacttcgcggggcggcgcgttgcgtgcggcgcctcgaggcccgcgcagcccgctctttcttcctgcccgcggtcgcctccactgtgtctttaactcgctcccgctcgcgtcgctgcctggctgctcctccccgcctcccgcgcctatctcttgttctctaagcacgacgcctgtgctccccgcccagtttaggattagacaagataaaaataggactgcccagcgcgcggagctgtgactgtgccccggcagccgggctggtgggagcgcggggggccggagctggagaggacccgtggtgcgctcggagcggccagtgcctgtgggccccctacccccaccccgcaggcaccgtcacgctccccgggttctgtccgccgtgaaccgtgcgggccgggggacctgggcagggtctccgcgctctcgcgggtgttgttggtgtgccggtgatagatcggtctagacaggcatgcaggctccctcccggctgaaggactggaggggggggaggcgcggagatggcagcagactctgtgagctgcgagtgagcgagctagcctccgggcccagcgagctgggtggagggaaggccgtgggggtttctcttaaccctttaaaggccgtggtggggtagtgtaatagggaaaggggggcaaagagcctagtggaaattcctggaggcagagtagctcgcagtggggaggagctgtgagtctgggcctagggttttcctttctcttatgtgtgcacggtcacatcttggtgcatcgggctcgattcttccacaaaccaaacgcagctgctagatgatctagtttgaccaggtatttctcagtcggggagctgtgaacacacacaatgaacaccctcactttaaaaactgagtttggaagacagacgtagactcaatgttcccaaagagaattcatgcgggtgttcaaggacgggaaggtctgcacatagctgtagtcgggtggggcctctgactatgactgctgcagaccaaggacctgagcctgaaatgccccgccagcatgtacaggtatgcactgaagagagcaaagcggtctttgagttgtctctatataaatagacatacttttaaccaggaacttgtgaggagttagatatgtgcaaggagacagcctccaaagaggagctggacactgatgtgttgtgagatccatcgtttgtgtgtgtatatatatggctaatattaaattggtctaaaattttaatacacctctgcagacatttatctagttctttcttcagcttgaaatgggcggatgggttaccctatacataaataactcattactaacattccagtctcctcctccctcctcttcctttctttaagagtttgtgatcttaagggatcctctgtttacatttaaactgcaaacccatattggtctggcctgggaaagagccacattataggcaaagcaaaaagaatggaagtagtacgaatgctcagattaagatgtgcgcttgaatgacatgtgctgagacaaatcaagacacttgggctccgttgcccaaatggaacaagagatacataagagataaagaactggccaaggggaatgtaaacatgggtatgcaaatacagagatgtatagcgatattctgagagaaaaatcccagactttgttgagctggaaactggggcagaatttctgtaagtgcgttccagagacaatagcccatttaaaggtgtgaagagggtcacttggaaacacaaaaagcattcatatgcatacatccatgcttagatacacaggctgaatgacaaacactcctcaatgcctgacgaagactttcctgccgagtgagtgagaccgacttgggtacagaagagtgggccacacaaccacattcacacacttattcacagggaaataatgtgtctttggcttgaaggaaactgagggccacgctagcagcctaaaggatggatggtgtgcagtgaactaggattatctctggttatagtttctttcccttctaggggtgaggtggagtgggcagcgggttggtgacgagcaggtaggagcctttctgaagagattttgagttcctgaccttgagtggctggatcgtgtagccacaagaggggtagctttccactttgtggtcagtaggaatggctgttgcactgctggggtccaatttgctaaggtggagcagggcctcagtgggctgggaaggagaacaggaagaagtgcggcctctgggaggaataaaagggaggtatgctttctttcttttcttttttttttttcctctggaggagaccgtggcggggacagcctgtgttgggtggattagcaggcgcctcggtgaccccagacgcgcacgtaaactccggctagggtatggcttgcccgcggcgtcgatttgctgcggtccctctttgtctaagcccagccgggaattccagcttttattgggaagaccgcacttgggtggggcccgcgccgggcggagtggggcagggtccggtcgcgctgggcgggaggcttggagcccgcaggacgttccccggagctgcgggcagccctggcaatgccaccccggtggtttcctcgaggacaccgggcccggcggacccggagaggcgcggcggggcggggaacttcctgggtccatctcggccgccccgccccacccttctccctccggcccgaggccgaaaggagctcacaaggccctttgttaggccccgaggtcacactcgtgccccgggggccgccgatgggtgggagaaagcagtgctgcgggtcaagaggagcctccttattgcctcggtgccccagcccatcttctggatcgggcccggtgggggcctcgcccaaagctgggtggggaggcctgggccggccctgacccgccccggcttctttgccagtgtttatggccgacgggattccgtctgtttgcaaaaccggacgcgctgctgaggcctaggtggtagagccaggagaagccgccggggcgggagtaaatggtctccccccagccgccctggtggtagccgagccgcgttcgtcgcgcgcacttggccgggggcgtccactggtctccagccctgcccgacggctttctctggttgccctcaacgtgttcatcaggaagggatatcttactttttgttgggtggagttcattaacgatgcctttctgcgatatttctgtagaaggctcccttttggggcgcaagctcacctccatgtgtttacaatcgagggtctcagaaacgggggtcctcactccgtcattgttttagagctgtgtctcccacagccggcacccacgggctcggctctccatgattagagaagcggggaagtccactcggagaagatcctgacagcataaaaaataatttgtgatctaaaagacagtttccagtataatctcattatgcaccacagactcccgatgttattttgtggaaggcggacaatgatcaatttacattgacccggggctgggcgagcttttagatggtaattgccatattgatttgcatgcaaaaaggagacctgctaaaattaaagaccggaagctaaattaaactaaatttattgtctaggtgcaaaccaggggaactgttgggggatgggattgactcaggtcagggtgccaggggcagagcaggtgagaagccctggagcttcggaaggtcacaacttgggaagcgatctttgcccttgtgatttcatgtggggagggggaatgtgtttaaggaaaaaagttataaaaagacaattttgcattgaagtcactaggatctttcaatgctaataggaacttagagggagaggagaggtttatagggttataggggtcttccagcaccatttccggcgtcccccctccatttctattgttctgcctggccagacgctcgcagtcgtgctagggacaccaaaaacctcttgcatttgaagagttaaaaaataaataaaagcagcccgtcccccccttcccgccttgctctctctcccctcccccttcccggagcattagacttttcggagagagcgcaccgcgggcaggccaggaccgttggcgctgtagggagttcctccccggacgctgcggtcccaggcttggctggacggcgatcgcttcgggaagccgccctctccaggtggccacagtaggcgggggtggggtggggtggagcaaggcgtctgccctggccgccgtctagcggtgcccgggacttggggggaatcgcctccccggaggggttaggagggccagccccgccccgccccgcccctccccgaactgggtgggggccggggaggactggaaaccctgcccgttcgccaaggccggaaagtttaaaaaagagaaagaacgccacttgcagagggctggcctgcagccaggggtggccggcctgcgggggcgtgctcggctggctagcggggtgagcgccccggcgccgccgtctcccctccgtccctcccgccgccgaggcccctgcacactcggtcgcactgcggagccatttcgcacatccggagcttcagcgtctggaggagtaaccagtccagggccgggaagcccgagtgtccggtacccctgcctgtacccatcgagccgagccggaggtggctttggcaggctctgcgggtgtaggtagttcccggaacatctgaaagcctggggcagacccggaaattggggatagggtggggaggggatgttgggccctgaggtttgctgccggccgcttctgtaaagaaacgttggggaaaggacaagatagcctatcccccggcttgcgcttttgtgggggactctgggtggcccaatagaacatcttgctggcgtcttccatcttaattccctctcccacactactttgttccctggggtttttcctttaaatcctaggaaaggtagatggaggagctccctccaaagggcttttgctctatctagataatttgatttattgctttatgtggcgaaactggggtggcaagcctagctcctagtaccagtagtcagcacttttcccagagacctgaaaggagtcgacccaccttacccctgactattctggggtactggaggaagggaaaggggaggcttgttgagagcattggccttacaccagggtataacagtgtagggagatttgtaggatgtagggggaaatggtgaaagactttgagtggaccaggagatgacttagatacaggagaaactgggttcacggctcactgtagaccaagtaacataggtgttaaacactctttgcctcgttcttgggtacataaggcctaaggaagcttttcagaggagacagtatgtgaaaatcaggatttcaaatggcacaattagaccaataattggctcctctccgcaactccaggactgagtttgaccgtggcccattttttactagctgtgtgaccttgggggcaagttatttatggcctttgagccccagtaagttttttcatttgtaagactgggaataattatccacctttaggatctaaatagaatgcttggcacatagtaggccccaaggatgaataattgctttgaatgacttgtcatgttcctataggttgctcctccattccctgctgcccctgagaccccctgagacttgctaggcctgtgtcctgggacccaaggatgcagattaaatctcccctacgagggtattctaggtccaccttcctgggttcccctttccctttgttaccgtagtttgcattctgccttttaaaggattccatatgaaaagacttgcttctcccctccacccccaagtgggatcattatatggttaggaactcatttcagaaccgtcatctaggtacccttcggcaaggcttcctggcattatttcaggggggaaccacggtgcctagaggggcaagacctggttggaagaggtgagagggggtggcctggtgcagaggccagaggtgctgtggtttgtttgatagggattaagtccggatgttatgagggctcaatgtggttttcaataaagtctgccagggattgcttcttttatatcaatatgtatttaaaaaaattactagcatgagaagaaaaccagacctgtatggatccaggctggtagtaagctactgtgatcaggtttcctactcgactcccagaggggaagtcagtgtttgattgaagctacacttggttcttgactctcaggggatgcctgctctgaaacaggagccctccctccctttctctcctcctctccccctcctcctccctctttttcccttcttcccctaaaagcctttgtgctgaaagagcttcagtaggcacgaatccctggtccctctctaaagaatgccttacagcctttgctgacattgttttgtgaacagtgggttttaccaggccagcagtttccccccgattttagcgcacgattttaaaggtagtgtatggacaagatgcgccttactgcagtgattgcctcagtgtgtagcctgggctggggcttggaatctagagacgccttaacctttgccctaggggccctcctggagtggggggtgaaggtggggagctcgaggactgattgttttcgaggatctgtttgttttgtccagccaccgaggctgaaggtggagttgggcaagtctgagtgtatgttccagctttgggtctgattttaaacttggtttaattggagaaactcctaggcatttaacagttctgtacaaatgcaaacttgaaatagctcgaggcctacgtcatttaggaaagaataaatgaagtacagaaatgtccaaactatgtaaatcctagcgttgtctgccctcccataaacacatgacaagtgccaaggcatttccagtcaaaacacccatggaagcagcagcctccatcctttgtatttattattttattaacagcattttacacagcatttaacaagcacagcgtgcctgctttgcaccaggactctaagcaggcgaaagggtggaaaatggatggaggtgggggaggagtggttgctagaggacatcaactagagaaatctcatcagatgggtagggaaagcagcaccgggggtttatttctactggccacaaggaagacagacatagtgctttggaggaagaaatcctctctcccatcccaggaggaaagttgtacagctgtgatatgtctggtctcagctttgattccagagggtaaaacagggtatgtttcatgatactctgcccatcggttattggtgattttcaaagaataagtatttgtctgctatcgttattctatatcctggtggaaagtttataacgaaaagtaatgcctttcttaagtcataaaatgagccttgtatgcttatttaattaaaatctatttaaggaccgattaggcgtgtaatttgcactaataatgacgattatggaaatgttcaacttaaccaaaaatcataaaggagacattttgatcagtggggcggccagtaagtatttagtgagttgggcaatttccgaaagacaggaggcattccgctgagggctgcagaaagcacagacctgtctggcctctgtgacatggcatggagaggggcagacctccctgtcccggccccggccccagcccggccagaccccactttgctgagcatggaaaccaaccctgcgagtctccacaacctttattctcgtgatgcttcctcgagcttccagaaggagtaaactctcggagagggctgatgagccacacggaaatctctgcgaaatggcggtgctcttttgctttaacaaacagcgctgacaaacgcatgcttccttggctagccttggctggatcccggaggggtagggggagaaggggtcccttgttccggagaaacctgccagctgctgggcttggtgtgaaggcagcaaaggcagacacaatgctgctgttgttggtttgatctctaactgtggattgttagtctggctttaactatgtggtaaggggggaatgtgaaggctgtttacagcgagtgcaaataatgtgacagctgttggcgcgcgagcagcgctgcgcctcctcagcacttacacaaagcgcgcactatgcaggcccatggacgagctgcagaggtggcggccagtttctggccagcgcatccccagatgagagaaagctccacggcacacccgccctccatccccaacacacatctttatgacttcccaggattggggtggggtgcaggatggtttgtatgttgtggtttagggaacttgtggtgaggcagaggtggcgggagaaggcccacggggccgtgagtgtcaccgtgttggtggggtttggccaggatccgttgaactgggtcctcagctgtttatggctgagtttttaagatttgtgaaaataactttcagccctaagtaagcttgttggaaagaatgtgttattaactgaaagctttctggaaattgcagaggctctgaaggccgttgttcccctctgaaatggccctgttattcagacaagttagagacaggcgggtgctgtgttctgtgcactcgacactgtttccagcttggaaatgcaagtgtgcaggttcagtaccctaaggggggtgtattttggggggaagggaggacagattggcttttgattacccacatcccttaaccttttcttccaagccttcccgttttcaagagcacatttgccttcaactgcagcacgcaaaggtgccgtcctgaagcctgcccacagcaccacctactctgacttcatcaactagatgcccacagcaacaggctttctttgagttcctggtaccccgccaggccctgcagagaggcgccagggtgggagggagagcagttggtggtggcagttacccactaggccagtcctggaggttcatggctggcccaagcaggtggacttaggatggccaagaatgtggacctgcctctggaccgtcctggggcaagctgggtgtaaaaattcactcctctcccccatgagtcccaaggttgaagccttccaagccctggcacctgcctggtcctccttgggttttggaagatcatttagggctgactttggtctctgggtgtacagcctacaggatatctgcaaatctacttcattctctcctgtcccccccaccctcagcacctcccctccctaagtctactctctaagttttaacatggacttctacatctagttgggtttccgatggggagctgggagatgcttctggagtgagacatgaacttcggtgccagttctataaattggtctctttttatgacgtgtgccattttctgtaggaatgttgcttgcaaaacgagtttcgccttggaggaaaggcggaaagataaacaagcctgcaacgccaaaacactggcagtctttccctccttccagctctcttaaagcagccgggctgtatttccaggattagacttgtgcatgtgaggagggactcgcgttggctttttttcccccaagcaaatgcaaattagagaaaaataattttctttcaacgatatgcaatgtattagtcacttgttatcgtgctccgaggcaggcctcatttgcgcgtctgccagctcgctcacatctgctcagcgctgttcggggcattttaaccttggcggtgtcgtgtctagtcccatggatcaaggaggagtaattaagccctgaacagctacaaaaattcgtgggcccccatctataccatagttgttccatggctttgttttgggtgctctgagttccatgactgagtagcagacatgggattcctattgttccttgtaaagaaggtgggtgcccctctccttctctgaccctcatcccagcctttctgggactcccaggctctgcacaatcagtgagagactcgcttgcagattgcaggacccctgcattttacacatcttttatgcattaaaagttcctttgtgcttcctgtgtatactaatgatagctgttgttattagccttacggtatagcttgttcccttcggtggtggtggtggtgggggggggtggcggcgacggcgtttgtgttttactcctacaaagccctggtggaaacaaaagtgcattgacacagcctttggaggcatggtgtggaacatttattctggatttgcccccaggttgtgtagattcccaagtggggacccagttctgcagggactagatcaaagggggcaagtggtttctttttgcgtggagggaagatagtaaggagggattcctggcttttgacttgggtttctgttgccgggtggcctcctgtgaagggacacctgtttctaaatttgccctctcttgaatacacacgtggtttcctgactccccgtgtggcaaaaccatgaaggaaagtgaaaagaacaaaaagccggtggggtggcctggacagattatccggggagacgggcaagtgtcccccgttggcctgtgagagagaggttgggggcacctgaccccgggccatgggctctgcctggaggaggggagtgtagcggacaatccaggttcggcagcgaccctcagggtcaacccctgcagattccaccccggaccccaacgcccgagattcgcacccctcccacgttacagtaggcgacgcttggctcacatctttgtaaggggaagcgtccagaggagcagcgctctagtatgatcggaagggaacccagaacgatggcgaggaggggtctgccgtgcccattccccgggtgggctcggcggcgtttcccgggaggtctcggattctccctgcgcccacccaaagtttcttttcgtcagattcgttgatggggagagaaggtgcggcggggcctcgggaaggggcaccatggagagcgtgccaggccgcagggtccgaggggttacctagggtcgggaactgggaaggtcgggccgcctccggggaggctgctggagttcctggaaggcctggcgggggcgcgccgcgagggcgtgagtgtgtgccgtggtgcggccccgcgcgctgggacctccgccgaggagcggggaggaggagcgggcgagccccgagcagcacgggtgtgtgtggtgggagagaaaatccctttgttgccgaccgatcgcgctccgggctgaagcgcctcagcccggggagggggcgcccctccccctttcttcttcgccggggccaagttcactcccagcccaggtggctctccgctcagaccccgacgccccgggaggaggccgggaaggttctgggtgctggaatggtctgggccggcgagtttccccttccccctcccccttactaatgcaaaacttggaggtgtgggcggggacgcccgtgctggctacggctaaggctgtggcttggagtgtgccaagaggcagcacctgggccggctggatcacttccctcacccccaactctctcgggggagggggtcgggaggggtgggaccgggccagccacctccctcgaccacacccctggaagcctgcggttttgcctcccagggacctggggggcagccttggggtatcttactctccagcagacccggaggacccatcccacactgcacatccggaagagctttttcttctcatctcccactcccacacaccccacccccacccctcacatcctaaaataggaacttcttcacccctcccttccttgacacccggagcacagcgctgctgctgtgacgcagtctctgtttggagcaaccccaggaagggctggcgggtggtgagctttgggcttctgtaaaatctacacagttctgctgaagttccctccctgctctgatcccctctctgttgctgcctcagcctcccccgcaggatgaggtggtagtgccccaaagaaactgtgttgtgattctggggcttattacacagtgtgtttattggagtcgggtactatttagcggggttaaacgtggccagcgccagctattgccaggcaaaactcaagtccatagtgcagcttaatcctttggaaaacacagtgccaaatatttacagaggggaccaaggttggagaggttcagccacctgcccagagacacgcggtgagtgagggtgggagccgggaggctgtggtgaccatgttctccacagagaaccagccatgcagtagcgagacccctcccctgaagagtcctctgccagaggaccccagcacactggctgggaatgcctgcctggccacctgagctggaagcccttgcgaacctctccagttcttctggctgttaactgctggatagctgccggtgggggcaaggggaacctagtgagagagatcccaagaaaagaccccgagatgggccaccctcaatgcctgtgtggacagcagggaggcgtgagcagagttagtttggtggccatgctttccaaattgtcagtgccacttgacaagtgtaatgtgcagacttttaactgatcggcgcctcaagggtgggggcagtggaaagtggccctagtgcaagagggggccagggttgggggtggggaaggaaaggggccaaggcttgggacctgtggtctgccctcacatcttttcacagagggtgggtgtgtccctactcagggatgccaaggttggagtgatggcttatgatcttggtccctcgacgccccccttctgccaatcaggccttctcccccgtgtccgggccaagctcaggtgctctcatcataacccttggctgaagagcgaatgactactcagagtctgtccagggtgacccaagctctcctatgtgttccacttccttggtgctaagagctggagaccatgcagtatgcagtgtgcacgcctgcttctcacaagccaggtctctccacttggccctgggtgttcctgcaggcagctggaacagttcccagtctgttctttagagacccacaccctccccatctgacctcttctcagctgtctttcctctccatccctatccagcacctttacccacttctctccactactagaaaaaggggttaaaccccagatccaaggtgcagcttcgcagctcacagtggaacaggttggtgcttgtaaagtgcttttcatgagtgacttcacacatcttggcacttctggaagcatagcctgcatttggaagaagtggggggtggaggtgggcattgaaaaataaaagcaaacgagcttcatctatagctgcaaagcaccctgaggctctgtttgtcattgaaatcaggtcatttgccctctccacagtgttccgctgccaagggtcagcaacatcagtttcgaagcacttggccttagaggtaaaaaagtccccagctatttcaacagcagcttctagaagtttgatgtccctatactttgcctcccagtctctttttgtttcttaccccagtgtccccttcgttgtacatgacagagaaaccagggtgggctgtaggtaatggtgacccctgttcttcagtagaggcttggtgtgagccgtatggcctttgcaaaggaggtccctgcttttgtaggtttggactgctctttgtcacccaggaggagggcctcctgtgagccagggccattgctcattggccctttccactcctctccatctttggccaggaacccgaagagttaaaagtctttagcttgttgcaatgaaattatggctggcagtggcgccgctgtttgttcaacagacctccacttttaaacagttcacaaaaagttcatggggcagctaaagattataagtgtgtgtgtgtgtgcgcgtgtgtgtgtgcgcgtgtgcgtgcgtgcacgtgtgtgcgtaagtccacagcaggatccaacaatgtgttccccccttttgcttttatgttcagccccatcctccaccccttccctcccaaaacacacacacacacacacacacacacacacacacacacacacacacacacgacagtgaaccgctctgctagcctcaaccctccatctgaccctgtgcatttgagaacactttgttctggtggctggtatcatttatctgtgcgccattaatatggaaagccccaaaggaggagccctggagaaggggagatgctttgaaagcacccagtaggcccaggtgcctgtaaaccgcagtcacctttctgctaagtccaggtggactttgctgaagaaaggctctttgaagggaagcagctgctggccttttcggggctgggcctcagtataatgattctgtttcccaagaaggtgccgggaggtcctttgcacaaggtgtctacttaagggaggtgggtaagaggcaggttttttgtttgtttgtttgttttttgagttttgctcttgttgcccaggctggagtgcaatggtgcgatctcggctcaccgcaacctccacctcccaggttccagcgattctcctgcctcagcctcccgagtagctgggattgcaggcacgcaccaccacgcccagctaattttgtatttttagtagagacggggtttctccttgttggtcaggctggtctcaaactcccgacttcaggtgatccacccacctcggcctcccaaagttctgggattacaggcgtgagccatcatgcccggccagaggcagcttttttaaaggggaggccaatttttaagaatggggacaccagaagattgaggttcattaggcacacgcttcttccctcatccttttcttgggggtttggttgagtgaccctttggctcatgatgtaatttctgtatttcatcatggcacagtgagggggtggcatggtgcagtcccactgctgcagcccgatgaccgggacacactggcaccggggaatgatgttccaccttctctattatcctacccagaatgtcttccttttgttagaaagggcagcaggggccggagaggggacactgccactgcacaagggaatgtgccttgtggtctgcccagccctagtggtggccttccccacttgatttgtgtatttgcaagatggaagaaaagcccacgaacccttatagaaccttccccaacagccgagtcggtcctttgggggcgctgtggctagtcaactggaagagccgctgtctggagacacttcctagggaaatagctttccagaaccccatcatgcctgatgcctctgcagatttctgcctttttcttgggccctttacctctcttccagcctcattgttgagctctaactgtacgtggtgtgtcgctgcatgtggattttggttaacagacgttgttctatggggatgggggcccatgggggatgctggtggacaaaagacctagttaggacaaagaaatgagaaagtacagaccggctttgggattccatcccccaggtgtccccttaactcccaccctcagtcactctcacagaagagtccccggacctggtgcctccaacccaaccgacctggcagtctgctccgtgtgctaaagtgtaaaagcaagcatttgcatattttttcctgctaacaaaggaaatgtgtcgacttagggaacatttgggctttcggaaactgtgtgggtgggtgtgtgagggaggagaaaaaagttcccctgatgatctgcacaccaattatttcacacccaggtttgggtcccgtggaaaaatgccatggccggtctggacaagggacactgagatgtgtttgtgagcagggaattgccgagggccatcggtcccaggcattaaaggctcccctacttattaacccagcatttaacagcaggatatgggctgaagcgcagtcaaaagaaacggctcaacctccaaagagcaattaaaatcctgcacgaggataaatcacgcgccgtgataatcctgttaataaaatgcagcttgtcctgacccttcactcatgcagcaaactagaatgtgatgtgggtgggggcggtgggcagaggaggtaaaggggggtgggtggtggtctgagctcctctgccttggcaacctcccgctcccggaacgtggaaaatgggtggcttctgccggctccccatgtgccagcggcttggagcccatcagccagggctgctaagacttctgtgctcgctaatgatttctcgtccccagtgagcaggcgtcattgaattactcagccgcctctctctgcagcttccaggcaaaaccacccgggttagctgcttaatctaatccagggctctggtggggcggctcaccagcccaccgactctttttcacacttgatctgtaagttgcacacacgacagccttggaaattcagccctagaaacgcaggtagtttgagagctggacctgccgctcacctcactgtggtgccttccacccttcttgcacccttttggccccaggaaagatcagttgtgtgcctcccagtgatgcagcatccctgaacctattgtcagagcctccccttgttgaatcaagtcttctttaccttctttaacaagtggcaagaatgaatgaccactgtacactttcagaggaaagggagtgggcgggtgctgtggtgtgccctgaatgtgttctgtgccttggatgaggctacctgtttcgaattaaacttcttccccagccccagcacctcctaccagggaagctgcatgcccctccgctgtcccttcgagtcaggtgtctgtccttggctcccagaccactgtagacagcaggcacagcctgccttccccatctgcatcctttatgaatcacctagaaagaggccttctctagcgccctgtttggctctcctttactgaacctcctgggattttttttctttccttttaacagactagacgcttgaagcaaagctgccatcccagaagacgacatgctctcagcaacccccctgtatgggaacgttcacagctggatgaacagcgagagggtccgcatgtgtggggcgagcgaagacaggtgaatgcgcccatctgggccgggcctgagtggagcccacgcccatgctgaagcccccctcaacttctcacagccaccgtgggcccaaaaggggtgggagagaaagagcttcccgcctagtaggccgctcttgatttacagttttaacaggcaacctggctcagtgaagcattgccgccctttaaaagattagcccctaaagcggcctttcagtgcactttcgtccttaatttattatttcatatttatgaaggagaattaatcccagtctatatactgctttaactctaaatgtcaggagtgtgggcccaggtggagcagcattctatgtgcttttaaaacaaatagtttgctcagtaataaatggggagagagccaccgttttccttcattgaagcccaggatctctcattgtcctctgctgcctgttcccagaggccactggcgcctgcttttggtcgtcagacagctctgttatgcttcctaatcagtaattttggagttgtggggtggaggcagctaagcagtagatgattgaagctgctcttcggggtaatgaggaaacttttcctctgccgcttgtcagcgatttttatcctggggatttggaagttggcaccaagcactttctttatcgatgctctctgataacaagtcccagggcagccgcagcagcctggcacagatgtgcagcttccttttcagcctggaacagctgacatttgtatgatactagtgtgtatccccctgtcattttgacaaaggcagtcaaatatggcttttttatcaccatggaaaccagtttcgtaggacatggtccctaactttgttttggaaaaagttttgaaagcctaccctcctgggtaacacggaagtggttgatgacacgaccagccttccagccccctttggtatttggctgtgttaccacttcatgtctaccctccaggagagtttataagggttggctgggacagccgagctccgattggcctacttggcctctagagaaaaaaatctcgagggagaagtagttgtgcttaatttctggcttacctaccttggggacatcatatttgtgattcatgtcctcacacatgaaagctttgcgtttcctttgtttttcctggtcaagttgaatcaccatttgggggcgactttcaatatgggccattgacagctggtgggggcggagggttaaggacagttttaaaaattgggttagtagaaactggtctgttctggggagatctgtgaaagatggattcagtgaggaatgctttcatgaagttggtgtatctttttaaataggaaaatccttgtaaatgatggtgacgcttcaaaagccagactggaactgagggaagagaatcccttgaaccacaacgtggtaagagattaatagcttctgttgatgccatatctgcatatcagtgatctgtaatcaatcgtattaatttgcatgcccttaaagggtggggaatgggggaggggtggcagttcagagcagggctgagttggaggcctctgcgagaggacaaggcccccacccaagctcttccagtcttgccttcctgcctcgccacacatgtccctgtcccctagtgactggtgggatgtgtactctcttttcttccataagctggatgccacatcagcgctcccagctggataaatttccagcctccaagtagccccttagggtttacctttccagtaaaatacgaaacacaggactgtcacttcagacacaagggagaggaagtcaaaagacacaaccacagtttgacccatggcctctatattgatatagaaatgaggctgctaaagtcctctgttcctgttgtcccatcgaagatcgtttcttgttctgttaagtcatgccttcctgcacccaggggaaatgaagcgaacacccacccccaagcctgacaggcccagggagggttagtgtgaattctgtaccccatgagggtgatgctgagagttttggagttggtgtcctagttgtagcaaagaatttttgctgagaaggtaaaaatcttcagacttttttatttttattttttaattttaatttttttagagacagagtctcgctgtgtcgcccggcctggagtgcagtggcgcagtcttggctcaccgcaacctccacctcccgggttcaagcaattctcttgcctcagtctcccgagtagctgggactacaggtgcacaccgccacacctggctaatttttttgtattttagtagagatggggtttcaccatgttgcccaggctggtcttgaactcctgagctcaggcaatctgcccgccttggcctcccaaagtggtaggattacaggcgtgagccaccgcgcctggccaaaatcttcagacttaatagatgactgaattaatatatgggcctcaagtccaaagggaccaatgttttccctgcttccaggatactagttgagaggtgagaaggcaggcagcaaaggggtttggataagggggtggggaaacagaccccccacccccgccccgccggaagcctgtctttaaccctttgtgcttggatgttaaggctgatggcatgttgaactagttggcagtgtctttgggtgctgctgccttgaaggagtatcccagtaacacccatgttgttcttctgcaaaggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcaggtgagcccccccacctgaatttcagttactttaccagttgtcagttttttaatgtgtaaacaggattgggggagtatggtagggcagggcaccaggcagatttggtgaatgaagcttgtggtaatttgaatatatgcaatgtggccagtaagagaacgtgagtggtagcactgaggcgtgtctggatgctttaagttattctgtagattataagggaactccactcaattgctgataaccgatgttttaattattgtgaagggtatctaaagactgcatgacgtttacctatcaattgctttgatttctctgcctgtaagatagcaaatatacctagaagtgctgcttagaatgccttacttgatacctggtagagatgtgtagcagccgcatgtctgtgggattcatgcaaatttttcaccaaaaagaaaggaaaaaaaaaagaaaaaaggttgcttaaagggatagagtatgtatttaacttgctagtgaattatgatagatgttgtataggaatttccttaagatattttacttttaattaaaagatgaataaagccaaattgttttgcaatgttaagaaaaaaattggtttatgcttataaaaatggatgaagttatctaaatgatccattgagtgcccattttaattacatagatggaaggattacaagaggacagtattttatgtctacccgctgcttactgtgaggtcagttcttcaaatttttattactagaatcttacataaaccttttgagttaaatttcatttccaaatatacaaagggaagtttgtgggccatggtcgtctttattcattgtgtattttgtttcttttctgttgtgtttttgttttgttttctttgcgttgtgttttcgttttgttttatttaccttcaaaagagaatgtctgtctgtatgcaatagtgtatgtgtggatatacatacacatcgcatatatatctatatacacatgactttatgaataaagaatgtgtgactacttatatatagatactcttaagttttatctgttaaactttaaaatatctgagttacatctcataagctgtggttggttttgggcacttttctttgaaaatactttcctttaagataaggcaaatgaaatagcttttatggtaaggtgttgtttttttttttttccatctccgttctctttctagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgtaagtaaacctgagcagtttgcttgtgttggcctcaggtccggttggcatctgcttggagaaatgggctgcttttgccatgcatggaatgaagggccgattgtccttatgaatggtggcaaccaggaacgaggcgtctgtgaaagatagtttcctgggacacatctttttttccaaagaagcactggttctagagttgataacagtctaatataacgcagtgtagcagaggtatggcagtaggaaattaggtgcagggacaggttatattttgtagcagtggaatgacacttcccagccatctcctgccccacccctgtggtgacagtctgatgtggaatgaagagtccttatattctccctccaaaggcatagatgttgttgaagtaggatgaacatggtgaagtcaccataaagatgagcgttacgatttaccgtggggggtgggggagaattggccacagaatcccaaggcagcctggcatgcatgagggggctcttcccaccggacagagggcagcttgcattttggagggcaagtgatgtgaagagaaggctagtatcttcctcagtacactccctttggtccttacagcaggtcccccaccccaccaacagggttgactttgggatttgctcacgagtcttctagggtgctaagatgtgttggcagcaagtggaggtcttcctctttatttcttaaatatgcaagcttgaagctttaggtctgcttgcaacatgagaaacctcactgggcgaaggggaattagggtgtctgggtgaactaactggaggagtaggtgcaaagtcctcctgacacaggacacttggaagtgttgggtatgtttgagagctccccaccatgggccgtcggaggtttgacattcacaacacagttcatcggtgcctgacagagtttgggaagaatgtgtgatcagggagagtgtgcttcttgatactcggagcgcacacccctccctccacttccagctcatccctgggagcagactaaggccacctgccaggatcctgggtaagctaaaccaggactgatttgttgtaagtcattgctgaagaaagtagtttctgctgctaataggtggtggccttactcaagtggcagggactcaatgtacctgaagttgctcactcttcctcaaagagtggctacagggcagtgggaggtccaagccactcttgggtgaagtggcaaagaaagccttcctcctccctgatgattgctgccaactcgcagcccccactctgagttgcctcaacaccagctcttgggaaggttgtcagagggacctgggagaagtgggcaaggccgagttgatggggaaggtgcttctaaaagagggagtgccatacataagaatccctctttgttctgagtagatggctgggggcctggaggaagggacaggaacttagccagcttccagccttcttgcccttgctgtggtttttgagtaacatggccagaccctccgttcacatctgagtaactcggtgtggccaatggggagcagggcccaagccccacatgatgtagaaaggcctccctttccctttctgtaagtccctccaagcttcataccaacaggctgtgttcttggagcacccaggacagggccctgcaagccataagtcaccacgtagtgctcctcaggtaatgagccatggcagggagagcagaagaagagttgggggaaggtgaaggctgctttttaaatactagggccaaggaagagctggggcaccataggtttgtggttgatcaagaggaggaacctagaggaaatgttgtccttgctgctgccactgccatctcatccagggtacagcatgcgctggatccgtttggcttcaaattcactgagctatctcggccatcacgtctcttcatgggtgtcactgtggcccagagccaagctgtgagcatatggaaactggggtggggatttggggcaggcaggggtcacaaagagggtacaggatgcctccccgaagcctctcccctccactcctacagcaccagtagcttctgagatggcaggtgccgcctgtgcggcctcagctgcctgcgtgtgggtgcatcttgttgggagggcttgtttaaaaaaactgaattaactggacaacaccgtggttaggattttcattgactcttagtgatagtatgggttgctgagtttttcatttagaaattgaacaaatgagttaggagtgtccccaaactcctaaggaatgataagtggcattttgaagatggggtagggaacacggaggtgttgggcccttcctttttgtttttagttttattatttttattgattgatttacttttgttgatacatattagatgtgcatattagcccttccttcttgaatttgggtgtctgtctcccttggtagccacttggcttgtgtggacctaggactcactcagtggcaatgcctgagcgggagctggagaaagcgttgagtgaaagtgaaagggtttcatgggacttcttggctcaggaaacttctcttccaggacagcagcccctatgtactttgtaaactactttgagtttgggcagacagatgactaccaatgcctctgctgctggagagggtagaagttataacatggttggcctctgctagaggtgatgttgcctgcagagggagtagatgtcatgggcagtcctcaaaaatctcagtcctctgccatcctgtttagggcttactgggcgtggttataacagtggtgaggttgctttgttgccacggtgacttgtaaatgttgccatggcgatgcttccaggaggtattgcaatggcatagccatggtaaattatgggatgtatgtgctgtgccttataggaccatgatgcaaggagaaagtggtagacggtgtaggactcagccatgttcacatctgcctagatctcatgaccaaaggcacatggcattccactcacagaagggctgtaagtagttgcaatggaagaggaccctgatggttaggacccctatctatcccttcatctctgtctatgcacccatctcctttgccctcaagagtaatttctgtgggtactggtaagaatagccccatttgagggaggtccaagtgaagtgtacaggaaagtgacctggagcctctccctcatagctgtttgccatacgtatcttcggcagtcaaggtgggtgttctttgggattattactggcccatggagggaaaccctagcataaggtttgggggccttcactgaggggaattgggatgtttgccttgagaggctcaggggttgaaggaaggacaataggcctcatttgcggaaagatctcgtttgcggaaagatcttcttgagagcggacaagaagcatctacactgcgtgtgggcaggcatgattgcagtgaaccccagatgcagcagtggagggctcccgataatagttctggactattcaggaggcagaagggggccctgtccggctgaacggggaatggtggggacttggaggaggcatgtgtgtttcgcaccccttatcctagcctgctggcttccccatgaatggggagcagaaggtggtgtgtgcaggggagccctccccacccccactgggcagcttttcctagatggggagccccagagaagacagatggcaagacctccccatatctaatgggggtgctccctagcagagagactaggtccccagttagtcactgcctgttgatgccagtctgtgaaataagtgattacaagtcttctaggtggttttctgtggacaaaatatactggcagtttgggcataaggccaggtaggtgagatataaactcatttcactattaggaagtttgcagtgaaggtcaaaactccaatggaaaactttctccctgagaaagatgccttagacttggttgagattgttacaaatacaggtggctgtgtgagacctggagttcaaatggaagctgtggaagtcaaatccaaagcactagggttgagagattcttaatctgatggggatttgatgggggggggggggtgtctctgggaagggtgccaagacagggcagttcgttctgggtggggccccacactggctaagctgctgcctcattttgacccaggaaggcattgtgacattacctagtcacctctgctttcaaaccacttggctcaaaccctctctcctacctaaagggaggggaaatgagtacactttaaaagtataaaagtaaccttgcatgtggcgcttcgtaacacagtctttacatttttacattgcacccccagcccctcccacagggctttcaggggcggctgattggctccagaaagtcaaatagtatataactaggacaatcagttcacatcttaaactttcataaatatcagggctaaaaatcaagctggtctggggatcatagcgtccttttgtaagtaatttctccagccttaccctctgccctgctgcaccgtgtttatgaagcccaccgggggaggtggcttgcagtaatagtcccactttacaactcaagggggccaaactgtaaagtggcgctgttactgccagagtggttaagacacagagcaactcgagtcgcagcccaccctctttgcgtccccaggccaagctgagcacagtggtcaccacttctgcatagtgtaagttttgggcagcttgtgtgttttctcctgttgctgctgtgacataacaccaccttggccatgtttttggacgcccatccgttgctggttgtacctacagagacctggggtggtattccatggtgggggcttgggtgccgaatcccagtcccagccatccctgtccatacagtgcactgtcgtgagtgaggatgaggaggaacggttggggagattctaccattcctttgcaagaatagatgcagccccatctgttcccccttagaacacccttgaagagaaggtgaatgggtccttgcaccattgagagcacaggctagccaacacccctgtaaagctcacccccacagctgactgccgtgaaccgctggcaatgcccccgagagaagcgggtgagcggtgctggtcaggagtgggagtaatatttgaagtgggttggggagaggaagaatgagatcagcggatgaggcgtgtgcttatttcatctagaaattgacttgtgtgcctcagctcagagttaccaagacaccagactcataaccctggtgatgagagggatcatttcagcgggccaagggctgacaccttaacctcgcagtggtcattaagtagttatcatttatattcattgtgtattagaaaaattgtgaccagcaaagcagttaatgagctatttcttgggctagagcaaaaataggaagtgatgttgggctgaggtgattcaaggaaaagccccaaggcccgtgataggccgagcacagggttcctggaacgagcggttttgcaagcgctggcctggcatgggaaggacacaccaacaatgaggagatgtctgtcgatgcttgcctgtgacagagggtgtgaagaggagtgtcagctggggtggccagcatccccaagggggtccctttgtgttggacaggaaatgggaacagcccaacccattggtttcacatctgtgcatccagcaaatcgagttttttgaagttttctctgaactcgtgtatgtgttaggaaaccttgcctttggctttgccacgcccctcttcccagcagcctgggtctgcctgggttccctgcctccctctggcctggactgtaggcccagagccccccaggagtgagggtcacttctgcccatcaaggacctaggctttctttcaacactcttgtctccagtccattttcatctccccggttggcctaggtgaatattggtgttatcccttcgatagatgacattttggggatatttggtcactttatcctatcagcctgccatttatttcaaaataatgacctcagcaaatgtttccataaagatttttaggtcagccccagcttggttgcatcttctgctgaaaggactatagtgctttaaaaaacgtagcattgacgccccatctttcttggttccctcttgcccccaaccataagaagggagaaggagaaagtcaggagtgtgacatgcacctcactctgctttacttgccactcgtcttcaatgtaccctccctctggaaagttctgtttctgagggttttgtgctaaccatgtgtgaggaccccagtctccaaagaagcagctgtcaatagcagattaccttgggcatggtggtcccacgcactccccagatcctgccttctcatggcgaccttcgggcttcattaatgccctcttgtctcccctcccccaggcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaaggtgagccctgtctgcttcgcccgcctgccggggggtgggcctttgcatgcggccacagtggatggacaggagatgtggatgtgcggcgcgctgcccccgtagacagagtcggtgaggggaagccgtgggggcgcagcagtggagcggacctctccattcccacactgcctcgtgaggttcccaccctggagcccccggggggagccgcccacacctcccctcccccaaagccagaacccagatggccaaagatgattaggccccttcccaaaagcagagaccagtgaccacaccccccctcccccaccccattagtgatgcgtaagacagtttgttcccccccggggggctttttgattaatttgtagttatttctccattagatgactggcctgagagggaaatgacaaacagttcctctaaccacttagaagacccacattatagtgagctgaccaacctgaaggtgtgcattgaattaacagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggtatgcgggggccaccccttgagtgttcaccccgctcctggagggtgggtcatccactctctgtaggaaagggcttttgaggagatcttagaaggccatagcaattgacttcaacgaagatgtggcaggcagggagttctctcttgatgtccttgcccgtggttgcacaggaaggaagtctgaacaccttcattccagcctcaggctgtctccagtctctgggtcctgagcaacccagacccagtgggtagggggcaggaaagcaggaagagccagcttctgtcctctcttccgggccctttgaagcaacttgccacttggcgttttgtgggttaacttaggtgccgtttgaatgtggtataattaaaatattaatgctttgaaaacataattggtgtatctttaaaaactgaagccgctccagtgatcagtgttaacaatgggcttttcttcctgcactggctacaactgtgtaacgcccgcttcttctcccgtctcccatccgcccgccaccccgtcaccccctccgtatttaggcttgcctgtgttctccggctctccgcccatgaagagtctttcatccaccagtgcaggcggcaaaaagcaggctcagccaagctgcgcaccagcctccaggccgcctgccaaacag

SEQ ID NO: 4489 - DNA, 28276 bp, human
ggctgcctgacttgggagatggatgggctgagggagtggagggggacctcagaggagcaggaccagggagactcccaggacggtaagcaacatttgaggaccattcactaacgcttctctgcaggggtttcctctccatccatttccttgctgggttgtcagtgatgccatctgagttgctgtcagggctgtagcctgacaaagggtttcctaatagatccaaactgtccatttgtggggagcttctgattttctgttgttactggtttcccttagcccaacaccagggtcattaagaaggaaggaatgtgaggaagaaagaaaggcagggcattcaggaagaagtgtggaggcatgggagggttctcatggggccctcctgggcactgggtgacctgtcctttctcccctcaggtaggggtcccacggctgggtggtcctaagccactgggtggatgaaaggccgagggatgttggtcctgcttctgcatggtgagttctcctgccggtgggtgcaagggttgggaagaggggtggaagccacagagcttctgcccaaagagtctttaaagtggcttctgggacagcggtatctggacacttctgatcaggtttcactgaccctgtgatcgtgggggaggggatagagaaagcaagaaaacagcaggtggtggggatttttgtttcctaaaaacaaaactcctgagccgaatatatgaaatagtcctcttggtgattttcttattctaatttcagatatgaattcattggtgtgataaccaaaagctacagtgctacagtgtttttttgttttgttttgtttttggagatggagtctcgctctgtcacccaggctggagtacagtggtgcgacctcggcacactgcaagctccgcctcccgggttcacgccattctcctgcctcagcctcccgagtagctgggagtacaggtgcccgccaccacgcctggctaattttttgtatttttagtagagacggggtttcaccatgttagccaggatggtctcgatctcctgacctcgtgatctgcccgcctcggcctcccaaagtgctgggattacaggcgtgagccaccgtacggtggttttttcttttcttttcttttctttttttttttttttgagacagagtctcactctcgcccaagctggggagcagtggcatggatcttggctcactgcaacctccgcctcccgggttcaagtgattctcgtgcctcagcctcctgagtagctggaactataggcacctgccaccacgcccagctaattttttgtattgttagtaaagacggggtttcgccatattgcccaggctggtcttgaactcctgacctcaggtgatctgcctgtctcggcctcccaaagtgctgggattgcaggcatgaaccaccgtgcccagcctacagtggtttctaatcacattattttaagctcatttagttaaaaacaaaagtccctttaaaaaaccaccttcctaaaggaaaaagaaaaaatgaaaaatgccttggaattataggattatggatattgaagttatttttcaaagtttctcgctctgttatgtgcactttaatataccaagaagactcgttatgaaatattttccctggctctagctgttccaatctgactgagatagcccaaggaaaaatcctttaaattcttcagtaaatgattctacacaaagaatctgtttttttctgaccctcaagtgaatttaattatttgagatatgatgatctatgtaatagacctctgtatgcgatgctgatagagaacattttaccagatcatctaaaacaggagtaatggagttttcttcctctttattccaccttttcaaaaaccggaacttgctctgttcagtcaaccaacaggcatacactgtgtgccttcaaaacgctcgagagatatttatgagggatataatagcatgctctttgtctttgagaaaattcttttataagagattcaataaataagcaataaaaaaaattggagcaaggcacgtggaacactgtgataaataggacatgacttcctacctcgaagaggttctaaagaacagaggttgatatttatataattactaacagtcaacttcttgccattcctcctaccttgaaaaaaaaatgaaacttgattgactcattggggcacaatgtttgcttccaacagccagtatcattttaaacgtgcaccaaaagctctaccgttcctcacagaaagcagaccgtattcatagcctgcacacttcaaaacaggaactgtccctgctacagaaacccgaaatatatccagacttcttgtgacaagttggagagctcagcggtgacatcatttgctaacaatagatgcacttaaaattaatgaccatctccacatcccctggcactttaatttaaaacacactctagcaagcacagagaatatttctctgactgcgagtcacaagcaatacggacaatatgttcccgagaagcaggcagggatagtgctctacctccttggccagaaagaaaatgactaagtgagcctcacaaaacaacaccttggagaaatcagaagtggctcgcagcagggaaatttggggcaagagaaattctcctctggacacacagggctcctggaagtgccccacttctcagatgcataagtgcaaatacctccacctcctccccccatgttaacccctggggtcttcccgctgttcacagcataatatctgaaacccttaacttcttttacagggtctttcacatgtgacttcctctacactgagtcttcaaagagagtcaggggttgtgtgtttgtgttttttgtgtgtgtttcttttgagacagggtctcgctctgttgcccaggctggagtgcagtggcatgatctcagctcactgcaacctctgcctcccgggttcaagtgattctcgtgcctcagtctccagagtagctgggatgcgccaccaccacacctggttaatttttgtatgtttagtagtgatggggtttcaccatgttggccaggctggtcttgaactcatggcctcaagtgatctgcctgccttggccttccaaagtgctgggattacaggtgtgagccaccgtgccccaccaagatttgcattttaaaggaagtctataggaaaataaaatcacaatgaggtgccactcacacagctagaatggctacatttttttttttttttgagacagggtctcactctgtcgaccaggctgaagtgcagtggtactatctcgactcactgcaacctctgcctcctgggttcaagtgattctcatgcctcagcctcctgagtagctgggattgctggcgtgagccaccacacctggctaatatatatatatatatatttttttttttttttttttttttttttgggtatttttagtagagagggggtttcgccatgttggccaggctggtcttgaactcctgacctcaagtgatctgcccacctcggcctcccaaagtgctgggattacaggtgtgagccaccacgcccagccataatttttgcatttttagtagagatggggttttgccatgttggccaggctggtctcaaactcctggcctcaagtgacaggctcaagtgaggctgcctcagcctcccaaagtgctgggattagaggtgtgagccacaatgcccagccaagaatggctacaatttaaaacactgacaacaccaaatgttggtgagaatgtggagtaactggaactcccatacattgctgctgggaatgtataatggtgcaaccattttgaagaactgtttcttagaaagtgaaatacatacttatcatataactcagccatcccactcctagataaatgagaaacaaaaacacatgtcacagctttagtcacgataggctgaaactagaagcaatgcaaatgtccatcaacaggtgagtgaataaacaaattgaggcacctctatccagggaaatactgctcagcaatagaaaggaatgatcaactgatattcatgaccacatggatgaactttacagaaggttgtgcaaaataagcatttgatttcatttccttttgagacagagtcttgctctgtcgtccaggctggagtgcagtggtgtgatcttggctcactgcaacctccgcctcccgggttcacgtgattctcgtgcctcagcctcctgagtagctgggattacaggtgccccccaccatgctctgctaatttttgtatttttaataggcatggggttttgtcatgttggccaggctgttttcgaactcctgacctcaggtgatccacctgtctcggcctcccaaagtgctgggattgcatgcgtgagccactgcacccgaccttgatttcatttctgtaaagttctaaaacaggcaaaactaatctatagttcagaaagcaggtcagtggttgcctggagccaggggtgggaaaaggactgaagtcaaaggagcctgaggaaactttctgggtggtagaaatgttttaagtctttttgctgttgctgttgttgttgttctgagacagggtcttgctctgttgcccaggctggagtgtagtggtgcgattatggctcactgcagcctcaacctcctgggctcaaaggatcctcccacctcagcttcccgagtagctgggactaaatgtgcaccaccatgcctggctaatttttgttttttgttgtagagatggggtttcgccatgttgccctggctggtcttgaactcgtgacctcaagcaattctcctgcctcggcctcccaaagtgctgggtgcccagccagaaatgttctaagtcttgattggggtggtggttacacaggcatgtgtacatttattatacttactgaactgcacgcttaaaatgggtacattttattgtaagtaaagtataccttaatcaacttgatttaaaagaaaaaatgaaggctggagggagagagtggctgtaccagaagcagaaaaaatgcttcactgtccacagtcaggcagtgtggtatatcaggcaacatgtatgtgagattcatcaacgttattacgtggattagagtagtttttccttttgaatgcctagtaatattcatttgtacagattgactggttagtttatccattcccctattgtcgggtgtttgtttccagtttgaggtgattgtttatatttaggcccggaggcctttctggggccttgcgttcttctccttagatgggacagatgttcatcttcaagtttcaccaggcctgcgaggctaccagcacaccacccctctggaaacattgacttctccatcccttatgactcacgttagccagcaaaactgcagctcgaatcctttctttcctgtcacaaaaggtacctgcatggggtgaaaaccaagttctggggtcacaggaggccagaggccacagcatggtctccgcctccgcacttctgtttcctccagccagtcttgttttgaagatccagcattgggttttggtccgaggagccacttggtagcatttgccaagaatggaaggaaagtgatttctagagccaaggtagctaaatagattttgctgaaaccagaaatttgaccatgttttcccttgctatttttggtttcataaggctcaagttcttttaaaacaatgagaataaagaaacattccaatctcagtctgtggttggaaacaccaagtagctgttctcctagcaaacctcaaggtgggaaagcacatatttgaaaagccgagggcttaggaaagagaaactgctcagatggtctgcattagacctcattatgcgggtgcctgaggctggccatccctgcctccttgcagctcgggggctggccaggacacccgatagggacacacaagcagggagccatttctggtgtttattttcccagattcagggacgccttgtaagatttttaaaaaactgaaggaaaattcacacaagataaaattaaccattaactatcttattttcttcttcttcttcttttttttttttttgagatagagtcttgctctgtcgcccaggctggagtgcagtggtacgatctctgctcactgcaacctccgcctcccaggttcaagctattctcatgcctcagcctcccgagtagctgggactacaggcatgcaccaccatgcccagctaatttttatatttttagtagagatggggtttcaccatgttgccaaggctggtcttgaacccctggactcaagcaatctgcctgccttggcctctcaaagtgttgggattataggcgtgagccaccgtgccaggccttcattcctttttaaggccaaataatattccgttgtatagttatgccacatttgcttatccatccattggctgatggacatttgttgtttctaccttgggctgttgtgaataatgctgctgtgaacgtgcatgtgcaactgtctctttgagaccttgctgtcaattcctttaggcatatgcctaggcatggaattgctaggtcatatactaactctacattacactttgtaactctttatatcacacagatgaatcccatttttataaaattggtgcatctagacctttgatttttgactttggctgcatatggtaatcacctgtggagcttcaaacataccaatgcctgatcccacccctgaagattctgatgtaattgatctgatgtatggcctgggcactgtgagttttcaaagctccacaaggtgattctaatgttcagccctggaaatgaaccatcctagactccagactcctctttacagcctatccctagtaatagcttcagtattctgacaactggtgtcttgctttccattctagggcagatttccacatggtcccttttttttttgagatggagtctcactctgtcgctcaggctggagtgcagtggcgtgatctcagctcactgcaacctccgcctcccgggttcaagcaattcctctgcctcagcctccggagtagttgggactataggtgcatgccaccatgcctgaataattttttgtattttcagtagagacggggttcaccatattggccaggctggtcttgaactccttaccttgtgatccacctgcctcagcctcccaaagtgctgggattacaggtgtgagccactgcgcccggctgatcctttttttttaagatgggctctcactctgtcacctaggctggagcgcagtggcacaggcacagctcactgtagcctcgacctccttggctcaagcaatcctcccacctcagccttccaagtagctaggagtacaggtgtgcatcaccacgcctggctaatttttgtattttttgtagagatgaggtcttgccatgttgcccaggctcatcctgaacttccgggctcaagtgatcttcccaccttggcttcccaaagtgctgggatcacaggcatgagccactgcacctggcctccacatggtctttgaaggatttgtgccttagtgaggtttaatcctgtgacaagaatggttcataagagcccacaactagcttgggccagtgttttcacagctgtgtcaagcaacgagacacatctgtcccccataactgtctacaaattacagatgaggaaactgagagacagaggttgtctgaggtttttgtttttttgtttttttttttcttttgagacagagtctcactctgttgcccaggctggagtaaagtgttgcaatctcggctcactacaacctccgcctcctggattcaagtgattctcctgcctcagcctcctgagtagctgggattacaggcgcccaccaccatgcccggctaattttttgtgtttttagtggagacagggtttcaccgtgttggtcaggctggtctcgaactcctgacctcaggtgatctgcctgcctcggcctcccaaagtgctgggattacaggcatgagtcactgcgcccagcctgaggattttttttttttttaaagcagtatgacagaacagggatgagagtgtcctcagagtttatgagagaactaggtcaagaggctgtgccctcggggtgagtattttaagaccgaatgttctggaaagccttgcatgtgaatcccggggtgatgacagaggctggctgagtagggacctgtcatgagcccagggcagtcctgctacatttatttctcatcttcccctccctacctcagactgggaaaaaaaagctctgaagcctttttccgatttccagatggatccttccccaaaataccggtgcaagaagagaaattgctaagcaactgccaaatgagtttcaccttctcttttcacaaactgtaatctttatttttaatgtggtaaatgtttttctggccaaggtattcccatggaacccagctctgaatagccaaggagattcgtttttggaatgatcactgctgattctgggagaggctattttttcatttggattcagcaaaaccagggatgtcctaaacagtgtttgatttgatgttatgtatttcctgtcagcgaatggggagcagtttccttttggttgaggggtgctgcatggtcctgaatttgagttgttttctctgccaaggtgaagaggtcactggctgggtgcggtggctcatgcctgtaatcccagcactttgggaggctgaggagagcggatcacttgactaggcggttcaagaccagcctgatcaacatggtggaaccccgtttctactaaaaatacaaaaattagttgggcgtgatggtgcgtgccagtagtcccagctacttgggagactaggcaggagaatcgcttgaacccgggaggcagaggttgcagtgagctgagatcctgccattgcatcacgtggttcttcaggaaaaggaggagaggccaggaagagggagatggttctagagagattaagggagcctgtctgattcaggatattgctcaggactcttgttgcaaagcatcttctctaggtcattgaaggcaagaaggagtttacttagggacattaggtattctcaggcttcctactagaggccacactgcccagagcaatgcctaaaccaggaagtgcacagctccagcaaaaatcctgtggccactgccattggtggccatacctggcagctccagggaatcatgttgggtactgggtgccagaaatgcaagcctaaaagcctctgccatcattctggccagacattggtttctgcctggtgcctacttctgaatccaagtcttactgggtgtttgattgacaaagctatgtcacatgcctgagccctaactgtaaagggagttgagaaagagagtttccggcttccatcttgaggaggcaggacgtatgatgttggaaattctctaaatgtagaaagagtgcttaaaaggtactcaggagccagaacacatgctatggtctgaatgtttctgacccccattccccacccaattcatatattgaacccaactccccaagatgatggtattaggaggtggcgcctttaggaggggattaggtcctgagagtggagccctcatgaatggaattagtgccctcataaaagaggcctcagaggccaggtgtggtggttcatgcctgtaatcccagcactttgggaggctgaggcgggtggatcacctgagctcaggagttcacaccagcatgggcaacatggtgaaaccccatctctattaaaaatacaaaattacctgggcatggtggcgcatgcctgtaatcccagctactcgggaggctgaggcaggagaatcgcttgaacccgggaggcggaggttgcagtgagccgagatcgtgtcattgcactccaggcttgggcaacaagaacgaaactccatctcaaaaaaaaaaaaaaaaaaaggcctcagagagctcccttgccctttctaccacatgagaacacagtgagaagacaactgtctatgaaccaagaagtgggcccttggcagacgcagaatctgccttgctcttggatttgccagcctccagaactgtgagaaatcaatttctgttgtttgtaagccaccgagtctacggtagtgtgttatggcagcctgaactgattaagacaatacaccagcttcttcaccttgcccttggctcctgctcccccataactttgacctgcacatggctttggtacaaactccagccccaaagctagacaggttggtgctcacatcaccttactgactagttattcactgcctattccattttcacggagaaagaatgaatctgattagctctgtttaggtcaaagtgttcaactgcggtgcaaacagctgtggttgggaggagatggcagagacacatggggctctgagtagggtatttttttcttagaggcagtggctggcaacacctgctgtcagaccgtggaaaatgaaagctacaagggctctcaaagaccaggatgtgcagtgtcttagtctatttcgtgctgctgtaacaatactagagactgggcaatttataaagaacagatatttatatcttacatttctggaggttgggaagtccaggattgaggggctcacatcaagtaaaagccttcctgcggcgccatcccatggtggaaggtggaagtgtgagagagcaagatggggctgaacctgcttttattacaaatctacttttgcaataataacattaattccttcatgagagcagaggcctcacgacctaaccacctcttaaagagcccacctctcaacactactgcagtggggtttaagtctccaacacgtgaacttaggaggacatattcaaaccatagtatgcagtttcttcagtttacagttaaagcaatgaaatctcagaaaggctaggtgtgtggggtgggagatagtacagtatagtgaaaaacaaacaaaggttggcatcatttaaccgtcctgaacctcagtttcctctttcatgagaagagaagaataatccttatcttgcatggctgtcatattaaatggaataatgtctatggcaagcttagccctgagcaaattctttttgagacggagtctcactctattgcccaggctggagtgcagttgtatgatcttggctcactgcagcctctgccactcgggttcaagtgattctcctacctcagcccctctccccctgagtagctgggactacaggtgcgtgccaccatgcccagctaatttttgtatttttagtagagatggggtttcaccatgttggccaggctggtctcaaactcctgacctcaagtgatctacccacctcagcctcccaaagtgctgggattacaggcatgagccaccacacccggccctgagcaaattcttattaaaagctggttgttggccaggcgtagtggctcacgcctgtaatcccagcactttgggagaccaaagtgggcagatcacttaaggtcaggagttcgagaccagcctggccaacatggtgaaaccccgcctctaccaaaaatacacaaaaaattagccaggtgtggtggcaggtgcctgtagtcccagctacttgggaggctgaggcaggagaatcacttgaacccggcaggtggaggttgcagtgagctgagatggcgccactgcactccagcctgggcaacagagcgagactccgtctcaaacaacaacaacaacaacaacaaagttcgttgttttaagagcaaaagaaacccatacaatttaattaatttgagtagcattatacatgttcatattacccagataacatatgttaccacagtacctaaactatgtcctgtagatatttgctgtcatttgggggtgcttccatctgtaggtcttgttctgttgagctgccccgagccactcccagcagctctgttctaggactgcacgtaaatgtcatcatataggctgggtgtggtggcttatgcctgtaatcccagcactttgggaggccgaggcaggtggatctcctgaggtcaggagttcgagaccagcctgaccaacatggtgaaactccatctctactaaaaatacaaaaattatctgggtgtggtggtgggcgcctgtaatcccagctactcgggaggctgaggcagaagaatcacttgaacccaggaggcggaggttgcagtgagccgagatcatgccactgcactccaggctgggcaacagagcaagactctgtcttggggaaaaaaaaagaaaagaaaaaagaaaacaaaaagtcatcgtatagtatgtttcttttgtgtcaagtttctgttaacatgtttttattgcttgtatcagtagtttgttccttttattgctgagtagtattctactgtacaaataaattataatttatttctccattctactgttgggtaatttctactttttatcaattataaattagcctctatgaacactcttctatagtctttttgtggactttttttttttttttcatttctcttgggcaaatacctaggagtggaattgctgagtcatatgataggcatatatttagctttaatagatattgccaaagttttacaaagctattgagctattttacactcccattgactatgtgaaagaatctagttgttctccatcctcatcaacatatggggttatcagtcttttgaattttagcagaaaatctcactgcagttttaatttgcatttctctgatggctaatgatgctgagcaccttttcatgtgcttaatggccatgtaatatattctttttcttttttttttttttttgagacaaggtttcactttgtcacccaggctggagtgcggtggtgccatcttagctcactgcagcctctgcctcctgggttcaagcgattctcctgcctcagcctcttgagtagctgggattacaggcacccgctaccacatccggctaatttttgtatttttagtagagacggggtttcgccatgttggcggggctgttcttgaacccctgacctcaagtgatctgcccacctcggcctcccaaagaagtgttgggattccaggcgtgagccaccgcacccagcctattcttttgttaagcattcaagtcttttatccattttttaaaaataaattttaaaaaattttattctttttctttgctggcaaagtgaaagcaatcaccgatttttacttagttgtcttttcattattcatttgtaggagttatttttacattctgtatagtcatatatataacacatacatacatacatacaattcatatttaaagtgtatcctcacgaaaccatcacctcaatcaagataatgaacatatccatcacccccaagaatcatgccccattataatctctccctcctgcccttctttgcctccctactcatccccaggcaacccctgatctttctgttactatagattagtttacagtttctagaattttatgtaagcggagtcacacagtatgtattttttttttttttttttttttttttttttggtctggctcctttcactcagcagaattatctatcacgtgattcatccatgttgcaggtatcaatagtcattccttttttttttggcaattttaacattatttttttctctttcattttttaaaatttccataggtttttggggaacaggaggtatttggttacatgagtaagttctttagtggtgatttgtgatattttggtgcaatcatcacctgagcaacaaacactgaacccaaattatagtcttttatccctcaccccctcccaccctttccctctgagtccccaaaatccattgtatcattctcatgcctttgcatccttatagcttagctcccacttatgagtgagaatgcatgatatttggttttccattcctgagttacttcacttagaataatagtctccagtcccatccaggttgctgcgaatgccattaatttattcctttttatggctgagtaatattccgtcatatatatatatatatatatatacaccacagtttctttatccacttgttaactgatgggcatttggggtggttccatatttttgcaattgcgaattgtgctgctataaacgtgcgtgcaaggatctttttcatataatgacttcttttcctctgagtagatacccagtagtgggattgctggatcaaatggtagttctacttttagttctttaagggatctccacactgttttccatagtggttgtagtagtttacattcccaccagcagtgtagaagtgttccctgttcaccacatccatgccagcatctattattttttgattttttgattatggccattcttgcaggagtaaggtggttttgcgttgtggttttgatttgcatttctctgatcattaatgatgttgagcattttttcttttttctttttttcctgagacacagtctcactctgtcgtccaggctggagtgcagtggtgcgatctcggctcactgcaacctctgcctcctgggttcaagcaattctcctgcctcagcctcctgagtagctgggattacaggcacgggccaccacgcctggctaatttttgtatttttagtagagacggggtttcactatattggccaggctagtcttgaactcctgacctcgtgatccacccgcctcggcctcccaaagtgctgggattacaggcatgagcctccgtgcctggccaagcattttttcatgtttcttggccatttgtatatcttcttttgtgaattatccaatagtcattgctttttattgctgagtaatattccactgtatggctatatcatttgtttgcccattcaactcttgatggacgtttgcactgtttctagttttgggctattaagaataaagctgccaaagtctttgtatagacatacgcttttatttccctaggagtagaatggctggattataaggtaggcatatgtttaacttttaaagaaacaacctcattgtttccaatttggaagtcccattttacattccaccggcagtgtaagacagtcccacctgttccacatgttctccaacacttggcacctgttttagtcccttcaggctattgtatcaaagttccataaactgggtggcttataagcaacagaaatgtatttatcacaattctggaggctggaagtccaagattggggtgccagcatggttgggttctggtgatggctctttcctgggctgcaggctgctgtcttcttatagtatggccagtctttctaattttagccattctaataggtggctactttaatttgtatctccctaacaactaatgatgttgagcatcttttcatgtgcttatttatcttctgtctatctttttttggtgaaatgtttctgcaaatattttgcccatttattaattggattattttcttattgagttttgggagttcttcatatattttaaatacaagtctttaatgagatatgtgacttacaaatattttctcacagtctattgcccgtcttttcatttactttgcagtgtctttgaaagagaagaagttttaaattttgatgaagtctagtttattattattatttttaattttatggttattgctttttcttcttctctctctctttttttttgtcccaagaaatcttcacctacctctaggtaacaaagatactctcctgtgttatctccacgaagctttgtaagttttagcttttacatttaggtttacggtccatctaaaatgaattttgcgtatggtgtgaggtaggtgttgagattctttttactttccagggattacactatgcatccttgtcgtggtctaccttgaattaatcttgtattgcttcaagtataatgtaagatccttatgagagtacaattcaattcacctcccttctcatccttcatgtaattgttgtcatagttttcatttacgtgttttaaactccacaatacattgttatttttgttttaaatagtcacttgtcttttaagcaattaaggtgagaaatagtagtctctttttttttttttttctgagacggagttttgctcttgttgcccaggctggagtgcagtggcgcaatctcggctcactgcaacctctgcctcctgggttcaagcgattctcctgcctcagcctcccgagtggctgggactacaggtgtgcgccaccacacccagctaatttttgtatttttagtagagacggggtttcaccatgttggccaggatagtctagatctcttgacctagtgatctgcccgcctcggcctcccaacgtgctgggattacaggcatgagccaccacgtccagcccaatgcctggctaattttttgtatttttagtagagacagggtctcatcatgttggccaggctggtcttgaactcctgacctcaggtgatccacccccccatcggcctcccaaagtgctgggattacaggggtgagccaccgtgccggccagtagtcttttatatttagtaacatacttaccatttccatcgctctttattccttcttgtagacctaattttcatctaccagcattttctttcagactgaagaatgtcttcatttcctgtgcagaagatctgctggagaagaattttctcagattttgtttacctgaaaatatctctattgcccttcatttctgaagatatttttactggagagagagagaattctaggttgccaaattttgcttttcattcagcgcttaaagagcactaatcccattctttttttttttttttaaaacaaggtctggctctgtggcccaggcaggaattcagtggcatgatctccacttactgcaacctctgtctcctgggcttaagcgatcctcccacctcagcctcccaagtagctgggattacaggcacatgccaccacacatagttaatttttgtgtagagacagggttttgccatgttgcccaggctggtctcaaactcctgggctcaagcgatccacccacctcggcctccaaaagtgctaggattacaggcatgggccactgtgcccagccactaatcccattcttgatcatccactctcctgacctaagtacctctcaaagtctccatctcctaataccatcactttgggggttaggatttcaacacataaatttggaaggcggacataaacattcagaccataactgtgattatcttttactgttttttactctatgtaatatgtctttttgttttggatacttttaagaattttctatctttggctatgatgggccgtgcgtgtgtgtgtgtgtgtgtgtgtgtgttttatgttacttggggcttgctaagcttcttgttttaatcaaatttggaaactgtcatcaactatcttttagccatattctgtatcttctctcctctgagactccacatacatgtatattagtctaattgcttgatattgttccacaggtcattgaggctctgataatttttcccccagtcttctttttattttctctctgtgcttcactttggttaataactactcgcctctcttcaagtttatgaagattttcttctgcagtgtctaatctgctatttatcttattcaataatttttaaaatttcagctattgtttcagtactaagatttctactgggttcctttttagagtttccatacctcttctaaaattcagattccccatgtctttgcccatgatccctatcttttcctgtaaattccttaacatatttatagcaaatctttgcttggtaattccaacatgtgggctgtctgaatctgcttctgctgttttttttttccttcttgacaagtgtcatgtttgctgcttcttcacatgtctactagtatttggttgtacactggatactgcggagccagtggtagaaactctggattctcttgtcttctgttgaagagtgtagaattttgttctggcattcagttaaattactggcagatcaccttgttccctgaaagccttggttttaggctttttaagggtaggactacttgagttttgcctttagtcctgggaaatggtcttcactcctgaggcatggtcctttggggtttcagtggaaagctcaaggtatttgacaagctcctctaacttggcagaccttgaactcttttttttttttttttaagatagagccttgctctgttgcccaggctggagtgcagtggcatgatctcagctcactgcaacctccacctgtagtcccagctacctgccccccgagtagctgggactacaggtgcctgtcaccacacccagctattttttttttttttttgtatttttagtaaagatgaggttttaccatgttggctggtctcgaactcctgacctcaagtgatctgcctgcctcgccttcccaaagtgctgggattacaggcgtgaaccaccacgcccagctgggaccttgaactcttaaactgcctcctgtcactgggcaattgctaaaatctctgtttaggtcttttggtgtttagttcttgctttccccttgggctccctggagtcatcccacacatatgcccttcagaactcagccaaggacataaggggaacctgtatactaactttgtggctcctcttttgaggctccctttttccatgttttccctcctcaatttccagccactgtggcagctataaatgctgacctctaagctgtcagcttgctttctgctttagcttcactcaccatgtgctgtgtggacttgaaattgccctgagagagccgggcccagaggctcacgcctgtgatcccagcactttgggaggccgaggcaggaggatctcttgaggtcaggagttcaagaccagcctcggcaacatagtgataccttgtctacataaaattagctgggcatggtggtacatacttgtagtcccagctacttgggaggctgaggtgggaggattacccaagcccagggaggtcaagactgtggtgaaccgagattgcaccaccgcactccagcctgggcaacggagagaagagaccctgtctaaaaaaataaaaaataaaaaaaaaatcctgagaggaaaaatcagttagatgcacatctcacctagtttgtgtctcttctttgaagggttgcatcgactctgattgcctgttttggttgttccctggtgctttaaaacaatttttttttttttttgagacagagtttcgctcttgtagcccaggctggagtgtaatggcgtgaacctggctcactgcaacctctgcctcccaggttcaagcaattttcctgcctcagcctctcgagtagctgggattacaggtgcccgccaccatgcctggctaatttttttttttttttgtagttttagtagagacagggtttcgccatgttggccagactggtctttttttttttttttttttttttttgagatgaattttcgctcttgttgcccaggctggagtgcaatggtgtgatcttggctcactgcaacctccgcctcacgagttcaagagatttgcttgcttcagcctcctaagtagctgggattacaggtgcctgccaccatgccaggctaatttttgtttgtttgtagttttagtagaggcagggtttcgccatgttggccagactggtctcgaactcctgacctccggtgatccacccacctcggcctcccaaagtgctgggattacaggtgtgagccaccacgcccagctaaaacaatttttttaaaaaaattttgtccagagtctaccatagatagcagtgggaatgttagtctgatagaagctactctgccatgattgcagtagaactcatccacatatattattattaaaagaatttttttttggtgccttgcttttctggctcactaaacatgtacttagtctttatactgaacaaaccaatacagttttgctgtcagttctgagaatttacttgacttaatttattattattattatttattatttattattttagatggagtctcactgtgtcactcaggctggagtacagtggcatgatcttggctcactgcaacctctgcctcccgggttcaagcgattcttgtgcgtcagcctcctgagtagctgggattacaggcgtgtgccactgcgtctggctaatttttgtatttttagtagagacggggtttcaccatgttggccaggctggtctcgaactcctgacctcaggtgatctgtctgcctctgcctcccaaagtgctggaattacagtcatgagccaccgcgcctggagacttaatttattattttttgggaggacaaggtcttgctctgttgtccaggctggagttcagtggtccaatcatagctcactgtaatcttgaactcctgggctcaagtaatcttcctgcctcagcctcctgagtagctgggactacaggtgcacaccactgtgcatggctaatttttttattttttatagagataggggtctcactatattgcccaggctggtctgaaactcctgggctcaagcgatcctcctgccatagcctcacaaagtgctgggattacaggtgtgagccactgtacccggccttgacttaatttaaatgtcactaaataatccagtaaattagttattgctcctaatggctatcaaagtttcagaggctaaaaataagtctctaatagtgacaatttcttgagtgtttaattaaagtttaaactctaatctattttttgaaataggtaacatagccacatggttcaaaatgttaaaggctaaaagcagtgtacattgagaagcttcagtctcactcttctcatatatgttttttaaacataggcagctacctttctgatctcttgcattatacaaattggttgtatcctgactgttgtaatcccaggagttccttgacaaataatttttttttttttttttttgagacagagtctcgctctgttgcctgggctggagtgcagtagtgtgatctcagctcactgcaacctctgcctccctggttcaagtgattcttatgcctcagcctccagagtagctgggactacaggcacgcgccaccacacctggctaatttttgtatttttagtagagatggggtttcaccatgttggccaggctggtcttgaacttctgactccagtgatctgcacgccttggcctcccaaagtgctgggattgcaggcatgagcaccatgcctggccagcaaacaatttttaaaataaatggaggaatccttgcataggaaggcatcatttaattctacaaacgtttattgagccatacagtgcgcctggaacagtgttagctattgtggggtataaacatgagtcatatgactgagtgtactttccttaattagaaagaagagagtagaatgaaggactatttgtaaagaaacctgatgcctgatacttgacctagttggaagggttgatagaaaaaggttctgcctctttccagctgaggcctgcagttaaggttatattcttggccctgtctccctagcagggtgtctccccagcccagcagcagccctgtttacagccaggctcagcacagagcccaagaaccttgctggaagcttggtgtctatctcagtttttagggagatggaaaagctaagtcaggcatcctcaacatcagaatgttgaagtggctccagtttacaactgaggggctgttcaaaggcctgagtgctcttcagctgtgtctgagagggctggatccacttctcagctgcttagaaaacatggagtgtccataacagatgacctgaaaagacactggaaaccaagcagagctacagaggtggcagcaagtgtattctacatatcccttttggggccacatcttcaggttcctgcagggacttgggtaggcaaggccgggtaatgtgtacagaatgggaggatgtgagtggcaggccaggggtatttgctaggaattcgggagtactgatgaggaggggtagaaattatgaatcggtgggcatatttacatctgggtaccgtttgctctcctacaggaatttcagatagagctgcccctgaccatgaaataaacattgtgcatctaccatgctgtcttttccattggtcctcaagattgggcttggggcctctggcttccacagggtagcaggccacgatgacattctactttttttttttttttttgagacggagtctcactctgtcacccaggctagagtgtagtggtgcaatctcggctcactgcaacctttgcctcctgggttcaagcaattctcctgcttcagcctcccgagtagctgggattataggtgcatgccaccacacccggctaatttttgtacttttagtagagacagggtttcaccatgttggccaggctagtctcgaacacctgaccttaggtgatccacccgcctctgcctcccaaagtgctgggattacaggcatgagccactgtgcccagcctcatgacattctactttgctgcaggtggcaagcctacttgtgggcttttgaagtctttatctgatcctccattcaaatgctcaaaatgaaagtaatttataagcaacttactctcccatgatgatgtaaaaaagtttctagcaggcaaggactggtgaatggaacttaactgcagcgtgtctataattaattcttttgagatgtgcaagaaggtcattgattttatttagtatgctgtccttttggcttaattttagtgactgttacagaaaaaaaaaattgattgacaggcttttctttcattcccaatctcctgctccctaattctccctcctccttgaggcataatttactcaatgggggtgttcaggaattgaattcttctggtgagaggaactatagtagcaccaacagaaatataacacaagccgcatgtttaaaaattctgagtagtcacattaaaaaacgtaaaaagaaacagttaacattaattttaatattttatttaacccaatatatctaaaataccattgtaacatgtaatcagtataaaaatcattgatgcagctgggtgtggtggctcacacctgtaatcccagcactttgggaggccaaggtgggcggatcaactgaggtcaggagtttgagaccagcctggccaatatggcaaaaccctatctctactaaaaatacaaaaattagccgggtgtggtggcacatgcctgtaatcccagctactcgggtggctgaggcagaagaatcacttgaacctgggaggcggaggttgcagtgggccgagattagcgccattgcactccagcctggcgacagagtgaggactctgtctcaaaaaaaaaaaaaaaaaaatcattgatgcagtattttactctttttaagtctttgaaatctggtgtgtcttctatatgcatagcacatctcaatttgggttggccacatttcaaatgctcagtagcccacggggctagtggctactgtattgggcagcgcagatctagggtgaaggccacagcgatgtcctcggagatcccccagggcctgcagacaacaaaccctcaaggccacattctagtgttccccgaccaaactgagggtggggctgctatttctcacggcccaataatgagatgcagatgaactgggaaaggagggagttttttatttctgtaactggttacagggaaaaggcctggaaaatatctctagaccaactcaaaattacgaacttttccagagcttatataccttctttttttggaggggggggatggagtttcactcttttcacccaggctggagtgcaatggcactatctcagctcactgcaacctccgctttctgggttcaagcaattctcctgcctcagccttctgagcagttgggattacaggtgcccaccaccatgcccggctaatttttgtatttttagtagagacggggtttcaccatgttggccaggctagtctttaactcctcacctcaggtgatctgcccacctcggcctctcgaagtgttgggattacaggcgtgagccaccgcacctggcccagagtttatataccttctaagctacatgtctacgtgtaagtgtgcattcatctaaagacatgtgattaacttcttttaatctataactaaggtctgagtcctgaagaccttcctctggagcctcagtaaatttacttaatctagatgggtccaggtgctggggtgattacccttattttgtctcctgctaaatcatggaggtttggggagttcctccagacccccaataaacttgtctgtggaggtctggggagtttagacccccagtaaaacttgtttaatcctaaatgggtcctgttaagaattatttcataatcttgtcatgctttaaggcccaggaaaggcttgggcaaaactcttggtgggcttttgttaccttccagcctttgtataagggcactggtgtatatatatatatgtatttttttttttttttcccctggggtaactggttctttagcaagaggggagcactggggagtatcttcagggtggctgaactttgcaacctctttaataaacaacttccccctgtgcagtttgtcctcctttatcaccacactccgatgccctggtattcaggcaatggcatcaggcccatatttccgtagagttcagagttctgtgaggtagagcattccttccaatgggatcttagaattcttagagttgcagaattttactgactagactcaggaggtctcaggagtccagacttccttaaagcttggctcaaaattccaagggagctcataactccatggagcccagagttcctggctcgggaacattgggaggcctgggatacagtggcttagcctcaagcaaaaaggtgaacaatatctttatggcttgaaggtatacgaaataatgtcactacatcggagcagcgcctctgcttgcacacctatgggagtctgtagctgtgacacatagaagttggccacatccatgtcggtggctccaaagtgggtggccacacgcacaccctcgtgcaatgtgaagctcacctgatgactcaccatggccagcaggccgcggaggtaacgatcccgaagggcggctcgggcccgctgcttctgggattccaaggattcttgagctatggaacactcctggatttcaagaacctctgactacaggggggctctgcgtccatcaggggcaaagccacggctgagaccatcagggcctcggggcagccggagcacaggcacaggaaaggtcactggagcctgcattgtcttggcgaggtccgtggctactgtgcgcgcccccacttccgccggcaccccgcagtagaggccagggcaggccccgagccgcggagcctgggttccgcctgcgccaccgccaccaacccacgtgtcacgggcaaatttatttatttatttatttatttttgatatggagtctcactctgtcgcccaggctagagtgctgtggcgtgatctcagctcactggaacctccgcctcccgggttcaagggattctcgtgcttcagcctcccaagtaggtgggattacaggagcccgtcaccacgcccggctaatttttgtatttttagtagagacggagtttcaccatgttgctcaggctggtgtgaactcctgagctcaggtgatctgcccgcctcggcctcccaaagtgctgggattacaggcgtgagccactgcgaccggtcagcttttaatatttaacttaaccattcagtcagtgccgaaacagtagttatggaggcctgcattagtgagtcctggcctgccacactaggagcacacaagtggtggtacaggcaggagggagtttagaacggggtcagctgcagggattgcagctgggttttgctgattaaggtaaccggaaagcaaaggagcgggtgtcttaggtggataaacccgtgtgaggccgcggaggtgggaagaggccatgtgcctgacacaagataactcggtggagggcctgcatcctgctgcccggacaggcaggatttttcctggggtgacctttggctgacggttgctccttttttctcttttctcctccttcccgactccccaccaccctgtccccgcagcggtggtcctcggcctgcccagcgcctgggccgtgggggcctgcgcccgcgcttgtcccgccgcctgcgcctgcagcaccgtggagcgcggctgctcggtgcgctgcgaccgcgcgggcctcctgcgggtgccggccgagctcccgtgcgaggcggtctccatcgacctggaccggaacggcctgcgcttcctgggcgagcgagccttcggcacgctgccgtccttgcgccgcctgtcgctgcgccacaacaacctgtccttcatcacgcccggcgccttcaagggcctgccgcgcctggctgagctgcgcctggcgcacaacggcgacctgcgctacctgcacgcgcgcaccttcgcggcgctcagccgcctgcgccgcctagacctagcagcctgccgcctcttcagcgtgcccgagcgcctcctggccgaactgccggccctgcgcgaactcgccgccttcgacaacctgttccgccgcgtgccgggcgcgctgcgcggcctggccaacctgacgcacgcgcacctggagcgcggccgcatcgaggcggtggcctccagctcgctgcagggcctgcgccgcctgcgctcgctcagcctgcaggccaaccgcgtccgtgccgtgcacgctggcgccttcggggactgtggcgtcctggagcatctgctgctcaacgacaacctgctggccgagctcccggccgacgccttccgcggcctgcggcgcctgcgcacgctcaacctgggtggcaacgcgctggaccgcgtggcgcgcgcctggttcgctgacctggccgagctcgagctgctctacctggaccgcaacagcatcgccttcgtggaggagggcgccttccagaacctctcgggtctcctcgcgctgcacctcaacggcaaccgcctcaccgtgctcgcctgggtcgccttccagcccggcttcttcctgggccgcctcttcctcttccgcaacccgtggtgctgcgactgccgtctggagtggctgagggactggatggagggctccggacgtgtcaccgacgtgccgtgcgcctccccgggctccgtggccggcctggacctcagccaggtgaccttcgggcgctcctccgatggcctctgtgtggaccccgaggagctgaacctcaccacgtccagtccaggcccgtccccagaaccagcggccaccaccgtgagcaggttcagcagcctcctctccaagctgctggccccgagggtcccggtggaggaggcggccaacaccactggggggctggccaacgcctccctgtccgacagcctctcctcccgtggggtgggaggcgcgggccggcagccctggtttctcctcgcctcttgtctcctgcccagcgtggcccagcacgtggtgtttggcctgcagatggactgacctggccagaggggggaaagtttgcttaactgggcttgagtgtgtttgtggtaaggggagaggagccggaatggagggcagaggtgaaaatcccagtggagggtggaaggaaccgtttgcctccagagatggccccagggagaacacagggacgtgccactcgagggggaggatggtatggatttctgcttttgtcacacgggcatccattggaaaagagaagcaagaatgaacgtgggccctcgggtgggaagactaggaatcggaagcttctagggcttcacatcccttcccctcccctccccttcccctcatcttccaggcaacagtgcctgcaaggcctgaattagagagacttccattggctaagtagttaagagccgtcccatttctcctggcggggtaacccattacaccgaagtcctttgttttctaccacaatcctcctcctcctctccaggggcctggaaacactaggattcaggaaggtaggcaggacgtgagagaagggagatgggagagagatttaagacaaagggtggcggtggttcctggggtctgagatgtgttaggaggcgtttaaaacaaagatccagttcatttactccacagttattcccagggctggccctagccacaaaggaactttagggcagggtagggaaaaaaggggcagcagggggtgtgtttgtggacaaataaatttgtaaagtccgaggattaaaaaaaaaaaaaggttaaaccggtttctctactgctggacttttcagagtctttcatatgctaacattcattgtgaatctcccaagag

SEQ ID NO: 4490 - DNA, 28192 bp, human
gctgagggagtggagggggacctcagaggagcaggaccagggagactcccaggacggtaagcaacatttgaggaccattcactaacgcttctctgcaggggtttcctctccatccatttccttgctgggttgtcagtgatgccatctgagttgctgtcagggctgtagcctgacaaagggtttcctaatagatccaaactgtccatttgtggggagcttctgattttctgttgttactggtttcccttagcccaacaccagggtcattaagaaggaaggaatgtgaggaagaaagaaaggcagggcattcaggaagaagtgtggaggcatgggagggttctcatggggccctcctgggcactgggtgacctgtcctttctcccctcaggtaggggtcccacggctgggtggtcctaagccactgggtggatgaaaggccgagggatgttggtcctgcttctgcatggtgagttctcctgccggtgggtgcaagggttgggaagaggggtggaagccacagagcttctgcccaaagagtctttaaagtggcttctgggacagcggtatctggacacttctgatcaggtttcactgaccctgtgatcgtgggggaggggatagagaaagcaagaaaacagcaggtggtggggatttttgtttcctaaaaacaaaactcctgagccgaatatatgaaatagtcctcttggtgattttcttattctaatttcagatatgaattcattggtgtgataaccaaaagctacagtgctacagtgtttttttgttttgttttgtttttggagatggagtctcgctctgtcacccaggctggagtacagtggtgcgacctcggcacactgcaagctccgcctcccgggttcacgccattctcctgcctcagcctcccgagtagctgggagtacaggtgcccgccaccacgcctggctaattttttgtatttttagtagagacggggtttcaccatgttagccaggatggtctcgatctcctgacctcgtgatctgcccgcctcggcctcccaaagtgctgggattacaggcgtgagccaccgtacggtggttttttcttttcttttcttttctttttttttttttttgagacagagtctcactctcgcccaagctggggagcagtggcatggatcttggctcactgcaacctccgcctcccgggttcaagtgattctcgtgcctcagcctcctgagtagctggaactataggcacctgccaccacgcccagctaattttttgtattgttagtaaagacggggtttcgccatattgcccaggctggtcttgaactcctgacctcaggtgatctgcctgtctcggcctcccaaagtgctgggattgcaggcatgaaccaccgtgcccagcctacagtggtttctaatcacattattttaagctcatttagttaaaaacaaaagtccctttaaaaaaccaccttcctaaaggaaaaagaaaaaatgaaaaatgccttggaattataggattatggatattgaagttatttttcaaagtttctcgctctgttatgtgcactttaatataccaagaagactcgttatgaaatattttccctggctctagctgttccaatctgactgagatagcccaaggaaaaatcctttaaattcttcagtaaatgattctacacaaagaatctgtttttttctgaccctcaagtgaatttaattatttgagatatgatgatctatgtaatagacctctgtatgcgatgctgatagagaacattttaccagatcatctaaaacaggagtaatggagttttcttcctctttattccaccttttcaaaaaccggaacttgctctgttcagtcaaccaacaggcatacactgtgtgccttcaaaacgctcgagagatatttatgagggatataatagcatgctctttgtctttgagaaaattcttttataagagattcaataaataagcaataaaaaaaattggagcaaggcacgtggaacactgtgataaataggacatgacttcctacctcgaagaggttctaaagaacagaggttgatatttatataattactaacagtcaacttcttgccattcctcctaccttgaaaaaaaaatgaaacttgattgactcattggggcacaatgtttgcttccaacagccagtatcattttaaacgtgcaccaaaagctctaccgttcctcacagaaagcagaccgtattcatagcctgcacacttcaaaacaggaactgtccctgctacagaaacccgaaatatatccagacttcttgtgacaagttggagagctcagcggtgacatcatttgctaacaatagatgcacttaaaattaatgaccatctccacatcccctggcactttaatttaaaacacactctagcaagcacagagaatatttctctgactgcgagtcacaagcaatacggacaatatgttcccgagaagcaggcagggatagtgctctacctccttggccagaaagaaaatgactaagtgagcctcacaaaacaacaccttggagaaatcagaagtggctcgcagcagggaaatttggggcaagagaaattctcctctggacacacagggctcctggaagtgccccacttctcagatgcataagtgcaaatacctccacctcctccccccatgttaacccctggggtcttcccgctgttcacagcataatatctgaaacccttaacttcttttacagggtctttcacatgtgacttcctctacactgagtcttcaaagagagtcaggggttgtgtgtttgtgttttttgtgtgtgtttcttttgagacagggtctcgctctgttgcccaggctggagtgcagtggcatgatctcagctcactgcaacctctgcctcccgggttcaagtgattctcgtgcctcagtctccagagtagctgggatgcgccaccaccacacctggttaatttttgtatgtttagtagtgatggggtttcaccatgttggccaggctggtcttgaactcatggcctcaagtgatctgcctgccttggccttccaaagtgctgggattacaggtgtgagccaccgtgccccaccaagatttgcattttaaaggaagtctataggaaaataaaatcacaatgaggtgccactcacacagctagaatggctacatttttttttttttttgagacagggtctcactctgtcgaccaggctgaagtgcagtggtactatctcgactcactgcaacctctgcctcctgggttcaagtgattctcatgcctcagcctcctgagtagctgggattgctggcgtgagccaccacacctggctaatatatatatatatatatttttttttttttttttttttttttttgggtatttttagtagagagggggtttcgccatgttggccaggctggtcttgaactcctgacctcaagtgatctgcccacctcggcctcccaaagtgctgggattacaggtgtgagccaccacgcccagccataatttttgcatttttagtagagatggggttttgccatgttggccaggctggtctcaaactcctggcctcaagtgacaggctcaagtgaggctgcctcagcctcccaaagtgctgggattagaggtgtgagccacaatgcccagccaagaatggctacaatttaaaacactgacaacaccaaatgttggtgagaatgtggagtaactggaactcccatacattgctgctgggaatgtataatggtgcaaccattttgaagaactgtttcttagaaagtgaaatacatacttatcatataactcagccatcccactcctagataaatgagaaacaaaaacacatgtcacagctttagtcacgataggctgaaactagaagcaatgcaaatgtccatcaacaggtgagtgaataaacaaattgaggcacctctatccagggaaatactgctcagcaatagaaaggaatgatcaactgatattcatgaccacatggatgaactttacagaaggttgtgcaaaataagcatttgatttcatttccttttgagacagagtcttgctctgtcgtccaggctggagtgcagtggtgtgatcttggctcactgcaacctccgcctcccgggttcacgtgattctcgtgcctcagcctcctgagtagctgggattacaggtgccccccaccatgctctgctaatttttgtatttttaataggcatggggttttgtcatgttggccaggctgttttcgaactcctgacctcaggtgatccacctgtctcggcctcccaaagtgctgggattgcatgcgtgagccactgcacccgaccttgatttcatttctgtaaagttctaaaacaggcaaaactaatctatagttcagaaagcaggtcagtggttgcctggagccaggggtgggaaaaggactgaagtcaaaggagcctgaggaaactttctgggtggtagaaatgttttaagtctttttgctgttgctgttgttgttgttctgagacagggtcttgctctgttgcccaggctggagtgtagtggtgcgattatggctcactgcagcctcaacctcctgggctcaaaggatcctcccacctcagcttcccgagtagctgggactaaatgtgcaccaccatgcctggctaatttttgttttttgttgtagagatggggtttcgccatgttgccctggctggtcttgaactcgtgacctcaagcaattctcctgcctcggcctcccaaagtgctgggtgcccagccagaaatgttctaagtcttgattggggtggtggttacacaggcatgtgtacatttattatacttactgaactgcacgcttaaaatgggtacattttattgtaagtaaagtataccttaatcaacttgatttaaaagaaaaaatgaaggctggagggagagagtggctgtaccagaagcagaaaaaatgcttcactgtccacagtcaggcagtgtggtatatcaggcaacatgtatgtgagattcatcaacgttattacgtggattagagtagtttttccttttgaatgcctagtaatattcatttgtacagattgactggttagtttatccattcccctattgtcgggtgtttgtttccagtttgaggtgattgtttatatttaggcccggaggcctttctggggccttgcgttcttctccttagatgggacagatgttcatcttcaagtttcaccaggcctgcgaggctaccagcacaccacccctctggaaacattgacttctccatcccttatgactcacgttagccagcaaaactgcagctcgaatcctttctttcctgtcacaaaaggtacctgcatggggtgaaaaccaagttctggggtcacaggaggccagaggccacagcatggtctccgcctccgcacttctgtttcctccagccagtcttgttttgaagatccagcattgggttttggtccgaggagccacttggtagcatttgccaagaatggaaggaaagtgatttctagagccaaggtagctaaatagattttgctgaaaccagaaatttgaccatgttttcccttgctatttttggtttcataaggctcaagttcttttaaaacaatgagaataaagaaacattccaatctcagtctgtggttggaaacaccaagtagctgttctcctagcaaacctcaaggtgggaaagcacatatttgaaaagccgagggcttaggaaagagaaactgctcagatggtctgcattagacctcattatgcgggtgcctgaggctggccatccctgcctccttgcagctcgggggctggccaggacacccgatagggacacacaagcagggagccatttctggtgtttattttcccagattcagggacgccttgtaagatttttaaaaaactgaaggaaaattcacacaagataaaattaaccattaactatcttattttcttcttcttcttcttttttttttttttgagatagagtcttgctctgtcgcccaggctggagtgcagtggtacgatctctgctcactgcaacctccgcctcccaggttcaagctattctcatgcctcagcctcccgagtagctgggactacaggcatgcaccaccatgcccagctaatttttatatttttagtagagatggggtttcaccatgttgccaaggctggtcttgaacccctggactcaagcaatctgcctgccttggcctctcaaagtgttgggattataggcgtgagccaccgtgccaggccttcattcctttttaaggccaaataatattccgttgtatagttatgccacatttgcttatccatccattggctgatggacatttgttgtttctaccttgggctgttgtgaataatgctgctgtgaacgtgcatgtgcaactgtctctttgagaccttgctgtcaattcctttaggcatatgcctaggcatggaattgctaggtcatatactaactctacattacactttgtaactctttatatcacacagatgaatcccatttttataaaattggtgcatctagacctttgatttttgactttggctgcatatggtaatcacctgtggagcttcaaacataccaatgcctgatcccacccctgaagattctgatgtaattgatctgatgtatggcctgggcactgtgagttttcaaagctccacaaggtgattctaatgttcagccctggaaatgaaccatcctagactccagactcctctttacagcctatccctagtaatagcttcagtattctgacaactggtgtcttgctttccattctagggcagatttccacatggtcccttttttttttgagatggagtctcactctgtcgctcaggctggagtgcagtggcgtgatctcagctcactgcaacctccgcctcccgggttcaagcaattcctctgcctcagcctccggagtagttgggactataggtgcatgccaccatgcctgaataattttttgtattttcagtagagacggggttcaccatattggccaggctggtcttgaactccttaccttgtgatccacctgcctcagcctcccaaagtgctgggattacaggtgtgagccactgcgcccggctgatcctttttttttaagatgggctctcactctgtcacctaggctggagcgcagtggcacaggcacagctcactgtagcctcgacctccttggctcaagcaatcctcccacctcagccttccaagtagctaggagtacaggtgtgcatcaccacgcctggctaatttttgtattttttgtagagatgaggtcttgccatgttgcccaggctcatcctgaacttccgggctcaagtgatcttcccaccttggcttcccaaagtgctgggatcacaggcatgagccactgcacctggcctccacatggtctttgaaggatttgtgccttagtgaggtttaatcctgtgacaagaatggttcataagagcccacaactagcttgggccagtgttttcacagctgtgtcaagcaacgagacacatctgtcccccataactgtctacaaattacagatgaggaaactgagagacagaggttgtctgaggtttttgtttttttgtttttttttttcttttgagacagagtctcactctgttgcccaggctggagtaaagtgttgcaatctcggctcactacaacctccgcctcctggattcaagtgattctcctgcctcagcctcctgagtagctgggattacaggcgcccaccaccatgcccggctaattttttgtgtttttagtggagacagggtttcaccgtgttggtcaggctggtctcgaactcctgacctcaggtgatctgcctgcctcggcctcccaaagtgctgggattacaggcatgagtcactgcgcccagcctgaggattttttttttttttaaagcagtatgacagaacagggatgagagtgtcctcagagtttatgagagaactaggtcaagaggctgtgccctcggggtgagtattttaagaccgaatgttctggaaagccttgcatgtgaatcccggggtgatgacagaggctggctgagtagggacctgtcatgagcccagggcagtcctgctacatttatttctcatcttcccctccctacctcagactgggaaaaaaaagctctgaagcctttttccgatttccagatggatccttccccaaaataccggtgcaagaagagaaattgctaagcaactgccaaatgagtttcaccttctcttttcacaaactgtaatctttatttttaatgtggtaaatgtttttctggccaaggtattcccatggaacccagctctgaatagccaaggagattcgtttttggaatgatcactgctgattctgggagaggctattttttcatttggattcagcaaaaccagggatgtcctaaacagtgtttgatttgatgttatgtatttcctgtcagcgaatggggagcagtttccttttggttgaggggtgctgcatggtcctgaatttgagttgttttctctgccaaggtgaagaggtcactggctgggtgcggtggctcatgcctgtaatcccagcactttgggaggctgaggagagcggatcacttgactaggcggttcaagaccagcctgatcaacatggtggaaccccgtttctactaaaaatacaaaaattagttgggcgtgatggtgcgtgccagtagtcccagctacttgggagactaggcaggagaatcgcttgaacccgggaggcagaggttgcagtgagctgagatcctgccattgcatcacgtggttcttcaggaaaaggaggagaggccaggaagagggagatggttctagagagattaagggagcctgtctgattcaggatattgctcaggactcttgttgcaaagcatcttctctaggtcattgaaggcaagaaggagtttacttagggacattaggtattctcaggcttcctactagaggccacactgcccagagcaatgcctaaaccaggaagtgcacagctccagcaaaaatcctgtggccactgccattggtggccatacctggcagctccagggaatcatgttgggtactgggtgccagaaatgcaagcctaaaagcctctgccatcattctggccagacattggtttctgcctggtgcctacttctgaatccaagtcttactgggtgtttgattgacaaagctatgtcacatgcctgagccctaactgtaaagggagttgagaaagagagtttccggcttccatcttgaggaggcaggacgtatgatgttggaaattctctaaatgtagaaagagtgcttaaaaggtactcaggagccagaacacatgctatggtctgaatgtttctgacccccattccccacccaattcatatattgaacccaactccccaagatgatggtattaggaggtggcgcctttaggaggggattaggtcctgagagtggagccctcatgaatggaattagtgccctcataaaagaggcctcagaggccaggtgtggtggttcatgcctgtaatcccagcactttgggaggctgaggcgggtggatcacctgagctcaggagttcacaccagcatgggcaacatggtgaaaccccatctctattaaaaatacaaaattacctgggcatggtggcgcatgcctgtaatcccagctactcgggaggctgaggcaggagaatcgcttgaacccgggaggcggaggttgcagtgagccgagatcgtgtcattgcactccaggcttgggcaacaagaacgaaactccatctcaaaaaaaaaaaaaaaaaaaggcctcagagagctcccttgccctttctaccacatgagaacacagtgagaagacaactgtctatgaaccaagaagtgggcccttggcagacgcagaatctgccttgctcttggatttgccagcctccagaactgtgagaaatcaatttctgttgtttgtaagccaccgagtctacggtagtgtgttatggcagcctgaactgattaagacaatacaccagcttcttcaccttgcccttggctcctgctcccccataactttgacctgcacatggctttggtacaaactccagccccaaagctagacaggttggtgctcacatcaccttactgactagttattcactgcctattccattttcacggagaaagaatgaatctgattagctctgtttaggtcaaagtgttcaactgcggtgcaaacagctgtggttgggaggagatggcagagacacatggggctctgagtagggtatttttttcttagaggcagtggctggcaacacctgctgtcagaccgtggaaaatgaaagctacaagggctctcaaagaccaggatgtgcagtgtcttagtctatttcgtgctgctgtaacaatactagagactgggcaatttataaagaacagatatttatatcttacatttctggaggttgggaagtccaggattgaggggctcacatcaagtaaaagccttcctgcggcgccatcccatggtggaaggtggaagtgtgagagagcaagatggggctgaacctgcttttattacaaatctacttttgcaataataacattaattccttcatgagagcagaggcctcacgacctaaccacctcttaaagagcccacctctcaacactactgcagtggggtttaagtctccaacacgtgaacttaggaggacatattcaaaccatagtatgcagtttcttcagtttacagttaaagcaatgaaatctcagaaaggctaggtgtgtggggtgggagatagtacagtatagtgaaaaacaaacaaaggttggcatcatttaaccgtcctgaacctcagtttcctctttcatgagaagagaagaataatccttatcttgcatggctgtcatattaaatggaataatgtctatggcaagcttagccctgagcaaattctttttgagacggagtctcactctattgcccaggctggagtgcagttgtatgatcttggctcactgcagcctctgccactcgggttcaagtgattctcctacctcagcccctctccccctgagtagctgggactacaggtgcgtgccaccatgcccagctaatttttgtatttttagtagagatggggtttcaccatgttggccaggctggtctcaaactcctgacctcaagtgatctacccacctcagcctcccaaagtgctgggattacaggcatgagccaccacacccggccctgagcaaattcttattaaaagctggttgttggccaggcgtagtggctcacgcctgtaatcccagcactttgggagaccaaagtgggcagatcacttaaggtcaggagttcgagaccagcctggccaacatggtgaaaccccgcctctaccaaaaatacacaaaaaattagccaggtgtggtggcaggtgcctgtagtcccagctacttgggaggctgaggcaggagaatcacttgaacccggcaggtggaggttgcagtgagctgagatggcgccactgcactccagcctgggcaacagagcgagactccgtctcaaacaacaacaacaacaacaacaaagttcgttgttttaagagcaaaagaaacccatacaatttaattaatttgagtagcattatacatgttcatattacccagataacatatgttaccacagtacctaaactatgtcctgtagatatttgctgtcatttgggggtgcttccatctgtaggtcttgttctgttgagctgccccgagccactcccagcagctctgttctaggactgcacgtaaatgtcatcatataggctgggtgtggtggcttatgcctgtaatcccagcactttgggaggccgaggcaggtggatctcctgaggtcaggagttcgagaccagcctgaccaacatggtgaaactccatctctactaaaaatacaaaaattatctgggtgtggtggtgggcgcctgtaatcccagctactcgggaggctgaggcagaagaatcacttgaacccaggaggcggaggttgcagtgagccgagatcatgccactgcactccaggctgggcaacagagcaagactctgtcttggggaaaaaaaaagaaaagaaaaaagaaaacaaaaagtcatcgtatagtatgtttcttttgtgtcaagtttctgttaacatgtttttattgcttgtatcagtagtttgttccttttattgctgagtagtattctactgtacaaataaattataatttatttctccattctactgttgggtaatttctactttttatcaattataaattagcctctatgaacactcttctatagtctttttgtggactttttttttttttttcatttctcttgggcaaatacctaggagtggaattgctgagtcatatgataggcatatatttagctttaatagatattgccaaagttttacaaagctattgagctattttacactcccattgactatgtgaaagaatctagttgttctccatcctcatcaacatatggggttatcagtcttttgaattttagcagaaaatctcactgcagttttaatttgcatttctctgatggctaatgatgctgagcaccttttcatgtgcttaatggccatgtaatatattctttttcttttttttttttttttgagacaaggtttcactttgtcacccaggctggagtgcggtggtgccatcttagctcactgcagcctctgcctcctgggttcaagcgattctcctgcctcagcctcttgagtagctgggattacaggcacccgctaccacatccggctaatttttgtatttttagtagagacggggtttcgccatgttggcggggctgttcttgaacccctgacctcaagtgatctgcccacctcggcctcccaaagaagtgttgggattccaggcgtgagccaccgcacccagcctattcttttgttaagcattcaagtcttttatccattttttaaaaataaattttaaaaaattttattctttttctttgctggcaaagtgaaagcaatcaccgatttttacttagttgtcttttcattattcatttgtaggagttatttttacattctgtatagtcatatatataacacatacatacatacatacaattcatatttaaagtgtatcctcacgaaaccatcacctcaatcaagataatgaacatatccatcacccccaagaatcatgccccattataatctctccctcctgcccttctttgcctccctactcatccccaggcaacccctgatctttctgttactatagattagtttacagtttctagaattttatgtaagcggagtcacacagtatgtattttttttttttttttttttttttttttttggtctggctcctttcactcagcagaattatctatcacgtgattcatccatgttgcaggtatcaatagtcattccttttttttttggcaattttaacattatttttttctctttcattttttaaaatttccataggtttttggggaacaggaggtatttggttacatgagtaagttctttagtggtgatttgtgatattttggtgcaatcatcacctgagcaacaaacactgaacccaaattatagtcttttatccctcaccccctcccaccctttccctctgagtccccaaaatccattgtatcattctcatgcctttgcatccttatagcttagctcccacttatgagtgagaatgcatgatatttggttttccattcctgagttacttcacttagaataatagtctccagtcccatccaggttgctgcgaatgccattaatttattcctttttatggctgagtaatattccgtcatatatatatatatatatatatacaccacagtttctttatccacttgttaactgatgggcatttggggtggttccatatttttgcaattgcgaattgtgctgctataaacgtgcgtgcaaggatctttttcatataatgacttcttttcctctgagtagatacccagtagtgggattgctggatcaaatggtagttctacttttagttctttaagggatctccacactgttttccatagtggttgtagtagtttacattcccaccagcagtgtagaagtgttccctgttcaccacatccatgccagcatctattattttttgattttttgattatggccattcttgcaggagtaaggtggttttgcgttgtggttttgatttgcatttctctgatcattaatgatgttgagcattttttcttttttctttttttcctgagacacagtctcactctgtcgtccaggctggagtgcagtggtgcgatctcggctcactgcaacctctgcctcctgggttcaagcaattctcctgcctcagcctcctgagtagctgggattacaggcacgggccaccacgcctggctaatttttgtatttttagtagagacggggtttcactatattggccaggctagtcttgaactcctgacctcgtgatccacccgcctcggcctcccaaagtgctgggattacaggcatgagcctccgtgcctggccaagcattttttcatgtttcttggccatttgtatatcttcttttgtgaattatccaatagtcattgctttttattgctgagtaatattccactgtatggctatatcatttgtttgcccattcaactcttgatggacgtttgcactgtttctagttttgggctattaagaataaagctgccaaagtctttgtatagacatacgcttttatttccctaggagtagaatggctggattataaggtaggcatatgtttaacttttaaagaaacaacctcattgtttccaatttggaagtcccattttacattccaccggcagtgtaagacagtcccacctgttccacatgttctccaacacttggcacctgttttagtcccttcaggctattgtatcaaagttccataaactgggtggcttataagcaacagaaatgtatttatcacaattctggaggctggaagtccaagattggggtgccagcatggttgggttctggtgatggctctttcctgggctgcaggctgctgtcttcttatagtatggccagtctttctaattttagccattctaataggtggctactttaatttgtatctccctaacaactaatgatgttgagcatcttttcatgtgcttatttatcttctgtctatctttttttggtgaaatgtttctgcaaatattttgcccatttattaattggattattttcttattgagttttgggagttcttcatatattttaaatacaagtctttaatgagatatgtgacttacaaatattttctcacagtctattgcccgtcttttcatttactttgcagtgtctttgaaagagaagaagttttaaattttgatgaagtctagtttattattattatttttaattttatggttattgctttttcttcttctctctctctttttttttgtcccaagaaatcttcacctacctctaggtaacaaagatactctcctgtgttatctccacgaagctttgtaagttttagcttttacatttaggtttacggtccatctaaaatgaattttgcgtatggtgtgaggtaggtgttgagattctttttactttccagggattacactatgcatccttgtcgtggtctaccttgaattaatcttgtattgcttcaagtataatgtaagatccttatgagagtacaattcaattcacctcccttctcatccttcatgtaattgttgtcatagttttcatttacgtgttttaaactccacaatacattgttatttttgttttaaatagtcacttgtcttttaagcaattaaggtgagaaatagtagtctctttttttttttttttctgagacggagttttgctcttgttgcccaggctggagtgcagtggcgcaatctcggctcactgcaacctctgcctcctgggttcaagcgattctcctgcctcagcctcccgagtggctgggactacaggtgtgcgccaccacacccagctaatttttgtatttttagtagagacggggtttcaccatgttggccaggatagtctagatctcttgacctagtgatctgcccgcctcggcctcccaacgtgctgggattacaggcatgagccaccacgtccagcccaatgcctggctaattttttgtatttttagtagagacagggtctcatcatgttggccaggctggtcttgaactcctgacctcaggtgatccacccccccatcggcctcccaaagtgctgggattacaggggtgagccaccgtgccggccagtagtcttttatatttagtaacatacttaccatttccatcgctctttattccttcttgtagacctaattttcatctaccagcattttctttcagactgaagaatgtcttcatttcctgtgcagaagatctgctggagaagaattttctcagattttgtttacctgaaaatatctctattgcccttcatttctgaagatatttttactggagagagagagaattctaggttgccaaattttgcttttcattcagcgcttaaagagcactaatcccattctttttttttttttttaaaacaaggtctggctctgtggcccaggcaggaattcagtggcatgatctccacttactgcaacctctgtctcctgggcttaagcgatcctcccacctcagcctcccaagtagctgggattacaggcacatgccaccacacatagttaatttttgtgtagagacagggttttgccatgttgcccaggctggtctcaaactcctgggctcaagcgatccacccacctcggcctccaaaagtgctaggattacaggcatgggccactgtgcccagccactaatcccattcttgatcatccactctcctgacctaagtacctctcaaagtctccatctcctaataccatcactttgggggttaggatttcaacacataaatttggaaggcggacataaacattcagaccataactgtgattatcttttactgttttttactctatgtaatatgtctttttgttttggatacttttaagaattttctatctttggctatgatgggccgtgcgtgtgtgtgtgtgtgtgtgtgtgtgttttatgttacttggggcttgctaagcttcttgttttaatcaaatttggaaactgtcatcaactatcttttagccatattctgtatcttctctcctctgagactccacatacatgtatattagtctaattgcttgatattgttccacaggtcattgaggctctgataatttttcccccagtcttctttttattttctctctgtgcttcactttggttaataactactcgcctctcttcaagtttatgaagattttcttctgcagtgtctaatctgctatttatcttattcaataatttttaaaatttcagctattgtttcagtactaagatttctactgggttcctttttagagtttccatacctcttctaaaattcagattccccatgtctttgcccatgatccctatcttttcctgtaaattccttaacatatttatagcaaatctttgcttggtaattccaacatgtgggctgtctgaatctgcttctgctgttttttttttccttcttgacaagtgtcatgtttgctgcttcttcacatgtctactagtatttggttgtacactggatactgcggagccagtggtagaaactctggattctcttgtcttctgttgaagagtgtagaattttgttctggcattcagttaaattactggcagatcaccttgttccctgaaagccttggttttaggctttttaagggtaggactacttgagttttgcctttagtcctgggaaatggtcttcactcctgaggcatggtcctttggggtttcagtggaaagctcaaggtatttgacaagctcctctaacttggcagaccttgaactcttttttttttttttttaagatagagccttgctctgttgcccaggctggagtgcagtggcatgatctcagctcactgcaacctccacctgtagtcccagctacctgccccccgagtagctgggactacaggtgcctgtcaccacacccagctattttttttttttttttgtatttttagtaaagatgaggttttaccatgttggctggtctcgaactcctgacctcaagtgatctgcctgcctcgccttcccaaagtgctgggattacaggcgtgaaccaccacgcccagctgggaccttgaactcttaaactgcctcctgtcactgggcaattgctaaaatctctgtttaggtcttttggtgtttagttcttgctttccccttgggctccctggagtcatcccacacatatgcccttcagaactcagccaaggacataaggggaacctgtatactaactttgtggctcctcttttgaggctccctttttccatgttttccctcctcaatttccagccactgtggcagctataaatgctgacctctaagctgtcagcttgctttctgctttagcttcactcaccatgtgctgtgtggacttgaaattgccctgagagagccgggcccagaggctcacgcctgtgatcccagcactttgggaggccgaggcaggaggatctcttgaggtcaggagttcaagaccagcctcggcaacatagtgataccttgtctacataaaattagctgggcatggtggtacatacttgtagtcccagctacttgggaggctgaggtgggaggattacccaagcccagggaggtcaagactgtggtgaaccgagattgcaccaccgcactccagcctgggcaacggagagaagagaccctgtctaaaaaaataaaaaataaaaaaaaaatcctgagaggaaaaatcagttagatgcacatctcacctagtttgtgtctcttctttgaagggttgcatcgactctgattgcctgttttggttgttccctggtgctttaaaacaatttttttttttttttgagacagagtttcgctcttgtagcccaggctggagtgtaatggcgtgaacctggctcactgcaacctctgcctcccaggttcaagcaattttcctgcctcagcctctcgagtagctgggattacaggtgcccgccaccatgcctggctaatttttttttttttttgtagttttagtagagacagggtttcgccatgttggccagactggtctttttttttttttttttttttttttgagatgaattttcgctcttgttgcccaggctggagtgcaatggtgtgatcttggctcactgcaacctccgcctcacgagttcaagagatttgcttgcttcagcctcctaagtagctgggattacaggtgcctgccaccatgccaggctaatttttgtttgtttgtagttttagtagaggcagggtttcgccatgttggccagactggtctcgaactcctgacctccggtgatccacccacctcggcctcccaaagtgctgggattacaggtgtgagccaccacgcccagctaaaacaatttttttaaaaaaattttgtccagagtctaccatagatagcagtgggaatgttagtctgatagaagctactctgccatgattgcagtagaactcatccacatatattattattaaaagaatttttttttggtgccttgcttttctggctcactaaacatgtacttagtctttatactgaacaaaccaatacagttttgctgtcagttctgagaatttacttgacttaatttattattattattatttattatttattattttagatggagtctcactgtgtcactcaggctggagtacagtggcatgatcttggctcactgcaacctctgcctcccgggttcaagcgattcttgtgcgtcagcctcctgagtagctgggattacaggcgtgtgccactgcgtctggctaatttttgtatttttagtagagacggggtttcaccatgttggccaggctggtctcgaactcctgacctcaggtgatctgtctgcctctgcctcccaaagtgctggaattacagtcatgagccaccgcgcctggagacttaatttattattttttgggaggacaaggtcttgctctgttgtccaggctggagttcagtggtccaatcatagctcactgtaatcttgaactcctgggctcaagtaatcttcctgcctcagcctcctgagtagctgggactacaggtgcacaccactgtgcatggctaatttttttattttttatagagataggggtctcactatattgcccaggctggtctgaaactcctgggctcaagcgatcctcctgccatagcctcacaaagtgctgggattacaggtgtgagccactgtacccggccttgacttaatttaaatgtcactaaataatccagtaaattagttattgctcctaatggctatcaaagtttcagaggctaaaaataagtctctaatagtgacaatttcttgagtgtttaattaaagtttaaactctaatctattttttgaaataggtaacatagccacatggttcaaaatgttaaaggctaaaagcagtgtacattgagaagcttcagtctcactcttctcatatatgttttttaaacataggcagctacctttctgatctcttgcattatacaaattggttgtatcctgactgttgtaatcccaggagttccttgacaaataatttttttttttttttttttgagacagagtctcgctctgttgcctgggctggagtgcagtagtgtgatctcagctcactgcaacctctgcctccctggttcaagtgattcttatgcctcagcctccagagtagctgggactacaggcacgcgccaccacacctggctaatttttgtatttttagtagagatggggtttcaccatgttggccaggctggtcttgaacttctgactccagtgatctgcacgccttggcctcccaaagtgctgggattgcaggcatgagcaccatgcctggccagcaaacaatttttaaaataaatggaggaatccttgcataggaaggcatcatttaattctacaaacgtttattgagccatacagtgcgcctggaacagtgttagctattgtggggtataaacatgagtcatatgactgagtgtactttccttaattagaaagaagagagtagaatgaaggactatttgtaaagaaacctgatgcctgatacttgacctagttggaagggttgatagaaaaaggttctgcctctttccagctgaggcctgcagttaaggttatattcttggccctgtctccctagcagggtgtctccccagcccagcagcagccctgtttacagccaggctcagcacagagcccaagaaccttgctggaagcttggtgtctatctcagtttttagggagatggaaaagctaagtcaggcatcctcaacatcagaatgttgaagtggctccagtttacaactgaggggctgttcaaaggcctgagtgctcttcagctgtgtctgagagggctggatccacttctcagctgcttagaaaacatggagtgtccataacagatgacctgaaaagacactggaaaccaagcagagctacagaggtggcagcaagtgtattctacatatcccttttggggccacatcttcaggttcctgcagggacttgggtaggcaaggccgggtaatgtgtacagaatgggaggatgtgagtggcaggccaggggtatttgctaggaattcgggagtactgatgaggaggggtagaaattatgaatcggtgggcatatttacatctgggtaccgtttgctctcctacaggaatttcagatagagctgcccctgaccatgaaataaacattgtgcatctaccatgctgtcttttccattggtcctcaagattgggcttggggcctctggcttccacagggtagcaggccacgatgacattctactttttttttttttttttgagacggagtctcactctgtcacccaggctagagtgtagtggtgcaatctcggctcactgcaacctttgcctcctgggttcaagcaattctcctgcttcagcctcccgagtagctgggattataggtgcatgccaccacacccggctaatttttgtacttttagtagagacagggtttcaccatgttggccaggctagtctcgaacacctgaccttaggtgatccacccgcctctgcctcccaaagtgctgggattacaggcatgagccactgtgcccagcctcatgacattctactttgctgcaggtggcaagcctacttgtgggcttttgaagtctttatctgatcctccattcaaatgctcaaaatgaaagtaatttataagcaacttactctcccatgatgatgtaaaaaagtttctagcaggcaaggactggtgaatggaacttaactgcagcgtgtctataattaattcttttgagatgtgcaagaaggtcattgattttatttagtatgctgtccttttggcttaattttagtgactgttacagaaaaaaaaaattgattgacaggcttttctttcattcccaatctcctgctccctaattctccctcctccttgaggcataatttactcaatgggggtgttcaggaattgaattcttctggtgagaggaactatagtagcaccaacagaaatataacacaagccgcatgtttaaaaattctgagtagtcacattaaaaaacgtaaaaagaaacagttaacattaattttaatattttatttaacccaatatatctaaaataccattgtaacatgtaatcagtataaaaatcattgatgcagctgggtgtggtggctcacacctgtaatcccagcactttgggaggccaaggtgggcggatcaactgaggtcaggagtttgagaccagcctggccaatatggcaaaaccctatctctactaaaaatacaaaaattagccgggtgtggtggcacatgcctgtaatcccagctactcgggtggctgaggcagaagaatcacttgaacctgggaggcggaggttgcagtgggccgagattagcgccattgcactccagcctggcgacagagtgaggactctgtctcaaaaaaaaaaaaaaaaaaatcattgatgcagtattttactctttttaagtctttgaaatctggtgtgtcttctatatgcatagcacatctcaatttgggttggccacatttcaaatgctcagtagcccacggggctagtggctactgtattgggcagcgcagatctagggtgaaggccacagcgatgtcctcggagatcccccagggcctgcagacaacaaaccctcaaggccacattctagtgttccccgaccaaactgagggtggggctgctatttctcacggcccaataatgagatgcagatgaactgggaaaggagggagttttttatttctgtaactggttacagggaaaaggcctggaaaatatctctagaccaactcaaaattacgaacttttccagagcttatataccttctttttttggaggggggggatggagtttcactcttttcacccaggctggagtgcaatggcactatctcagctcactgcaacctccgctttctgggttcaagcaattctcctgcctcagccttctgagcagttgggattacaggtgcccaccaccatgcccggctaatttttgtatttttagtagagacggggtttcaccatgttggccaggctagtctttaactcctcacctcaggtgatctgcccacctcggcctctcgaagtgttgggattacaggcgtgagccaccgcacctggcccagagtttatataccttctaagctacatgtctacgtgtaagtgtgcattcatctaaagacatgtgattaacttcttttaatctataactaaggtctgagtcctgaagaccttcctctggagcctcagtaaatttacttaatctagatgggtccaggtgctggggtgattacccttattttgtctcctgctaaatcatggaggtttggggagttcctccagacccccaataaacttgtctgtggaggtctggggagtttagacccccagtaaaacttgtttaatcctaaatgggtcctgttaagaattatttcataatcttgtcatgctttaaggcccaggaaaggcttgggcaaaactcttggtgggcttttgttaccttccagcctttgtataagggcactggtgtatatatatatatgtatttttttttttttttcccctggggtaactggttctttagcaagaggggagcactggggagtatcttcagggtggctgaactttgcaacctctttaataaacaacttccccctgtgcagtttgtcctcctttatcaccacactccgatgccctggtattcaggcaatggcatcaggcccatatttccgtagagttcagagttctgtgaggtagagcattccttccaatgggatcttagaattcttagagttgcagaattttactgactagactcaggaggtctcaggagtccagacttccttaaagcttggctcaaaattccaagggagctcataactccatggagcccagagttcctggctcgggaacattgggaggcctgggatacagtggcttagcctcaagcaaaaaggtgaacaatatctttatggcttgaaggtatacgaaataatgtcactacatcggagcagcgcctctgcttgcacacctatgggagtctgtagctgtgacacatagaagttggccacatccatgtcggtggctccaaagtgggtggccacacgcacaccctcgtgcaatgtgaagctcacctgatgactcaccatggccagcaggccgcggaggtaacgatcccgaagggcggctcgggcccgctgcttctgggattccaaggattcttgagctatggaacactcctggatttcaagaacctctgactacaggggggctctgcgtccatcaggggcaaagccacggctgagaccatcagggcctcggggcagccggagcacaggcacaggaaaggtcactggagcctgcattgtcttggcgaggtccgtggctactgtgcgcgcccccacttccgccggcaccccgcagtagaggccagggcaggccccgagccgcggagcctgggttccgcctgcgccaccgccaccaacccacgtgtcacgggcaaatttatttatttatttatttatttttgatatggagtctcactctgtcgcccaggctagagtgctgtggcgtgatctcagctcactggaacctccgcctcccgggttcaagggattctcgtgcttcagcctcccaagtaggtgggattacaggagcccgtcaccacgcccggctaatttttgtatttttagtagagacggagtttcaccatgttgctcaggctggtgtgaactcctgagctcaggtgatctgcccgcctcggcctcccaaagtgctgggattacaggcgtgagccactgcgaccggtcagcttttaatatttaacttaaccattcagtcagtgccgaaacagtagttatggaggcctgcattagtgagtcctggcctgccacactaggagcacacaagtggtggtacaggcaggagggagtttagaacggggtcagctgcagggattgcagctgggttttgctgattaaggtaaccggaaagcaaaggagcgggtgtcttaggtggataaacccgtgtgaggccgcggaggtgggaagaggccatgtgcctgacacaagataactcggtggagggcctgcatcctgctgcccggacaggcaggatttttcctggggtgacctttggctgacggttgctccttttttctcttttctcctccttcccgactccccaccaccctgtccccgcagcggtggtcctcggcctgcccagcgcctgggccgtgggggcctgcgcccgcgcttgtcccgccgcctgcgcctgcagcaccgtggagcgcggctgctcggtgcgctgcgaccgcgcgggcctcctgcgggtgccggccgagctcccgtgcgaggcggtctccatcgacctggaccggaacggcctgcgcttcctgggcgagcgagccttcggcacgctgccgtccttgcgccgcctgtcgctgcgccacaacaacctgtccttcatcacgcccggcgccttcaagggcctgccgcgcctggctgagctgcgcctggcgcacaacggcgacctgcgctacctgcacgcgcgcaccttcgcggcgctcagccgcctgcgccgcctagacctagcagcctgccgcctcttcagcgtgcccgagcgcctcctggccgaactgccggccctgcgcgaactcgccgccttcgacaacctgttccgccgcgtgccgggcgcgctgcgcggcctggccaacctgacgcacgcgcacctggagcgcggccgcatcgaggcggtggcctccagctcgctgcagggcctgcgccgcctgcgctcgctcagcctgcaggccaaccgcgtccgtgccgtgcacgctggcgccttcggggactgtggcgtcctggagcatctgctgctcaacgacaacctgctggccgagctcccggccgacgccttccgcggcctgcggcgcctgcgcacgctcaacctgggtggcaacgcgctggaccgcgtggcgcgcgcctggttcgctgacctggccgagctcgagctgctctacctggaccgcaacagcatcgccttcgtggaggagggcgccttccagaacctctcgggtctcctcgcgctgcacctcaacggcaaccgcctcaccgtgctcgcctgggtcgccttccagcccggcttcttcctgggccgcctcttcctcttccgcaacccgtggtgctgcgactgccgtctggagtggctgagggactggatggagggctccggacgtgtcaccgacgtgccgtgcgcctccccgggctccgtggccggcctggacctcagccaggtgaccttcgggcgctcctccgatggcctctgtgtggaccccgaggagctgaacctcaccacgtccagtccaggcccgtccccagaaccagcggccaccaccgtgagcaggttcagcagcctcctctccaagctgctggccccgagggtcccggtggaggaggcggccaacaccactggggggctggccaacgcctccctgtccgacagcctctcctcccgtggggtgggaggcgcgggccggcagccctggtttctcctcgcctcttgtctcctgcccagcgtggcccagcacgtggtgtttggcctgcagatggactgacctggccagaggggggaaagtttgcttaactgggcttgagtgtgtttgtggtaaggggagaggagccggaatggagggcagaggtgaaaatcccagtggagggtggaaggaaccgtttgcctccagagatggccccagggagaacacagggacgtgccactcgagggggaggatggtatggatttctgcttttgtcacacgggcatccattggaaaagagaagcaagaatgaacgtgggccctcgggtgggaagactaggaatcggaagcttctagggcttcacatcccttcccctcccctccccttcccctcatcttccaggcaacagtgcctgcaaggcctgaattagagagacttccattggctaagtagttaagagccgtcccatttctcctggcggggtaacccattacaccgaagtcctttgttttctaccacaatcctcctcctcctctccaggggcctggaaacactaggattcaggaaggtaggcaggacgtgagagaagggagatgggagagagatttaagacaaagggtggcggtggttcctggggtctgagatgtgttaggaggcgtttaaaacaaagatccagttcatttactccacagttattcccagggctggccctagccacaaaggaactttagggcagggtagggaaaaaaggggcagcagggggtgtgtttgtggacaaataaatttgtaaagtccgaggattaaaaaaaaaaaaaggttaaaccggtttctct

SEQ ID NO: 4491 - DNA, 419 bp, human
ttcgcctgctccaagctcgtctcctctccctcattggtcaagagcacctcacagctgctgagccgtcagctatctgcagtggtgctgaaatgaccggagatactgacagatgagagcctcagcagcttggcagtctcacgtccccttacctcacttgtctctagccgcagcttccaaaccagcaccatttcaagggacatcgacacaacagccaagttcactggagctggggctgccgcagttggggtggctggctctgcggctcagattgggactgtgtttgggagcctcatcattggttatgccaggaacccttctctgaagcaacagctcttctcctacgccactctgggctttgccctctgagacgccatggggtgcttttgcctgatggtggcctttctcatcctctctgccat

SEQ ID NO: 4492 - DNA, 242806 bp, human
tgctgtggaacttgtctctgtctctttttctgattttgtccctcagtcgaattatttcttctgaggaggcaaggactgaagttgctacagacccctaaggacaggccatcggtaacactgggtaaatcagatctcttccacgggtaagactttctataaaaatattgaaaaatacaagaagtagttttgtatgctgtaaatattcttgtatgagaagaagaaaatgaaaaatatttgtaatcctattgcccagagatttctgggtagtcttttcagactcaaataaataatatttccattacaaaaatgtagaaaatttgttaaaacataggaaagcaaaaacaaaacaacaaataataaatccctgtgttcctaagatataaaacaaaatttcaacagagcttgccattccattttttcccctcctcttttcctctctccttccctccttttctcctctcctttctctttctttcctttcttctctctcaatataatagcatcattttataatactcttttgtagtttgctttttaaaaaccttttatgggcatgtcaaatatttcatatttcaataaatattcatctaaaacttgatttttgatgactgcataacattctatcttatgaataatttgcctaacagttctctagtgttgagcatttattttgtttatacttattcactattatcaagaaggccatggtgaactttgttgtatatacatctttttgcatctttgattattttaggataattttatggaagctgaatcagtgattcaaagtttatatacattaaaaatattttgataaccatggccaaattgccttctagaaagcttatgtcattttaatttctactatcagtttatgagaagcctatttcatcatgcctttggcagtcctgagcattataactttaatttttacaaatgtaaagggtaaaaaaaatcattgttcttttatttttctttgattaacagggaggttgaatttttctggatttttaaaaaatttttattctatgaattagttttttatgccctttgatgattattcctaatgtgtttatgtttttcttgttgggttattggcgttttatatcttaaaggattttttgcatgctttttaacgtatttttaaatatcttaagggactaatatttgcttttcttatttatttttaatattttcctaattcattatataacattcatggtgtccttggatatacaaaagttctaatgctttacgccaagaatcaagtcttctttttatgtagtcgtatttttagctgcttaggttataatttcttacattatttttatacttagtaatcccttttcagtcagaaatcaatgaagttgtcacttatagtttctgccttttgcaaaaaaaatggttttgttcttaacatttgactctgatttgtctggaatttacttgacagtacgagattatattatgagacagagatctaacattcatttctccaaatacatagttaattttccaaaccctatgcattaaatagaacatctaattcctattgctttgtgattccttctttatcacatttgaagttatagtatatactaaagtgtatttgctcccattcatctgtcttttatttatgcaacatattttttaatttcattttttatttcaatagttttattggggtacaggtggcttttggttacatggatgagttctttagtggtgatttctgggattttggtgcacctattacctgagcagtgtacactgtacccaatatgtagtcttttatccctaaccccccttccacctttcccctcaagtccccagagcccattatattattcttatgcctttgcatcctcatagcttagctcccacttacaagtgagaacataagaattttggttttccattcctgagttacttcacttagaataatgtcctccagctccacccaagtggctgcaaaagacgttatttcattcctttttatggctgagtagtattccatggtgtatatataccacattttctttaaccccttgttggttgatgggcacttaggttggttctctatttttgcaactgcaaattgtgctgctataagcatgcaagtgcttgtgtcttttatatataatgatttcttttcctttgggtagatacccagtagtgggattgctggatcaaatggtagttcttttagttctttaaggaatctccatactgttttccatagtggttatgcaacatatttttactgagtacctagacctactgtgtcccagaccctatggttgtcctggaacacatgttgctgaaccagacagacagtgtaaactccataaggacaaggagaatctcgttgtgtttcttcccccacgtgcttcttaacatcaacttaatttgaaagccttcagaaggtgagaaacaagtcttcattttccatgcactctccatggtgtttttgccagggccaaatggactatagggcttcataggaaaatccatcaaaaaaatgttctactcctttcctcccaccttgacttagcaaaggtatagagtctctttttcaagatgcagccatggtgaatgagaacattagatctagagtcaagaaacctgggtttgaattgtgattatgtactaacttcatgcccttcaaaaaatatcttcactccttggaaactcagtttcctcatctttaaaatggagttaataggctgggtgcagtgacttatgcctgtaatcccagcactttaggaggccaaggcaggcagatcacttgaggtcaggagttcgagaccagcctggccaacatggtgaaaccccgtctctactaaaaatacaaaaattagccaggagtggtggtgcacgactgtaatcccagccactcagaaggctgagacacgagaattgcttgaacccaggaggcaaaggttgcagtgaaccgagatcgtgccactgcactcaagcctgggcaacagagtgagactcagtgtcaaaaaaaaaaacaaaaaagtaaaaataaaaaataaaaataaaatggagttaatgcttataggaatctttgagtgtgaactgaaaattggtgttaaaactctgaaaattgtaaaatgtcatggagataaaaattattattttcatttttagtcaaactaaagtacaaataacctgaaagcagggctcatatcttgctgcctttgtgaccccctctgcctaagtacactatttacttagtacttgtactgacaggaagccctaaccaaatatttattgaatacataaataaattcccctgctcaggtagatgctcttctaatataacctaatggaaacaccccctgccagaaagcctaagcaaataactcattatttgctctggattttagttggctttagtagattatatatgtatcctgataccccagagtttgggagccaacttaaatattgtttaaaagaataaaaaggatctataagataacacattaagcctttgatatttgaaagagatacttccctaaaccctcacaaatctccaaatttgtaaatactatgatgatgcacactttccatcactgaatacagtaaaatgtaactaaaatatttgtgatcaaattgttggtgattctgtaagtccactggctctttagacttaagttcaactggttggcctttgctttctttttggagctagtttctcctgttagctccatagtctgctctgctaacaggcaccagcagacttcttgaacactgaatctaggatgaacagagcttatgcccaaattgacctccctcctcaactttaaatcttttctatcaggataataattcatagatcttaataaaattgatgaggccagatgaatagccaggaggttgaggagacttgaaagccgaaaaaagtgggtattttgaagtcattggtcctgtcagagttttaatctcattttacagatgaggaaaagtaggactcaggaagatttaataacttgcctaaggtcaaggagctgaaagaatcagtactgcaaactctgctagatctatatttcatactcctaaccatcttgttctatggaaatgccacggactcttttggatgccaattttttcctgttaggtattcaataagtgcccagataaatttaagaattgtggagaacgatttagacttgctatgcaactggaaggtgaattttattctgtttcaaatctctctgtgaacaataggaaggattaagcagctggtaagcaattaggggtctgaacagctgagccccacactgagcaagacagacagtctgccaagtggcagtgagggcgggccccgggtgctcagtgccagttcaatctggcaacttggtgaccccagggattctgattcctgcagccccacagcacctccactactatgtttaataatttccgcatctgtcagcagatacccagacatccccaattctcatgctgatgggcatttgctctcaaatgaaaactgggatgaggaaggcctagatgtctggatccccagctaagacaggggtttgttactgtggtgccagagttctcttttgtgcctcttctcagcacctgcttggcatgttgaggatacaaaatgtgcctccctatcataatgcacccaccccatgccctaccccaagttatctgaaagggaggcctcgtctcacttatcctgttttcttagttagggtaaagaaggtaggtccatcctcccatcaaccccagctctcctctgggagaaccaaaccctctcaagagtcctcccctttcaaatttggaagcacaggtctcttttaaacattgcaaggattatctattactcatcaaatcctatggtctttattacaatatgccaaatatgcattttggccaaatgctaaaaggccagtgtcaaaattcatatttggtcaaagccaaggccaaagtggaaaataaccctcataaaatgaccttctaggtcataaggatacatctgaaaatatatcaaaatatttattattaaaaatctagtagtcacctttcatgagattgacattataaaccagggacaatattttctcaggtactgtcatctgctggattgtttgtgtggtcactgtactgtacaagtgtgataccaaatggatgctcactttcaaatgaggttggtggataaacaagattttttgaggcttgttttgtcaagtaggattctgctggggctaaggctgccaccacattagtgagcctttctttctctctcctagtaaccaagtaaggttaaggatatttcctcctcatctcttggacttgaacactggttcatggtgatgcactttaactgaagcaatcctccccaaatgaagctctgtgcattgcttggggaagatgctttcttaaattttcagaaacagtcttacaagttatcttgtttcatattatgaatgatatgaataatcatgattattcatatcattataatcgtatttcatatgattataatgaaaataatctcccaaaaaatagatgtgtgatgtagtctaatctctgttgtttgcccttgtattgttactgaatttaagtttttatagaatactagttggcttagaaaggaattaatgttctttttaaacttatcaactaatactcagtatgtataaactgtcaatctacatctctacttatttaactacttggaagttcttaatagttgtttttgaatataaaattaacagctttcacatcaccattaattgtagtagcatttaacttttgcaaagataaatatgcattcatacttcaacggtttgaaagaatttccatgtacaaagcccataaggagattttttgttccatgctacattagaatatctacctctaagtttccattagaatttgaatgtgaacattctgataatatcaattaatcagggtgacatgtcttgttcatctcacaaatgttatgtttactaaatatgagggtaatatgcatcatgacgtgatcattgattgttcacaaatgaccagaaatgatataggtgtttagttgttttttgtttttgccttcccaggaccaagactaatgcagattttgtcttaatactgaatctaaaacgtcatgttggatacatctttagttttcatcttaaatacttttaggaccgtgttcaaagcagccctcctttaaaaggtcatcccttcacttgaccttgatgttcctgctaactactggtccactacttcccttctttcacgggcatacctctcaacaaaggtcttccctctttccttctattccacagtactcactcattcattcatcaaagattgtctgagcttgtgtaatgtggcaggcaatgtgctaggtcctagagatacagctgaaagtaaaacactgccttccctcaaaaagcttatatttctagagctggaaagatgggtaaacatgggattactatatatagtctgtgattaatgttatgaggcaagagaacacagggtgctgtggtaactcctaggaaggtggcacctaacccagcctagagaggcagaggtaacttgctggggtttcccactgaggctggttagaagaaagccaagaaaaccccaaaccaaaccagacataagcattaatttggttcttaccctttttgatgaacccagttggtacttggtgtgattaaatgaccttcttgtaaaatccaatggtccttgtttttgtttttgttttttctttcaatggcctctgagacttgaaaccatgcacattttccctttcctgatactctggctctcatggcctcatctgctccagtgtcccctatccttgttgacaacttctgtgcttcccttgatgatctctccttctcttctctctatctgtgtatggaaacacacccagggctccacctgtggcccctggaattgtcttctccttctaggacagttaatcaaccttcaaggtttctatacctttagtccaaaacttccctcatttaattcctttgcaccatacctcggactacctgtggatatgtcccattgtctgtccgtatgtctatctcactcctatcctggccctcctcctgtagcaaagcccatcactaggaagagaatggacattggccatcaacatatcaattacaattggttttctccttctgggaatggtagcaatggtttcatttcaagcctcgtttcaaactataggatatagattttatcccgttagaggaattttttactccagcagacatatgatgtagttttttgttttatttttctggccggggctgcgtgcacttcccaactctcttaaaataatagcactgaaaatacatatggaaacaggtttattgtatattattatcaatcaaaactgaagaatgtatttaaatatatacagaatgtgtatgtgtgtgtgtatatatatatatacctacatacatatatatactatatatatacacacacacatatataatgtatatatttgttatttattgctacttaacaaattatgccaaaactttatggcttaaaacaacaatttattatctcatactttccatgtgtctggaatttgggaacagcttagctgagtggttccagctcagggtctcttgtgtggttagagtcagaattttggctaggtctgaagtctctgaggacttgactggggctgcaggatctgcttccaagatggctcactcacatggctgttggcagtaggcaacagttctccaacatatgggctactccattgagctgcttgaatgtccccatatggcaattggcttcccctagaaagagtgatgagacaaagtgggagagagagcaggaggaaaggggtggggggtaggggtgggaagaagcaatagaaaactgcaatactttttatgacctagtttcagaaatcacacaccgtcacatctgtcacattctattagctagaagccagtcattacatctgacccactctcagtgggaagggaattaggttctaccttttgaagagaggagtgtcaaaaactttgtggacatattttaaaactaccacaatttgtggaaagatatctgcaataataaatgcaacattttaaaacaatgattttatctgggaggtgagattatcaattatttgtttatatttttcccattttatgaacataactatattaaaataataaaaattttaaaatagaccaaaattgtattatgctgatgttgtataacactgaacatatttcctgaaacatcctcaaaggatttactggaaatggtttggctagaaatgtttgcatggcgcagaacttctgaagtacatattattgttatcctcagtttatcggtgatgaaactgaggtatagagagattaactgaggttaacaagctacccagggtcctagagtaaataaatacgtggtatagataacatggaaacctaggcaacagagttctatagcccaagctcttaaactaaatgaaacatccacaatacatattggactgtatagaatcacactgtagatcttacaaacaatagctcagagatgtgaaagagtcaagggctcatcttagtcagggaaattttcattaaaaaggtggacagtgagctgtgccttaaggaaaaagtgagatttgggtaatctagggttgacattccaaatgagggacacagcctggctgaggcttaaaaatgggttggggcctggcctttccaagcatgtcccagtgagaagattagtgcaggtaaagttgagtgattcctggtaagctgtgtgagttaaggcaaaatggattgagatggtggtaggggtgggatgccagattcagaggaaccccagatgcaggcaggaggtcaatttgtattcatacacagacttggagatcttggccctttaccatcaggaaggaacttagaaatgttgtggctcgtgccccttattttaaatataggaaattatatggaagaaaatgattcattcaccccaaatgtatttcttatttattctgttatgttaaaggttgttggactgttaaagcattttttaaaaacatcttaattattacatttttaccattaattttttttctagtacaaggaataaggaatccttttactaaattaggctacttcaggctatagcttattccatactaattgaacctataagaattctgcgtgctagactaggacactagattcaaagaagatccgtttccagaattactcagtgcacttcatgctcacgtggggagatttacttacttatttgtttgtttgtttagtatatcatgttctggatgcatagggcttctcaaaccagatatacaaacctgtctgcaaggactaagcagtttaaagtccatgaaaacttggaaattatcaaagttagatgttttcagcaaacattggaattttattactctcagaaatagtttccagatggaaaatttaaaaatatccaaataatgaaagacaccctatttggtttcttttctgtgtatcaaagtctatgttgaaataaagcacttaaagagctgggatcagttctccatgttactttgtacccatttcacactgtgggctcttagatgatctcataatgttaattacctagaaaggctggatgaaataattattttccttcaatgactaatgatagctggtggatttttatcgcctcccccatgattttttcagcaaggattcaaagaggttttgccacaaactagatatgggttccaactcctggatcattttgaattcgctagttcagactgaagatgacaggtgattcagagtacacacacacacacacacacacacacacacactgccctgggaactaggcaggatgtctttatcttgctgggtaatttccagggtaccaaccttggcttatacatggtctctagtaatttccaagaatgaattatagcttgctgtttccacctctcatctctttcctccctccctcctttccttcctttctagcaacaatgtaagagaaacaatatgcaattattgctggggcgcttcgaagccaatcagggaaaagaactgtatatgtgacattgtcaaagaggtcaggccattagcaaggcaattaatgtaccctatgatgcctctcattgagagtcaagtctccttaatagctaatgtggggaaaataatcttcaagcatccattacagctcccagataaatgcccaagggaattagttcactggctacctctagttgggaacactgttctcccctgacctgaggccttcgtactcagtcacagctctagcctctcttaggtgactcacctggctcagatccacatccaaagcactgcttagctttgccctcttctcactcttcctgccatctggggggcctcctattcacacactcccaggatttccaatggactctttctgacttccttcccaaacccagaatcatgcaatcaaccttaattgtcactattttatgttaccacttctcaagcttcttattgagtgccatttcctctgcaattttttttgcctctttggtttttcttcagttgtactttctatccttcagcactttactatggtattttttaaaaaagaaaattgcccctgctaatggggattaaattgtgggtgtattaaggcacacattgagcaaatgttttccaaaggcagcatgtattatttccctctttctgtattttgtatttttttaaatggcaattttattttgtagtgaaataatgctataaatgtaatattggggggaaaagctttagctcaatacttggttattcagttataatttctgtcacatattaatcagatttctgctgagataatgatgcataaaaaacaatgctccaaatctcagtaatttaccaaaaaaaccacagttttttttccctcactctttggtctgcaggttgactgggagagcagcaagtaggtgcatgtgagtgaaacactgacatggggtggggccagcaaggaacaggtggaagaagacgaagaccccagaggtgggcaggtggcaggtttacaagggccttatgcaacaaggagacaatggggaaccccagagcttttaaagtaaagaagtggcaggattttattttagagaataacactgatgttgtatatagaatgggccaaagctggagtcccctggagtcagatgtccacccagaagggtgtcacaggagttgaggcaggagctaaggagcctatgaagtaggactttgggccgtaaggaagggatgcagagcacagatactagaaattcgttccaggaggcaaaaatcgtcagtctattctatgtagggagtaaggggaggagaggctagggtgaaaccaacattcaaaggccatctaggaagagggtggtgcagccctggagagagtaggcgagttcagtagaaaccgaggaaaaggaggaccttggcatcctgcagacccctccaggataaaaagggaaggcgtgaaaacttgtttccttagccagaaaattagttcagaatgtgggagaggcaactgactacaatgatgatgatggcagcaattaccattcattaggttgacaatgagccagatgttgtctctttttattgcattatttcatttgaatctcacaacaatcctatggaataggtactattactatccccatttcacagataaggaactgacatgcagaattggtaagattccaaagacacccagctgataagtggtagagcagaaatttgattccaggtgtgtctgcttcttcatctctgcttggtgagacagttgttaccccagtgttaggctgatattcaggtagagcagactggcctatgactagagggatgatttcacacttctctgaagtcctcttgaaatagtctgaattatataattcagtgcctttattttcacaatcattgttcggttgatggattgattgatttcagtggtttcatgacaatcatcttcctaactaataaagttcaccccttacaagagtagtgtcaggcctctgagcccaagccaagccatcgcatcccctgtgacttgcacatatacgcccagatggcctgaagtaactgaagaatcacaaaagaagtgaaaaggccctgccccgccttaactgatgacattccaccattgtgatttgttcctgccccaccttaactgattaaccctgtgaatttccttctcctggctcagaagctctcccactgagcaccttgtgacccctgcccctgcccaccagagaacaaccccctttgactgtaattttccattaccttcccaaatcctataaaacggccccacccctatctcccttcgctgactctcttttcggactcagcccgcctgcacccaggtgaaataaacagccatgttgctcacacaaagcctgtttggtggtctcttcacatggactcgagtgaaaagtagcacttttcacttcacagatatctttcacatgcatcttctcatttgctttttataaaaatgctgatgggaatgcagggtggatattatgatcaccaccttttagtccaaaggtcagcagagattttccttaaagggccagattctaaagattttaagctttgtgagccatatagtgtctgtggcactactcagctctgccattatagcatgagagcaatcatagaccaatacaatacaatacaatacaatacaatacaatacaatacaatacaatactaaattattgagcatagctgtgttccaataaaactctatttacaaacatagatgactgtctatatttggtatgtggccatagattgccaacccttgctctaggtaaataaacttccatgcaaagtgattaaatgatcctcccaactttatatagctggtagaagtatgaatggaacctagacctcttgcttgctttattcatttaataaatatttattgagtccccattatgtgtcaagcactattgtaagtactggggacaaaaaaggtccctagccgcaaggaccgtgcatattttggggacacatatgatgaacaagtaaatgagcaaagaagataacttcagaaagtgaaaagtgccataaggaaaatacaactgtgatagagggcaactgtagctacaggaatcagagtgatccagtctgaagcagaaaaatgtgaactgcaatctggaagaagagaataagcaaattatgcagggattttgggatgattattccaggcaaatggaatagccagtggaaaaaaaaataagtgtggctagagcaaagtaaataaggaagaggagatctgagaaataacagggggcagataagggcaagaattataaaccatggcaaaagatgtggatcttatttgaagtgaagtgagaagtcagtgctttcctggttttaacattccatccttccttttgtgtctcctctgctgcccaagcacgaggcagatactttcagaatatattggttgattgatgggttctgtcactgaggtgccttcaaggcatgaaagacttaacacgctgggctcattgaagacccttatgaggggacatatttagtagatcctctttcattgtaggtttccaagaaggctgtgcctaatgctttttttcagagacagcatggtggccctttgttctctcctggggtgattctgggcatcatccagaccatctgctctggccccggctccctggccatataggctttgccatcatttgacaaaacactccaatagctaggagtgagatgtctctgacatcagagccactttgtcaggatgaaacatcatggtggattaacagttttgtggcaatccagttctaagtgtacaattgaccagctgtgaggaagcaactcaaagagttgttggactggtgaaatcaacttatgtatgttcaagtcctagtatactgcctgggccttagagtgcccagtggaagtcagctgccttttcttcccaaatgctcttgtatttagtgtttactggccatgtcccattgaaagcagtgattcacttagcatcctcatttcattagggcttacaaaatactaaaatattttaggaagccttaaagtaattgaaagtaaactgatgcagttcggccatctctgaaattattgacttttcagagagaattgttttggtggatactgggatgttcctccacccagattccccttcaacagaggatgggttgtcccagccactggaagtgcagtcagcagtcagccttcagtgtcagctgcttcagagattgcctcatgctacagagaggagcctcaccaactattttggcccaatttgggacaactctgaaggctccagagcttctcaaggaggttagctgaagctgttgttgagcttgcttcacagctcaacttctccctctatccaatcctgctgccgtctccttctttccacaagtgtagatcctaagatcattctctaaaaaccatcacgcatggttaaactccacccagagtctactttccagaaaacccaacctgtaacaattgggtacaggtgtcagtgttagcattcctgtgatcttctatttgtgaatttggtgctcatgtaaagtacttccttacaatcgttagcatttatgtcctgtgtctgaaagggtatatgacctatgtattgtttacaaatgacttttcttctgtaaagtttaaaaatgacagaaatgtcaaatattcactgaagcacctggaacatatttctctatgttataagagctaaaagaattttaagggatctttgattactaaatattcattaaatatgaatgacatggatgtatatcaaatgagaggttaattatagacttatctatgaggttatgtatcatatcagcatgcaagagaaggagaacatcctggcatttgaggggttaattcagggtcagaaagattaagaaatttagaaacgcatagaaaagatggtatatcatatttatttgaatcccaggctactgagagtttgcaaatgcttttaaatggttgtacatggcagcctgtgtccttagcagagagtgtccttgggcaaattagtcttagagaggttaaatgagggttgttgtggtgattaaatgagaaaatggatagatggtacatggtaagtgctcaataaatattagcttctgctgttgttgttattcaaagtggcatctggctagcagtccccagggaaggttctctcaatatctaacaaaaacactaatgaaggcctaggggaaaaaaaataaagctcccaacgtggaaaataagactgatgggtaatctaataccagaaccatgaaaaaactggaactaattcccggacagaaggagctgggtttggacacaaaatcaacttcataaaaggtagaaaaatagttcgtgcttctgtcactggagattcaggatttgaactagccagaaacttaggggcatctctcttttctcctgggtatgggaagagacagtacatctacaggcaacaggttggtagggtattatttgcatggggcctttgtaggaagaccccaggtagcagtgtaggctgagaattgtagtatttgacataacacatcagttcagagtaccagagaaccagacggtgaggtagggggaagacgtcagattgcaaggaacaaaggcacacaaaattaagttccacttaacttgctcatcaacttgtcattttgttataaatagtaaaagagtgttttaccactagcatgggacagtgtgcaggacaaaggactagctaagacgaataaagaaaaaagtagcaatggggcctgtgaaatataccacagaacaaggaaacagacagtatctagaagattcaggagaaaaacttctgataattaagtgaatccagaggaaagcctcaaaaaactatttgacatttgcaacagagcataggaagacataatcttcatgaaatagctgtggaacattagaaggacggcactgaatattatttaaaaatttgattataaaatcaaattaaaatgtcaaaaattattccaaaatgagaaaatacatgattttaagaaaatgatagacttaaaatcctttattatgttattaataaaaacaggtttattgggccctggtagtgagggtcaggaacattagactgtattgtatcccttctctcaaacagaggaaactcaaatgatataatttcactgctcattcataaggattagacagagtgcaaagcgtttataaaaataacttctaaatgactattaacagaattaaagtcaattattgtcaaagaacagaaagcaaaagaaaccagaaggaagaactaaaaataggaaggcatagaataagatgacagaagccaaattagtgataacaatactgtaagtaggttaaaccagtggttttcaaaattgtaagcacttgaagcttattttcaagtgaaatactatgtttaatcacaaactacaaagctctacttttttcagttgcatgtgtttattataaagccaattaatgagaccaaagttaatgaaaagtagcctccactgagtgcataccaccaatccttgagctgtcagtttttttgaaaattgatctgtagatgaatgcaattccaatcaaaatattgtaggtgtgaaaaaggaaagcttcccccttcatcctctgaaggcttgctgaaaatgaactgacgaaaggcaaattaataggaaaaaaaggcataaaaaatgtattttaacatgtatagaatgggagaatttcaggagaatgatcactcaacaactcaatgggggtacagatgcttgtacctttttcttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacggggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccatagtcatcctgggccgttctcaatgagctgttgggcacacctcccagacggggtggtggccgggcagaggggctcctcacttcccagtaggggcggccgggcagaggcgcccctcacctcctgggcggggcggctggccgggcggggggctgacccccccccacctccctcccggacggggtggctgccgggcggagacgctcctcacttcccagatggggtggctgctgggcggagaggctcctcacttctcagacggggcagctgccgggcggaggggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggtgctcctcacatcccagatggggcggtggggcagaggcgctccccacatctcagacgatgggcggccgggcagagacgctcctcacttcctagatgtgatggcggctgggaagaggcgctcctcacttcctagatgggatggcggccgggcggagacgctcctcacttcccagactgggcggccgggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcaccttgggaggccgaggttggcggatcactcgcggttaggggctggagaccggcccggccaacacagcgaaaccccgtctccaccaaaaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggggagcgggagacggagacggagacggagagggagggagagggagagggagagggagagggagagggagagcagaaacttttcaatttaatcacttctactaccctagtctctctccagatgcttgtacctttttcataggggaagggaagtgggggaaatgtggcaatttgagggatagtaagtgatttttagggagaaatgaataggcctaatgctaagacaatggtaagcaaataattttctttggaaattgagtgggatagagagtagacaaaggtttgggatgaagtttttctggggttttagatgtgatgttgacgttttagtctctttaggtccagtagcaaggggaggtcagagagattttgaggctgtttagttcagctgtatttcagagtgaggtgaaatattctggtttccttcataacaatgcaatttttattagaaagtgacaaaatgagtctaaagaacattttggaaaaataaagagaaaataagccacaaagacctaaaaagaagagtatgaggggggtgaagttgctatgccagatattaaagcatactgaaacactctaataattaaaagtgtgataccagctccagaatatccatagaactttaaaaacccaactatatgtgcatgtgtttatattttttaatttagaaaagattgcaattcaactcaattaggaaagtatggattattcaacaagtgatattaagccagatgtttaacattgagaaaaaattcagttaacaaaattaattataaatgtattaaagacaaaaagtttaaaagtgaagacataaaagtaagaatagaatatataatataatataagataatatagaaaataatatatgcttgtggtggagaataactttcaaaacatgacatcaatggcttataccagagattcactgctgaatttagaatgtagccatgctcattcattgacatattgtctattgctgtttttgacctacaaaaacagcattgagtagttgcaacagagaccattaagctggcaaagcctaaaataggtattttctgaccctttacagaagaagtttgctgacacctgtcataaaccatacaataattttatgtggtcaaatctaaaaaccttagcacagaaagtaacattgtaagcaacaaggaactgggaagaatatttgtagtatatgtggcataaaatggttgcaatatatatgttatatatataaacagcttttacaaaaaactaagaaaagttgtacactagtagaaaaatggtcaaaatacagaaacaggcaatgcacagcataggtatgataaatagccagtaaacccatgtttaaaggaatgtattcaaaaaataccacaaacagatattagcaggggctcccagccccttggctgtggactagtactgtctgtggtctgttaagaactaggctgcacagcatgaggtgaggagcaggtgaacattaccgcctgagctccacctcctatcagattagcagcggcattagattctcacaggaatgtgaacctattgtgaactgcatatatgagggatctaggttgcatgctccttatgagaatctaatacctgatgatctgaggtggaacagttgcatcctgaaaccatcactcctcctccccctgtttgtggaaaaattgtgttccctgaaactggtctttggcgccaaaaaggttggggaccactggatattaggaaaccaaaagaagaaaaatactcaatgtgggccaaaatatggaaaaacagagtctcatgagcttttggtgggtgtgaaaactgaagaggaattggtagcatgtaggaaaacctttaacatgtatatacccccccctttttttttttttttttgtgatggagtctcgctctgtcgcccaggctggagtgcagtggcacaatctcggctcactgcaagctccgcctcccgggttcttgccattctcctgcctcagcctccccagtagctgggactacaggcgctcaccaccatgcctggctaattttttgtatttttagtagagacggggcttcactgtattagccaggatggtctcgatctcctgaccttgtgatccgcctgcctcagcctcccaaagtgctgggttataagcgtgagccaccacgcccggccgtatataccttttgataaagcaactccactacaaggatttactctaagtaagtagctaaggagtggtacaatgattaagttccaaggatgttcattacaggattgtatataatggtaaaacattggaagcaaatttaaatatagaagcatatggcattttttaagtaaattatcaactcatgggataaaattttctaagctattgagattatgttgttggactcttttttttttttaaaaaaaaaaagcacaaatgttcagaatatattcctgagaatagaagctaggtcaaaaaacaacgaatactttgtaattgcatttttgaaaagaaattcacataagaatttttggcaaacattggttaatattagttatagctgccttgtgggataacagatgacttttattttctcctctttgcttattcatatgtaagtgttttattgaactgtctcatccctgtggggtatgaagaggaaatggttttatttttctccattctaagctctcactcccacaactgtgccatatgaaaaatccctccctgctggctcacagactccttaaggacatcttaggatgattccttaactttgctttttggatattaaaaatctgtccatttcatttacccttcagaacttttctctttccccagggcctgagaggtttgtggcttgaggggcgtgaagtgaatatggtttgtggtgagctcctctgggatgctctttctctgccccttgctcttcctgctacttatctggtatgggcaaaggaaaggaggcggaattaggggaaagagccagttacttagctgggctcccttgcaatctgcttttggtcattgctccttctctgacaggtcctaagtgccctccttttgaggaggtcaaaacccctgctctcctaaggggcgatgagatgtgtaccatttgcctctttttttatctgttccaactcctgctttctctccaggcctgctcaaccactaggcttctggggtggggacatctgcaaaacttgctcagctttgcttcctttgcagccattctcatgacacatgcaaaactcagtcatgaatggcaaaccaaacttgggaagtgcaagctgcttcacagtagctctgctgtctcttccactgctcttccctgctcagcagggcacaaggatggatcagtaagtcctctccctacttagatttcaagacaggacctggtaccagtctccacctcttccagggaaagccaatgttactactggtgattcccttagagcctctcctctggcttgactttcttcatatttggttagctttgacaaaaggaagtgctccggtccattgaagggtagggaggagagagaagggaattcaacagccctcctcacttctacaatgagctaggaatccagaaatgtccccctttttcctctccctgtcccctcttataaatcagggattatggaatgatgaaaatcctagtgggatttttttctttgaatattttaggaagttctttgtgaagaatgcactgatgaataatgttataaaatgtgaaaatttgaagttatttgaatgttttttgaaatatttccaactgcccacacattataaaatgtgtgggcagttggaaagacttgcttgaccagatctcaaacacattatacaattacagcataattatgaccaaaaatgttgaatgatcaatttttaagagaacacatagccctcgaacagattctagcatatggaagaccttagtgcgtgctaaaggaaatatcagactaatgagaagggatgacatattcaacaaaagtgctgagaaaattatcttggaaaaaatattatgttacattctcgtacaccaacataaatttcagatgcatttagaatttaaaatgtaagcatgaaaattctggaggataaaataggtagttgtagaactgatcttaaattgagtaaactatttctcagccccaaagcagtggaaaaagatacaaagaaaaatatgatcattttctgaaaagtaaacatatgcaagtatgttatgggtctattgaaaactccatctaaatagaagcaagtgagatatgtcaaatccattctagtataacaggacagacaacaggctagtatatttaacacataaatatactaccagtcagcagtcaaagcactaatgtcttcatagaaaaatgggccaacacagaaatagaaaggaaagttgtattcatgaccccaaacgatatcaaaaacatatctgacctccctagtaataaaatactgcaagctgggcacagcggctcatacctctaatcccagcactttgggaggctgaggtaggaggattgcttgaggccaggagtttgaggccagtctgagcaacataacaagacccaatatctatagaaaattaaaaaattagctgggcgtcgtggtgtgcacttgtcccagctattctggaggctgaggtgggaggatcacttgaagccaggaggtgggaggatcacttgaagccaggagttggaggctgcagtgagctatgatcatgccaccacactctgggcaatggcgcgataccctgtctctacaaataaatacatacataaaataatgcaaacccaagcaacaataaaataccttttcacctataaaataagagattttaaatatgtgcaagacgataacagaacagtgaggtgatcatttttatccacagcagatgagagagtaaattgccctaacttttaggtatgcacttgagcataaagtaaacagagccttaaaactcctaatcctcttccacttagttattgcactcctagcaatctatctcaagggatgaactgaatgttcaacacaatttatgcacaagaatattaatcatatatttataatcatcaaaagttgaacagaaagacaaatgttgcatgttctcacttatttgtgggaattaaaagtcaaaacaattgaactcatggaggtagggagtagaggatggttaccacaagctgagaagggtagtggggtgtggggagtggggattgttaatggatacaaaaacatagttatatagaataaataaggtctagtatttgatagcataacagggtggggatatagtcaataataatttaattgtacatttcaaataactacaacagtataattggattgtttataacacaaaggataaatgcttgaggagatggatactccatttaccctgatgtgattattacatattgtatgcctgcatcaaaatatcccatatgctccataagtatatgtacctactatgtactcacaaaaaattaaaaattaaaaaagttgaaaataaactattatatttttattgggcattcaaaaaatgcattacaatgtctttattggatggttttggtacctgtgagatatgccaaatattccatgtgttggagaattttaattgacatggccaagtgcttatgtgaaaaaaagctaactacaaaactatttatagcatgactgatttttttttcaaatctcagaaacatggctttgatcattttagtgctcatgcctgttagattgtgcttttttcatatagacagagagaaccttcccaaggcatgagaatttcagcccaaaaaggaaacagaagggattcagtcctatattccagttatagcagtcatccctgtcctcttcactctcctttctcagtgcatcctctgtcaaaatttttaaaattgtactagattcaaatattcaatttctattttcttaattatatttctaaatatttgtttttcttatattgttgacattttaagaaaacagcttaattgagggataattgacatgcaataaactgcatgtattaaatggtgcaatttggtacattttgacatatgtatatgcttgtaaaaccatcaccataatcaagataatgaacatagcatgattgggattttattataagaacatatggcttggaaagaactatgccataaagctcagattatttatatttaacaaattttattttactcttttgaatgtgttttcaaaattttctatgatgcatatgtgttacttttatgatcagaaaaactttgaggaaaagttagtaacagtgactaaaggtgggtggcagaatggcaggtcaggacttgctgccttatggaaaccaaataaagagaaattcttagtgaggaaggctcaagactttgaaatctcatgtatcagacaattaggttccatcagaaagggtccagctccatttttgtggaaaactgatagaggagattaaaaaagagagagtgagttaagaaatgaatgggcttggcagagtggaagaggaggggctggggcccaggtgacaagataagcctagaccctgaggagggatacttcctcccctgagaccagaagtaatgaaactagagggaaaagagaagtcagacaaaattttatattggtgggtggagagttaacagctacatcacagcatcacttttgcttatggagcaggaggcaaggttgtctcctaccaataatttgacttagaggtcataatgaaggacattggtgcttgcattgaagaactgcctggtggcagaagaccaccgtttgaaatagcccctattttcctgttttgctaaattttgtcagtagattggggcagaagaaaagtgaggtgtgggattaattcagtgttggagttgacagagaagaagggggtaagtaaagaatcaaagagttagggacacaagttaggtcaggggtactttattattgcaggagcaattgctgggatataaattagaaatatctactgttaaaaaagcagtgtgtgtgtgtgtgtgtgtgtttaaaaacttaaaattatcactcttattactggaacatggttgattttgatcatatttcaagttggattatcacattctcctccagctaattgttcacccaatatcatttagttggcattttctaaacactccctgtgctaattcattccatcattacaatatagcagttaaatcagctcccttgttttaaatgaaatgccaggagtagtacctgcctgaagtagacgttctacaaatatgtttaatagatgaccaagtattcctgtgcatttacagtcacatataaaacagtgcatcattaaataatggctttgagattctttcagatagccacgaataagacaatgttagcattatctgtaatagatacttgggaggaaaataaatttatcagtattctaggatctctaaaatggaagaatagcctacccaaccaaatcaatggcaaatgtggtattgtcctcagttctacacagatcagatgacagctgcgaatggatgttatctagtgaaaatttcccaccatattatacttgcttgcttcaggcatcttcatgttttattaaagtcactaaataaattgtcatttcctttccttgctcttggaatgttctaaagtttctgagagtcattacttttcagagagcacatgaaattacagaagttgtttatcagcactaggtatttcctttgagagttgagctttagggatagcatatatttatttccaccaatcatgcaagctaaaggaaattgtcaagaactaatattaaacagccctaatagatttgcattaactctagatctagtattcaccaaagatcattttcagcagtttttgtatgcttcctatctctgccattctcatttaagctatgttcataattgaagagtcactgtcttgaatttatattttgaaagatgccagcctgttatatggagtattccagtgcctgagtttcagatctaagcttcgtcttttttccaggaggatcctcatacagtggctgggtgaagtgacttttgttctctactgcaagtagtgatgtctcagtgaaggtactggaaactttccatgcttcagtttcctcatctataagatggtaatagtatgtctggctttatacaacagaacttttcagagattcaatattttttttaatgggagaacactttgaaaataattcagggcaaaacaaatacaggaaatttttcctcttgtaagaagaattcaactcaatgcaaagaaggttttcccttctggaatgttaccattgggatcctggcatcatttctctcagtattttgatgaagacttctggttgaaccactcttccatcattgtttagaatccactacacactattcatttttagtctcttataggagctaaatattgtccctctctggatctcatcctgtgtacttggagcaagatggcacccaaggctctgagagacccatttaagactcttgaaaatttggtagttggaactcggtagtctctgctgaaggagaaaagccatccttagttattgaagaatagtttttatgtttaatttgatttcattcctgataacttaattgttatactgatttgtttataatgttgaaattacctcttagctcagtcagtaatgatttattttgatattacaaaaagtcattaaaggtaagataatactccttctcctattactttgctgcttttctaaagataattgccttaagatttatagttctcctattcttaaaataagaacatttgtccacacaaaactatttgcctagctctaataaaatattatccacatagacttttttctggagaaagaagtatacttgaattctgaacactttcactatggatttaatctctactgcaaactacaaacattatcagtgtgaagataggaagtaggtatagtgggatgagtattagtagcatttagtgctttgggttggaatgacaggagtttagttgcaatagttaggactttgaatgaggatttgcgtctaagtttcttttcttttttaaaggctgttggaagagtttctacctagataaaccaagaacagagttatcacattacccctgactatttgaggtagcagatactgttagagccccacccatatctcttcagctttagggatttcattgcatgccagcccaatttcaaatgccagcaattgcatttttgcctgagggctttctctgggtgcttgagccaattctactcttgcccatagcaggccagaagcaccaggaaattaatgccacctgagaatagccttcaattaatggctgatgaaaatagctgaataaattcctcagcctttttgcttctgggacactataacactgagttgtgttctatgctgtttctcagagttctccagtgggattgagttcacattgccctcagtggtaacttcatggtaatgcctcttttattgacctttccttctctgtctcacttcctcactcctttactggtggtttctagaatcacctccaaaaaaatctacttgcacttaaatacttgacttacggtttgtgtctgggacagttgtgaatgtagaacagttggaaatctagattctgtccatacaagtatgtttagggagggaggttgacagctgtagtcaggatagggataatgaaggatgaagagtgaacttacggattcacatcgtagaactattcgcaagggctatgatggcatcagagagaaggctttctgcccttaactaaaagggcaggtgaacaagtaactcagttcgtgtggctgagagagaagcaaagagagagaaagacgaagagagagagagagagggaaggaggggacttgagggccaggggcaggaagagaacttgacgttgagagtgacatatgagagcatggacaccagagttcacaggtgaggagtgataacagtgttgcttgtggcaacgcagtgcacagtccattctgatcagcacagtggcagtaagagcttttctgagataccagcattcccagcacacaccacccttttgtggctctcccttcactcaccctacattaccaccaccccataggaggcatggctaggacttggttgatacagatttccatgcatctctccctaactatgttatttaaaaagcaaatgtggatggaccatttctggtgagaataagaaacctgtaggtagttaatattcccagttcatggtagagagcagcactgtaagaggagcaagatgttgtttgacatttaaaaatagacctaactctaccgattagtctgttctgtccatggtaaccttattcaatgttatggtagtaatcgcttctggaaagctttgacatattttataattgaactgccaggttcacacttagctataattcattcacagataagtgtgtcttgttaaccaaattatgttgactcccttggaaggccagtgtgaggactttcctgtttcttgtcttcatgtggttttatagtctcatgacagaccattagcatgatgaaagattgattattgtcttgggtaccaaactgtaatttggccctattttcatttttctttttcatcaactgcagaatcatatgcatttatcaaaatgggtgtcatctgttttgaaattcatgaagttagattgcacacttgtcaaacattttttttctggcattgacaaaacatcaacatcaagctttacttaagttatttagaaatagagatgtccaggtgaaagaatggtggaatcaaaatgaaagactaggggctggaatggctcattcattctaccgacattttttgaatgcattcagtgcacatggcaaattgccaggtggtgagctggagtctgtgaatggttggagagacatgaagctgattcattcactcaaaaacgtttagtgcctacagtgcttgacactgtactaggcactggggaaacagcagtaacaaaacaggcaaagtccctttccttacagagcttatattctagagagcttatataatataaaagaaagggaatatttagtccttatcctcaaagatcttacaatctacttggaaagataaagtaaatgtattaagttaaaattacacagcaatgcaaaaatgggacaaatgaataaagaatgtgttttacatgtaggtggttaaagcaagtgcaataaaagaatgacccaacactgctctgccagaaacttgctaggacctcaaggaagtcatttaactgcccaaaactgttcctggagcagtgatttaggggcagttttgctgctgattggagcctttgactatccgtcttgaaggccattcacaatgagcaatctggaagaaaggcaatctctgaatgcaactttaaaaacctaaagtgaatatcatacgaaatgctgatgcatatattcatttaagatttagtgacaagataaggttgcctgttagcactgtttggatttaacgtggtattaaaggttgcaagcggtgcatcagacaaggaagattaatacagttttaagaactggaaggaagaagttaaattgtcattatttttagacaatctaattgtttatggagaaaattcaagaaactcaacaagctattagaactaataagaaatttcaacaaggttggtggataaaaataaaatttgaaaagcagcgatattccaatacatcagaaacaaccaattaaaaatgtaattttaagaatcctattaacatgagcaagaaacacttaggaataaatgtaataaaaaatataaacaacttgacataaaaaaactgggtggagagtactacatgtttgtagatgttatttcgacaaaaatcccagtagttgtgtgtgtgtgtttgtgtgtgtgtaatttgataagatgatcttaaaatacaaacaggatggtaaaaagccaagaccaccaagccaatttgaaaaataaataaataaaagcaaggtgcaagaacatgacctaacatatatatacatatatatgtagaaatatatatgtagatatatatatacatatgtatatggatatttatatatgtagatatatatagcaatattacattaatttaaacagtatagtgttgctacagagactgaaaagtagaccatttatcataggaaactgtaagcatttctgtgtgagtgtgcttatgtattgaagtgtgtgaatgtgtgtcctattttaaaatagaagtattctagtctcagttctcattgaagcatgaagacaataaatcctatactccaaagacaccaccatacaaacatttcaaagtcaaaatatgacaattgtttattttgcctctgagcccttttctttcatagaggatgtagaaagcagtggagacttggaggggggtttgtgaagaaaatttctttggtagttgctgtctcactgcaaactcctgccagggcaggacagttcggattgctctccctttgcctcaggtccaaggagaagaaaggactgtgagaagttggtatggaggtcctaatggactggtgctgggccccttccatgaagtttagaggctgtgtaaggagcagggacctgcgttggcgatggagcaagtgcccctgtgctgagattggcttccactcttggactttgctggtgctaagggtgtcagagtggttcctgtggatgagatggggccacgtgcagaagagagagccagcctggagctttacacaaccctgtcctagagaaccaccaggaggggcaaagagattccaagagagagtgatctatatggagtgggcacctgaagagcaagagccgagaaaagtagccagcaaggggagaggcatttgcctggctcacaggacatccacctcaatgcctcaggggaaacgtttgttcaaagagagaaagtcaactgtggtgtctgccaggcccagagagtataaagtcatcttttactccctcttctctccttagctcctttataatcagaaagctggggagcaaggtaggggcagggaattggaggctttaggcagagagacaaaggggaaggatcatgtactgttctacaacacagtcctcatgtctgcagaaggcccagctgggtgcaaaaatataactttaaatcagtttgagttttgatcattatataggactaaactttcatatgtatgtatatattcaggctcctgctataacaccaagtatgcatttctgaaaaacctctcatgttgcaaaatcacacactataaataactggcttatgggaaaaatagagttggggcagaccactcaaaatatatggaaatttctaactagactactaacaaaaccataacaattctaataaaaaccctggcatagttccatctccaccaatatttacactcagcctcacaatcagctgatccttgtctgctcttggccatagatttctttcacatttgagatgcaggatagtgagggcattcaattatgatgagaactttaatcaaaacaaaaaatcagatgcagagtgcagacattttaaaatcaaggtccttccttcctcccgcttccctctccacttccacatcctccctctctccctccctcctttcctccttccctcctttcctcccttcctctcactctctctcccttccttccttctaattggccagcttcatgtaatatcttgttgacggcaaataatctcagtgtcaaattttggaagatcctaagaagtcatttaattgaaattattgaaaggaaactttcagcaaaaccatgaaggatgctcatcggcacactggcccacctaggctcttatttcttcatcatcatttgctcagcttatcttgattgcttgatcaatgggttattttgccagccatcttttccttcatttggcccttcatccactactcagctgccaggcccaagtctccatggtctgtgtctgatttgtgttgtgatacagaacttaaaaacagccagctaaactacataaaaaataaatacttccaaataccacctaaaaacctaatggcatggctctgataactatgtctaggaaatgtaaaatgtaaaagaaaaatttcaattcaacactaaacatgtactggatgcttgaaaaagaaaaatatccatttctctaccaatgaccaccaaccataggtagttgcatccatggcaggaaagagtcaagaggaagaggtagaccagagggaaaaacagatggataataagaaaaataagccatcaggttaccaagttgaattctagcagagtctctgttgaaacttctctctccttctaccactgtctcagcccatgcctccctcagggtactcacctcattccctggtgaccaagtcttctgggtctactgcacatttatttaataagtatcttggctgcactcggttccattgattgtgaacttctcacttttcataacaaaatctgtagcctgtaacagcagtgtgactgagaaaattgcaatcctgtttccaagtgatccacagagatcagaacaattcctgaggaacactgtttcttttgaactatgtaatcttcttttgtggtcctatggtatccaaaggaaatctaaccttgtgactttatcagggaccagagagaaaagcatctagaatccaagatgagtaactggcatttaggtttgataggacacaatggatttaaattgtttctgaggttaatcttttttccttgactttgaaattgtttattattggtcagaggcccatgtttcccacacaatgatagagctggaatcaaggttcttatccacttgtttccaaagtccaggcttaggtaacaaggtcattaaattcagaataatggacatagtttgctagggaatttaagggtatgatatctttgtgacttggtaggcattgtatcaccacaaagggagcagattccctgttgtacaatacgaaattagaatcccagcaatgattcttgcccaccgtgtgactttgggcaagtttcttaacctctctgagtttctacatctgtatagagggagtaaggatttatacataatgaagttgtgagaattaaatgagattatgcatgtcaagtaccgcatgcagtgcctggaacatttggaaacagtcaaatagtaccttgctactccatttttgagccctgtattactttttgggaattgagctgactggaacaagtttgatgtttgtcttagtaaggatgggctatgttatactgtcataaaaaataatcctaaaatatcagtgtcttataacaacaaaggctagcttccttctttctgggaccctaggtagcagagtggcctcgtcctggaacattgccagtagttgtggcaaagaaaaagggaacatggcgaggaagagattggcccttaaaacctccatccagaactgacacacatcacttctgcccacattcattggtcaaggcaagtgacttggccatacataggttcaacagaatggagaaatatactccttccacgtggacaagcagcaaatattggtgaagaatagtagtttaccacagggttggttcagctgaatgtttattttccagctttatttctctgaactctccagacaaacatgtggagtgagtatctgatcatatgattatccactcatatgagaagtttttgtataatcctacctacttatcctttaagtatcaactcagatgctgcttccaccatagtcttttgggattctccttgctgaaaaataaactctttccactgtggtatgacacttttcttcctagggcatgcaccacacactttcatggattataatgtattatttgtatagattttttttcttgagagtaattatcttcaaggagtttacaatctgtatcttattaatctttaggaaaatacctagttcagtgtcttgcacataattgattcaaatatttatagagacagactgaagatctgaggtgagaagtgataatattggtgggcaaggtggaggaaagtgggtgttacacaacagagaagggtctcctcttgaaggcaaatatatgttttctggaaaaaccttggtagtaatcatgggaaactccctggggaaactggatgtcagctgagactcctgagaactacttgtgcagggttcagaaaggacagaggctgttagagaaaattaaagtcatcagacaaatatatcagctagtttataattagcaattactgcaggaaggagaaacatttatcccattctgacaacaaagattgcataattgcaccaagagtgtttgcccacaccctttccaagatgtgttaagcatttacaaacagaaacaaatagccttaacattggtgggagcagcaagaaaacaggctttcttaggctgtcactgatccatgaacactaggcaacaacatggttaccatgtgggtggatgaaccgtgtctccatgttcattttctttaccaataatctctagtgcttagtcaggtctgagaaagaaccaagaaaaatcaattcatccccagttactggagataccaataaatcacctgtatatttttaattcaattattaggtattgagaatctactatgtgccagacagtgatagcttgagtctacccagtcttttaaatgacatagagtcttattctcaatgcctttgtaaatgtttttccctccacctgaaatattctgatctctgtcccctacatacccttctggttttgctttagacatcacatcaattcggaagaatttctagacctccagacaaaggtttcagttcccccttcaatgtgcttttataacaatataaacttcctcacacacaaaaaagcacaattgtattttcttgtttaaattgtctgtagtttccattggcctatacactcttagaaggcaaggcctgtttcttgctcacttctgtatctcctgcaccattgtgatgcctgatgaaagttgattaatgtgtcattatctttttatggctattatatgattatattattacaatgtattaccatgtcaatgccctataatagtgttaagtgtctatgtacttttcagggatttagccatttgcagctagctgtaatttttgaagagctatcttctatgtgtagcgtgctttttgtttcagtgagctaaacaaagccaggtttgtctctgtgactatcttgtggtgtggtcttgggaaataactttacgtcttcaaactttttccctcatttgtcaaaaaagaatgtgaaataagagatgccatatgtttgacattctgtggtggcaactgtgtggtgattttgaaacatgacccaaacattttttaactctcctcccattgagtggtggggtctatgttccctcctcttgaatctgggctctgtgactgatagtccaatagaatatagtagaaatgatgctgtgccagtttctaggcccagactaagaaactgacagcttctacttcctgcatcttgggatgctcacatttgaaactcagccaccatgccgcaaggaagcccaggtattccaaagagaggcctgccatggaaaggaactgagttccctggtcccccgtcccaactgagctctcagataacagccagctctaagttgccagccatgtgagtgagccattttgaaagtgaatcctgcaggcttccattgagctgccctagctgatgctgtgtaaagcacggaggagctgttcctgcccagcccttctcaaattgcagatataagaataaagtaaatgattgttgttgctttaaaccactaggttttggagtggcttgttacacagaaatagataattgatatacaccttttgctacttcacagtgtctcagacctttcatccactacaatattctggtatgtataaaattaactccagacctttgagaaatcaatgcttactccaaatttattacaggaacaaaagcagtaaggatgagatgccattaaacgatcaaatgctggttgagtagtgcctctcctgggcttcacagcagaggttaatggagaaaactttggttaaattaactgatgtaggtgacaaatgggccaaccactctccattggaatgtaagttctatgattggtgataactctttgaaggactttctggagatgactgtcaattacgggtggatccccaaaccacatgggaggctttcccttcatttattttgtgcaaagtaatgttctcaacaatagcactgaggtatccatttaccactgcccccctcagtggcctggggcttggagccgagaccatttctttcaaatggcattatgctacatataaaataagatatttacatcctccaataaataagtctctaggtgaaacagtctagggtgcataatgaagagaagctcttctttttcactagctaagacgtcaatcttcaacaggcttgggaaataaggattgatggtgacatctttgtgctaccattgtggtttctgggactggtggcttctggactaggtaccaggaccgaacttctgtgattactcttctacgggagggagttgcttttcccccttagagcacaatggttgtgagcaacagccctggagccaaataatctgggtaaaagcccagctcactagctgcatgaccttgtacaagttactaggcctttctatgcctccattttctcatcatggtgataatactagtgactgtttaatatggttgtttttctaaggttaaacaaattaatatgtataaagcatttagaacaatgcctgtaatattgtttggatgttcatcccctctgaattcatgttgaaatgtgagctccaatgttggaggtgggcgcagtgggaggtatttcagtcacggaggcagatccttcatgaatagcttggtgctgtcctcttggtaatgagtgagttctgactctatgagttcacacaagatctggttgtttaaaagagcctggcacctcctccctgtctctcttgctatgtgatatgcctgctacccctttacctcctgccatgattggaagctttctgaggccttcactagatgcagatgctgacaccatgcttactgtacagcctgcagaaccatgagccaaataaccctcttttcttcatacatttcccagcctcaggtatttctttatagcagtgcaaatggagtaacacaacctgcaatgtagaaagcactatataagtgttagctattactattactgttaatattgtcattagttaattttatttttattttcttcttaccttacagctgattaccttgcctataatcagatcctttatgtatggacaccaagcagagctgccacattcagaaggccttttattaattgcaaaagtgcaaagcataccattggaacagggaacactttgggcatcctcttttcctctcttattcctgggactttgtccgccacagcactctcctcttagttattcctcctcctaggaactacccactcccattccacttctactagtccctttttataccatcttttgaataacatatttgagaaaagatttggggtttgaggcctcgtatattttgggagtttttttcccccaacactcaggtttaagtctacacctcagattgcattccctggaaatggattctagatagaattgtgtgtagaaggtttactgggttgtgctccagagaaatacacgcagaaggaagtgaggaaggcaggactggacaaaggcagaagactcatgatggggttgctacagaagcctcagttgatcctatggggagtgctagatcagggaaggcccttcaagttgtgccaaattgaggtttatggggccaggcttttgaatctccaaatcagacactgaagccgaactacctggaggaggcataaacttgggcaggctgtttctcataggcaagggcacttcatgtgaaggggtgcagctgtgaatcatctgcagctgatagttccagcagctgtggatgggtgcattgaccctgagaagaggatctggacagagcaccacagtgtccactaatgcagacaatttgtttcaagaaagatatatttctagtgaaaagagctttgaagtatactcacaaggggtatacgacccaggcaaattattgaatctctctcaccctccttttctcctatacattggagatgagatcatttctaaaggctaacagggctctgcgactgcatctttcctacggggaatactcagtcaagtctagctcccgtcccatcttgctcaattgcatgacaccaaaaatcttaggtccagaaattctagccccggtattttcaaatggctctggggcctgtatgtctgttctcacttagcgctagccctgagggcaggaagtgaatgccacttaagcacctacaatgagccaggctctctgccagctcatgtcaccttcaccacaacactgagggcaggtgttaggtcctcattttacacaggaggaaactgaagctcagacaggtgaaacgacttgcttaaggttatacggctaataaggggcagagacaagactcaaatccatgttcatacactgcttcatgtactgctgccctggcccaggtataatgctcttcactttaaagcccaagcttccagaatatagctggaaacaaaaaattaaaattttaagggggattaatattttacaaatattgatgtaattttctattctgccttcctgagcatgtgattgtactctagttggctcatgatacccaagtacctagaaatatttttgaagctatgtgtctgtatgtgtgtctgggtatgtgttagggttaagaaatgttaaggaatacagaaagagcatgaccatatttgcagaatatgattgtgcagcagggcaacagccttgtaagtcaggctatagtcttagaaaaggatttgctcagtttttaaagctcattccctttttacaacatagcatatccagcctcaagggcccagagtagaactaaaacacactgagtccacacagcaaagccatgaatcttgctgctcagtactagaaggagaatatgacccagggaactaagagatagctgaacccctttccctcccagaagaaagtgggaaggagaaagaggtaagaggaaaatggagatcaaactaagctgttatgcgtccctgattgttttcgctccaggtgtcagtaaggagatggtgaggggatttagagaaattagggtaatgccaagagtgaatgaggcatagcatggctggacagaggaagcccctaggttaaactttgtggtactgccagtgttcaattcctggacttggagttaccatagacttggagttgagaatccatggacttttcccagggatcccctgtgacagaatgaagaacaattttactgagtcttggggtagatatctgggccaacaggcatgatggagcacttggcagagacccagggattggtcagtaaccagtgggggttgaagtgaagccaagtcaccactgagttggaaacaagctgagagggttagcaaacaagggatttaccacccacagccctcagtggatagtggggacacagtaaatagtccattcaaaaggggactaaggtgttccccttattgctttggaggcagaggtcaccatgcctgaggaactcaagctcttcctgccatcatgaggatgcattagtcccccaagtcctgtcccattgaataatagtgtgttagatattattttccctattcccacacaggattcattttcatccttttctgcacctaccagctcccttgacttctggcttctggctgcctttggctaatggacatcaccagcaggaaggcaagagtgtgggtagaaagattgggcttattttcttcctgctccctccatacctgacagtggattaaaggggactgcattccccggatgaaggtcacagcttctaatgagcagccctctcccatagccataagcctcaccaggctctggaactcttacctccttttactcttttaggcttaggggtggcagcatcctcctactgttgtgggccttaggtgctttcccatctcttgttggcttctcttaaccctatctacacctttgaaaaatagacccttaattaaatgaaccccttttgactgtggtttccatctggatagaatgactttctgtactggtttgcccccagacagtcccagtctattccaattattccagtataattatttcagcatcctgctttactctcagaagttcctggtttggacagtatcctactcctgggaccctgactgctgtagcatcttagggagggtggcaggaggaagtgttataggttatatttgaaccatactgcgcctttaactaactggctttcctgcacactcacaggaaggtatccaattagttatagacgcaatcaaagaagctaaatttcctctacacttgcaggttgtgatgtgaatgatttttcaagtcctatttctcaatcgtcactcctgggggacaggactctaccttatgcatctctgccagctcagctataccaagttccctgtctggcccaatgttcataaacactgtctgaatgaacaataaaggaatggtgtcactatattcaatcagcgtgacaactcactcacacatagaggtaaccatggcaccagttcttacaggagctgcacatatttcacagaagaagatgctgttaaagaaaaaggaatgggaggaatggatgtgtgtgtgtgtaggtttggacatgagattataatctaaatacgaattcacaatgaagtctcatttctgttattagggtgagcatgaaatttaaagatctgcctgcagatactgtggtcccaacaacgagcatccctgagtgcagtcagcctccttgcatcaggagttagaactcactgcctctacctcctgcctgacctctttctccctttatctgaacaaatatgaatagaagaatctcagtagaactcatttgtttctcttgagaagcaggagtctggggtactcaacgaccacaactgcctatgacaacttctcagaaactcaaccagccaagagtagccttagcccttctgggtgggcttgcactttctctcaggcaatgatgttcattactgagatgctggtggccagaggtgggtgttgtgacagggagtttcctgtgcaccttgagccaggcctgggtgattccacagttgtagtcctgaaaatgacacttatctcatactcatcatggtgggtctctgagtactcttcgattttgactaccgctcctctgggctctttctccctgccatacagggctcaccctcatattaagcaacctctatcctcaggtccgggatccatttggggtcacctttttgctacagcaacttgtcatgacctcccctgcggtggacttgttatttatgggctccttcttaccttttctctggccatgaccacaagcatccctgagattcctgatagagtctctgcattctgattctagctccttacgactgcccccacttgtttcctataccctaaaaggacaatgggttccccaactcaagagatgtgtcatgcttaacacatgactgcacatttttgtcactcgtcccatcaagagctaaagtctaatccccttcctcttgaacatggcctggccatagtggtttgcttctaacaaataaaatgcaaagaaaattattctttgtgattagacctaaactacatattaaattatttcatcttaaaagatgagacagcattggcctggctctctgtcttttttgagaggctcactcttgaaacccaacccaggcaccagagacaggccacaggtgggtgttctggcctacgaccccagcagaggtccttgttaacagccagcattaaccaccagatacatgagtaaggacaccttcatgagaactccagttccagtctctgtctgactgcaaccatttaagagaccctcaagagaaaaccagctagccgagcccagtcaacccccaggcctatgaaagataatattaataaatggttgttgctgttttaatgccatcgtgtttggggtggtttcttaggcagctatagacaaccataatgagaggcaagaagaacttggataaagctcccagagagccagaggctgattaaaaggttatatataaaacatgataacatgctggggaggctgagcttctagccaaccaaaggaaagatcaagaggaaatttaaaaaatatctttaaaaacgcaacaaaggagactaaaccttcttgagttccagtgaggacagcataacaagaaatcagcttaaattgtagcatgacaatttgggattgatgtaagcagtgatttttgagtggggaaaaagccctgggtagtcatattttcacatatcatatatcccctttattgtcctcctacccagttaggtgcctgcccttccttcatgttcactgtggtttctaaaaactattaatacaaaatataataaatacagattgaagataaaatgcattaattagtttatagatattcattatttgggttttaaagaattaacaaagaaattatgtccaaacaagatttccttagaacagtgtcatctccttaaatagtatgattttttaaaaattaacacacctgggttagttggtttggagctatgtaatataatttgccaaaaagattcatgtagaagtgtgtactggagagatatcacttagcattctcgttatacatgagactattttgcaattccatggctttcaactttcttcaacctggaagcacccccatcttacctcatctgcctgtacagttacctgttgctaagtaacaactgcaccctacccaaaataaaatatagcctaccttccgtatctgtgggtttcacatatgtggattcaaccaaccataaattgaaaatatttgaaaaaaataaaatggatggttgcatctgtactgacaagtagacattttttcttgtcattattgcctagagtgtaacaactatttacatagcatttacattgtattaggtattatgagtaatctagagatgatttagtatacaggaggatgtgcaaaggttatgtgaaaatactatactagtttataccagggacttgggcatcattggattttggtatcctcagggtcctggaaccaatccctccacaagtatgaagggacaactatattatgtaagcagttatttttgagtgggggaaaaagccatgggtattcatattttcacatatcatatattgcctttattgtcctcctacccagttaggtgcctgccctatttatatagctcatgattctgaggattggttgagtcccatggtgtctttgaaactctagtctgagactttgctatactgtatatagtttggagacgtgttgagccatcagcaggtgaggtgctccatagccaccaggagtactgtagttcatgagcagagactcagaaacccttgactggaccgccgccctcactcagtcttgaaatatcgtttgtttttattccccaccccttccacacttacccatccactgacactctttgggcaggaacctggatttacagaaaacatccagaaacctcttgaaggaacaagaatgaccctcctgcatcttaaaggtaatcacaaaagctgaactcggagaatttttttcctactgcttctgctgaaattttttgatgctggaaggcatttattcagcttttattattttcttattaaagaatatttaatcttactagtgggttgctgtgggtggtgatcacttcagagggaagaaaaagaaatccaagcatatttctgtggaaaaaatacgtgttaaccattatatgatggtacattatttagggttaatatacagttcaggaaagaacataagagaatagcttccaaaccatacagaaagcaaaatcaactctgtgtaaaccataccctgtattaacaaactctgagctgtgttatcttggaaaccagattgattttctggtggacattttttctgaattaacttattgtttataaagtaccctggagctacaaagtaacattggttatacaatggatcagaaattctcttgacctacaatgttgaaggctcaaaaaagaaggcccaagagaactaagagagggccttggaatgtttaccttgtaagtaccaaggccagaatcttgaagaaaacatataaatgacactgccattaaacaaatcacagtttagtaaaatgttaatctaagtttgtcctaccatttgctatggtagaacaatccctttagtttaactgccccaggaaacaatactctgtctgtgatagactggttatttcttaatgtcttcatgatctgtgaaatggaaaataataatagtaatagtaatagtaataatacccccttcatgaggttgttttgagtattgcatgaagtaacacataaaaatgtgtagcccagtgactggtacttaatactagctaacactcagagtcatgatgagtattactgctagtaggcatcataatgcatgtaagaacatgtgtttttaaatttgatataattgaatttaaatgccaattgcttttttaaaaacataagtagcaacacatccttgggtatatcaccataaaattgtgataatattacctgtcttatatagttgctatgaggcttaactggaattacttacaaaaataattgaacacagtgtctggcacatggaaattaatgaatgaatgatagctcttattactctttggaacttctatagtatctagagagatatgtttggtctgtgccatacctgatggtatgcaaaaacaagccactgtgcctcaggatttgcggtaattgtgggctgagtcagctcaggtcctcctagaagatgggattagatgtaaaatgacttattgggagaggctcattttgatggataaatgggcagtaagcaagagtaggcagagagaaccttcagagtgggaggcaggtctgactcctgtggaaagagagaggaaggaaggaagggtgggtagggagagactctgatggcagtgcagctctgagaaagtctcacccaggctgatggggagccccagagcacagactgcacataggagaggttccctgtcaggcaggaatagcccagctctagttctctcactgtactttgccactggcctggggtaagcacaaccttggcatgggtgccacggtggatctgaaggttttgcagctgtagactgtcagcaaatgatgctcctcctctgagcagggctcttgaaaggagatctgaatgccgtacctctatggccaccgaaaggtgccaagttaagcagcatcccagtcagaattatctttgttcatattagttagggctggtttgggccaagccctcataacagaccctttctaaatgtgaaattgaatagaattttttaaaaataagaaatactgcatggagtatttatagagaacaattgaggcacttaattgaaaaactatgatattatgaaaaattaacagttttcatttagagaaaagtaacacaggtgccaacttgtcctgtttgattcctggaaggaagacagaccctacatttcttttctatatgtaattgaaaaaaaaaactggagattttaagtgacatctttagttatgaagtttcaataattcattctggtgtctattcctaattgcactgatcagatttatttaaactttctgttttagagggatctcaggaatataatagtagaggtagagtggaggaatatagccagtctacatttacctcttatttctacttctacaaaacctttgtgttttccatgtgtcctttgtattttcctcatattttgtgatgtcagggagggaactcttttcctgtaccctgttaggtttagtgactggggccgatgaactaaactgacaagagacagataaggaagagaaaagacagtttttgatcaccaacatgcatgtgcatatgggagttcacaaagaaatacgactcaaagaggcagttcgaatttggagcttatacaccatcttaataggggaaggggagagagagaaaggatatttatcgaaaaacaaatgactttttcttggaaagataaataagcccttaggagaataaatgggagatatgagcgtttctctgacaatatctgtttagctgtggtgtggagacttctcaatctctgatgataagagtcagtcttccccagtttctcacaagaagaggatttatgacagttgagttcttctgagttctttgggaagctctacttttaggcagataagggattttagaaattcaaatgtcttctcaaaataattttttatgctacagagacatactctgaaccccttcagtgacatggatactgaaatattggtttgccacacaatttgagggcccagaacaaaggtagtgcgtaaagctcactaatactactggtattaccttgccagttcagtgtttacttactggaaataatttaatagtggtggaaaacaatccagaggagcccataagtggcatttgctgatggcataggtcctggaaacaccttattggaaagaaaaaaaattacaacttttctaatcagaatattaccataataaggaaaagaaattggaattgagggaatgggaaaggggagagaaagtatgaacagtatcagacaggaaatttcagagccaagaaataacaggtttgtggctggataaactgactgcttaagaaaagccaacaggggtgaaccaatgaaaatgtcacatgactagggaattgacagggctagtaaaatcagcagcaggcctgaagaaattaaaccttggcagtccaggcagagaccatgatcacagttgctatgacccattctgaattttctacctgagttgaaaatgaggtgagagtgaaaacaaaagttgatgtttacactgctggtatcctatggaatcattgtagagtttttgatgaaaaacaatgtaagttctgttgtttttattttttattttttaaaagatgagcatctctgaaaggcaagggcaacaggattacatactagataagtttgctgatataattttgcctttggccagagtaatgcaggactaaatagtggactcaaacttttgttaagagtgtgtttgaggttctgctagaggttggtaattacttgataccattgactaaacaatactcctatactatctgggaatcgatcctctttgaacaaatgggtatattcaatactattttttgcaccattgtttttaatgacaaaaaatctgtaaataatctgagcatatatcaatagagaaattattgaataaattgtattatatttatactatgcagctattaagaatgagttagatcaatacttactgaccttgagagatatctatgaagaaaaaaataccatgatgttaaaaaatattccaaaattacacctgagagactttgaaacttcttttgtttatgatttgaaccatatatgaatccatctggttgataataaaaagcaaattattaaattatagttctttcaatttagctagtagatagcacttatcttgtgtttggcacacttttctctgcctcaacatagctgaaataatcttgagaaaatagtattataatagtataataataaaattactactttttaaaagttaaaggagtaagtagatttggggtggtaaaaggtggagtaataaatgtgctaaattgtttgtttacagttaggtactttaaaaaatgtttaaattcgagacgaaaagcaaagatgttttatacttctttttgagtagtaggagaagagatagagaagcaaaagtgatcaatgtaaaaggtgtagaattgcctatatgacttcatattgatacggctcccatgaatggaggaacactagggttcttgatcctcatgccagtttagataaaatgacacggacacacatggagtggttttaaggagcggagagtttaataggcaagaaagaaggaagaagaaagaaggaagaactcccctccccccgtacagagacagagggaagggggctccaaagccgagagaggagatcccaagtgccacagataccagccagttttgtgagtaggctggaggaggtggtgtctgatttgcatagggctctggggattggtttgaccaggcatgtcattcacgtagccctcgaaaaagctggccctcccaccctagccttttaatatgcaaatacagggcaccaggatgttctacacacgtggggatatgtgggggctgtcatgttgccaggaacatgtggggcaaggacaagaaggcctggggggatcgccgtgattgagtggaccatttctaatggcttgcatttgcatatcaaaggttgctggcctggctctaagagctgctttaaaaaggaaaagtttccaaggaccacttttcctctctatctgcctaaaataatttcttaataactcctacaacaatatgtgtatagagcattgcagttttaaagacattttcacatctagctccctacgtgtcagagagctggatatatgcctgccatttcacagaaaaaaaaagcataatgtctctgagtgccggctaaattggacaattgataaaatctgtatgtggagtcagtcaagagaaaattaaggttttcttcattggagtttggaattgagatattcttcagtgtaaataaatacatgagctgcgctgtggatgaactcacagctctcctgtattttacagaggctctgagagatttggaagcagaatgaggatggagtagaagggataccatctgggttgtgatgcaagttaagaggaaagagcagaggacttggggtatagaggtcacagatgaattacagtgatgattatgatgagtctgggtacagaactcccacttctggtaaggttggactagttaattaagactagccctcctgctgaagacagctaagaaaagctgacacatatacatgaacacaaacatacacacacacacacatatttcgtattaaaatgatattctcaaaagtgccagataagttagctaaaatttaaaaaaaaaaaaatggagtggagaattactgggccagaaaccacaggaagatagattctcagggagtgaggcagggtttggggccagttttcccttgggatagctgtcatttccttagcaggtgactaagaacctaaaaggttgaatgctgcttttgatagcattataagtgtagagatacagggtttgacattcagggctctctgaggccttagtaccataggtctatatcctaggagtaagggtatacctgatacaagctttcacgaatactgtagttcaactcatgttcaatccctaagtggattgcagtgatactgaatgagcttaatcctccgataaaggcagaagcaaaggaaaatctactttggaggaggctaatagtttcttaggcctcacataatttctatgaatattttataaatacaatgtctggcaaacaaaatttagccagatgcataagagacaagatcacctaaaagaaaaccagcagaaacaacagataaggaataatcaaatacacagcttaaaatactttttactgtgctcagagacagaaattaaaattgagaaaataggcatataattggaaatatgtaaaagaatgaaaaataaagttcagaaatgaaaaacacaacaaaaaattaagaactggtggctggcaagatggccaaataggaacagctctggtctgcagctcccagtgagatcaatgcagaaagcaggtgatttctgcatttccaactgaggtacccagctcatctcattgggactgcttagacagtgggtgcagcccacagagggcaagccaaagcagggtggggtatcacctcacccaggaagcacaggggtcagaaaactccttcccctagccaagggaagccgtgaaggactgtgctgtgaggaacagtgcactctggcccagattctaaccttttcccatggacttcacaactcgcagatcaggagattccctcgggtgcctatgccaccatggacctgggtttcaagcacaaaactgggcagctatttgggcacacactgggctagctgcaggagtttttttttttttttcataccccagtggtgcctggaatgccagtgagacagaaccattcactcctctggaaagaaggctgaaggcaggcagccaagtgctctagttcaggagatcccacccctcggagcccagcaagctaagatccactggcttgaaattcgcgccaccagcacagcagtctgaagtttacctgggacactcaagcttggtgggggaggggcatctgccattactaaggcttcagtaggcagttttcccctcacagtgtaaacaaagccaccaggatgtttcaactgggcagagcccaccacagctcagcaaagccactgtagccaggctgcctctctagattccccctctctgggcagagcatctctgaaagaaaggcagcagctacagtcagaggtttatagataaaactcccatctccctgggacagagcacctgggggaaggggcagctgttgggtcagcttcagcagacttaaacattcctgcctgctggctctgaagagagcagcagatctcccagcagagcgctcaagctctgctaagggacagactgcctcctcaagtgggtcgctgacccccatgcctcctgagtgggagacacatcccagcaggggtcaacagacatctcatataggagagctccggctggcacctggtgggtgtccctctggaaagaagcttccagaggaaggatcaggcagcaatctttgctgttctgcaggctccactggtgatacccaggcaacactccagcaaactttggcagacctgcagcagaggggcctgactgttaggaggaaaactaacaaacagaaagaaatagcatcaacatcaacaaaaaggacgtccacacagaaaatccaactgaagatcaccaacatcaaagaccaaaggtagataaatccacgaagataagaaaaccagcacaaaaaggctgaaaattccaaaaaccagaaagcctcttctcctccaaaggatcacagctcctcaccagcaagagaacaaaacgggagagagaatgagtttcacaaattgacagaagtaggcttcagaaggtgggtaataacaaactcctccaagctaaaggagtatgttctagctcaatgcaatgaagctaagaaccttgaaaaatggttagaggaattgttaactagaataaccagtttagagaagaacatacatgacctaatggtgctgaaaaacacagcacaacaacttcgggaagcatacacaagtaacaatagctgaatcaatcaagcagaaaaaaggatatcagagataagatcaacttaatgaaataaagcatgaagacaagaatagagaacagagaatgaaaaggaatgaacaaagcctccaagaaatatgggactatgtgaaaagaccaaacctacatttgactggaatacctgaaagtaacagggaaaacagaaccatgttggaaaacactctgcaagatattatccaggagaacgtccccaacctagcaagacaggccaacattcaaattcaggaaatacagagaacaccacaaagatactccttgagaagagcaacctcaagacacataattctcagattcaccaaagttgaaatggaggaaaaaatgttaagggcagccagagagaaaggtcaggttaccacaaagggaagcccatcagactaacagcagatctctctgcagaaaccctacaagccagaaagagagtgggggccaatattgaacattcttaaagaaaagaattttcaacccagaatttcatatccagccaaactaagcttcataagcaaaggagaaaaaataaatcctttacagacaagcaaatgctgagagattttctcaccaccaggcctgcattacaagagctcctgaaggaagcactaaatatggtaaggaaaaatcagtaccagccattgcaaaaccaaaccaaaatgtaaagaccatcaacactatgaagaaattacatcaactaatgggcaaaataaccaactagcaacataatgacaggatcaaattcacatataacaatattaagcttaaatataaatgagacaaaagtcccaaataaaagacacagactggcaaattagataaacagtgtgcatcagtgtgctgtattcaggagacccatctcacatacatagacacacatagtctcagaataaagggatggaggaatatttaccaagaaaacagaaagcaaaaaaaaaaaaaaaaaaaaaggcaggggttgcaatcctagtctctaataaaacagactttaaaccaacaaagatcaaaaaagacaaagaagggcattacttaatggtaaagggatccatgcaacaagaagagataactatcctaaatatatatgcacccaatacaggagcacccagattcataaagcaagttcttagagacttacagagagacttagactcccacacaataatagtgggagactttaacaccccactgtcaatattagacagatcaaagagacagaaaattaaaaaggatattcaggacttgaactcagctctggaccaagtggacctaatagacatctacagaactctccaccccaaatcaacagaatatacattcttctcagcaccacattgcacttattctaaaatcaaccacaaaattgggagtaaaacactcctcagcaaatgcaaaagaacagaaatcataacaaacagtctctcagaccacagtgcaatcaaattagaactcaggattaagaaactcactcaaaaccacacaactacgtggaaactgaacaacctgctcctaagtgactactgggtaaataacgaaattaaggcagaaataaacaatttattcaaaaccaatgagaacaaagacaaattgtaccataatctctgggacacagctaaagcagtgtttagaggaaaatttatagcactaaatgcccacaggagaaagcaggaaatatttaaagtcaacattctaacatcacaattaaaagaactagagaagcaagagcaaacaaattcaaaatctagcagaagacaagaaataactaagatcagagcagaactgaaggagatagagacacgaaaaacccttcaaaaaatcaatgaatccaagagttggtttttttgaaaagatcaacaaaatagatagaccactagctagactaataaagaagaaaagagagaagaaggaaatagacacaataaaaaaatgataaagcggagataactactgatcccaaagtaatgcgtactaccatcagagaatactgtaaacacctctatgcaaataaactagaaaatctggaagaaatggataaattcctggacacatacaccctcccaagaataaaccaggaagaagtcgaatccctgaatagaacaatagcaagttctgaaattgaggcagtaattaataggctaccaaccaaaaaaagcttaggaccagacagcttcatagctgaattctaccagaggtacaaagaggagctggtaccattttttctaaaactattccaggcaatagaaaaagaggaactcctccttaactcactttatgaggccagtatcatcctgataccaaaacctggtggagacacaacaaaaaattgaaaattttaggccaatatccctgataacatcgatgtaaaaatcctcagtaaaatacaggcaaaccaaatccagcagcacatcaaatagcttatccatgacgatcatccctgggatgcaaggctggttcagcatatgcaaataaataaacataatccatcacataaacagaaccaacaacaaaaaccccatgattatcacaatagatgcagaaaaggcctttgacaaattcaataccccttcatgctaaaaactctcaataaactaggtcttgatggaatgtatctcaaaataataagagccatttatgacaaacccaccatcaatatcatactgaatgggcaaaagctggaagcattcccttagaaacctggcacaagacaaagatgccctctctcaccactcctattcaacgtagtattggaagttctggccagggaaatcagccaagagaaagaagtaaagagtattcaaacaggaagagaggatgtctaattgtctctgtttgcagatgacgtgattgtatatttaggaaaccccatcatctcagcccaaagtctctttaagctaaaaagcaacttcagcattctcaggatacaaaatcaatgtgcaaaaatcacaagcattcctatacgccaataatagagagccaaatcatgagtgaactcccattcgtaattgctacaaagagaataaaatacctaggaatacaacttccaagggatgttaaggaccttttccaggagaactacaaaccatagctcaaggaaataagagaggacacaaacaaatggaaaaagcactccatgctcatggataggaagaatcaatatagtgaaaatggccatactgctcaaagtaatttatagattcaatgccatccccatcaagctaccattgactttcttcacataattataatgaactactctaaatttcatatggaatcaaaaaagagcctgtatagccaagacagtcctaagcaaaaagaacaaagctggaggcatcacagtacctgacttcaaactatactataaggctacagtaaccaaaacagtatggtactagtaccaaaacagatatatagaccaatggaacagaacagaggcctcaaaaataacaccacacatctacaaccatctgatctttgacaaacctgacaaaaacaagcaatggggaaaggattccctatttaataaatggtgttgggaaaactgactagccatatgcacaaaactgaaactggactccttccttacatcttatacaaaaattaactcaagatggattaaagacttaaacataaaacctaaaaccataaaaaccctagaagaaaacctaggcaataccattcaggacataggcatggacaaagacttcatggctaaaacaccaaaagcaatggcaacaaaagccaaaattgacaaatgggatctaattaaactaaagcgtttctgcacagcaaaagaaactatcataagagtgaataggcaacctacaaaatgggagaaaatttttgcaatctatccatctgacaaagaggtaatatccagaatctacaaagaacttaaatttacaagaaaaaaacaaacaaccccatcaaaaagtgggtgaaggatatgaacagacacttctcaaaagaaggcatttatatggccaacaaacatatgaaaaaaagctcatcatcactggtcattagagaaatgcaaatcaaaaccacaatgtgatacaatctcataccagttagaatggtgatcattaaaaagtcaggaaacaacagatgctggagaggatgtggagaaataggaaccacttttacactgttggtgggagtgtaaattagttcaaccattgtgtaagacagcatggcgatttctcaaggatgtagaaccagaaataccatttgacccagtaatcccattactgtgtatatacccaaagttttataaatcattctactataaagacacatgcacgcatatgtttactgcaccactgttcacaatagcaaagacttggaaccaacccaaatgcccatcaacgttagactggatgaagaaaatgtggcacatatacaccatggaatactatgcagccataaaaaaggatgagttcatgtcctttgcagggacatggatgaagctggaaactatcattcccagttaactaacgcaggaacggaaaaccaaacactgtgtgttctcactcataagtgggagctgaacaatcagaacacatggacacagggaggggaacatcacacaccggggcctgtcagggggtcgggaggggtagggaaggaatagcattaggagaaatacctaatgtagatgatgggttgatgggtgcagcaaaccaccatggcatgtgtatacctatgttacaaacctgcacgttctgcacatgtatcccagaacttaaagcataataaaaaagttaaaataaaaataaataaaacataaaaataaaaaattaagaacttacggtttacagcaaattagacagagttaaggtgattaatgaatgggaagatagttcagaagaaaatatctagaattaagctgggtaagttagaaagatcaaacatacagaagatacagtaaaacgtatggtaagatgatctagcacatatgtaattggaatctcagaaacagaacaaaagagagattggaacagaacagcatctgaataaaatggctgagactatttcaaaaatagataaaagatatcaagaagccctattgattccaagcaagatatataaaatggaattattacctaggcacatcacagtaaaactactgaacactcaaaataacaatcttgaaaaatgttaaaagcagctagaataaaaatatcaattactttcgaagaagcaacaaatgcaatgaccactgacttctcaatagaaacatcacaaacccaataccttggaatgacatctttaaaatgttgaaagaaaacatgcaccaccctagaattctacactaagtgataattttcttcagtagtaaagatgacacaaacacgttgttttagttatttgttgttgcataacaatattacacaaacatagcagcttaaaataatgcatatttattatttcacagttcatgtgggttgagagactgggcataggttagctgagccctctgcaaagctgcaatcaaggtgttgtccagaacttggttttcatttgaggctctaccagggaagactttgtttccaaactcacgtggttgtttgcagcattcatttcttttcaggctgtcagactaagggcctcagcttcttgctggctttcagctggaggctggaggttttaaacccacgtatgataagaggaaggctaaaaatcaataagctaagcattcatataaataaattaggaaaaggaagccaaattaaaatcagaggaagtagaggaaaataaaaaagcatcaataaggatacttattgacactttttattactttaaatcaatggataaaatttttaaaagtcataaaatatcactgtgcatcctagacataaaaatatattaagaagctatcatatacaactttatgccaataaacttgaaaaatttagatgaactagagaaatttatagaaaaatacaagtttataagcctgacacaagaagaaatagacgacctgaagaatagaaaaacatttgcaaatgaaatttataagcttttctacatgtaagggagaaaatctgtatttttacctcataggttcttagttgagacactcccctgaaaataaaagtcagattaacaagagaaaaaccagtagaagtttattgacaaatgctatacacatcacacaggagaggcctcagttcaaaagcacttttctttcaagacagtggcctagtggttttacttagatagtattttaaccaagagccataaattctacagtgaaaagacaaaaaggagagcatcttcaggcttccaaaaggtgggaaaatgtgagaagttaagtttgtgggaagagtaaaatctgcttctagatcctcaggcaccactgtctctgagctgataagcaagcattgtaaaggggcctatctttaggtaggaaaaggcagagggaagaaaaaccttgtctatggaaattgtcctgccatcaggcaagcagagggaggagcagagtgtcctcctgctatttaatattcttcagctcaataattcccagtattttaaacagcaatattttggttttctttatacacagaaaattcccaaacgacttcactagtacattttaccaaacatttaatgaaaatagaatggcaatctgttaaaaacgatgtgacacatgaagaaaaggagaacattccccaactcattttgtaggccagcataatcagggatactaaaaatctaagtaggatataacaagagacatttcaggtcaatattactcaagaacatgcatgaaaaatcccaaataatataatagctattcaaaactagcaatatgttaaaaatatgatagatctgaaccaagttgagtttactccagaaaggcaaggttggtttaacaatacaaagttgagcaatgtaattcatcacaacataattaagggcaaaaatgatgtgttcatctctatagatgctgaaaaaattgataaaattccatatccatttataggggtaaaaagctcctctaaacaaactagtaataaaagaactttcttaaactgataaaattatccacagaaaaaaagctacaacaaaaatcatactaaattatgaattgctagaagcttttcctttatgactgagaacaagacaagtttgcctgttatcacctcttctattcattgttgtactggaggaccttaacagagaaataaggtaagatagaaacttggaacggatatggaggagaatgaaaataactgaactctacaaatttgcttggccctgctttattttgggaagggtgtggctaggactattttgttctaagttttgtatatctttttttttttttaaacatttcttatatttggttctatgcaagtgaaatggcatattggggaaaaaatataaaacgatggttactggccatttgaattgacttctgaaggaaggagacattttgaatcagccttgctctagtcaatggggctttctgaggcttagtgaaaatttgtacttgtgccctattcaggccaaggttgctggaatatcttattttgattttactatggctgacaaaaggcagagtacagaaagagtattactttggaagatattttatctggggctatttttttagaacaaaatcaacggggtgctgatatgtgtttggatactggagcactgactgatcagtattgtgattcacctactcttaaagaaaatgacatacatctagctattgcacatgcagaaaaatgtctaagcctgatgctaatggatgagtaagcttagcttcaacaattggaatgaaaataaaacaatttattttaagacttgctattactagacaagttcaaacaacaaggatgatcataatagaattaataaagatctttgcatggtagactgacaggccatgcagatatgaaggaagcaatagatgtaacctacatagacatcaatggagctttgattatattaaaatgatattctcctccaaaagagatgaagatttctctgctattcttagatatctattgggagggtgataggaaggaaaaggtaattgagggagtcactgggtaggtgaaaagtatactcggcatgaatatacttgggagtggggtcataggttcttaagtgaatttaggatgtttccatagatggcgttagccttgtttgctttttagtctgactcaagtggttacaattaaacacggtgagtgttttccactgatttggctgctattgggctgcatatatgcaatgtcaaaacaacagaatactttggaaactttgccaacgtgggtgattgactcacacaagcagttacaaagaaatgtttaagggtcttccatatactgaagagctgatgtttaaattcatcttacttctcacaaacacataaagtgtgataaagcttgttgctcctgggtaggcaatgaaagatcagcagcacaccactgaaaagatgtgagtgtagccatatgttgagcatccctagcaattatggaatgctttaaaatggataggtattcacattttgaagctataagtttcagatatttatcttctttgatgcagccgtctgaaccaaatcttgagatttggtttttcctttttctttctttttgagacagggttttgctctgtcaccaggctggagtgcagtggcacaatctcagctcactacagccttgatctgccaggctcaagcaatcctcgcacattagcctcctgagtagctgggaccacaggcaagtgccactacacctggctatttttttttttttttttttttttggtagagacggggtttcgccctgttgctcaggctgatcttgaactctggtctcaaactctggtctcaagcaatcctcccacctcagcctcccaaagtgctgggattgcaggtgtaaggcaccatacccagccaaaatttggttttccgatgtgatttcaggattctagattgggtgctgtttctcctacactttccttccctcaatctccatgttaggttgttcagagtatgcactgtacagggtcaacacatctgaggaggcaccattcacattggggacacatacagaactaacttacctgggagcgctgcaggtgagtgtagacattccaggcctcttggctgagtcctgaagcagcaagagagcgccctctactccataaactttcactctctcaactggtcatgcacacctcagcagggcctgcactatcacatttacttggagatgaacatgtgcacatggctacgctttcttctggctgtactctgagtatctggattccaacatttcctcttacactgaacttctcatggtcacctcatctggggttggagtatgtgcgctccttacgttttatgtgctgggcaggaggtaagttcacaggaatgtatggttttgtgtgtgtgtgtgtgtgtgtgtgtgtgtgtgtgtgtgtgtgtgtgtgtacacaagcagctgccaccctcaggccctgggacgatcttcgtactcaagtggagtacattcaaataggctttatccaatccctaaaggtagtgttcccctgattccttttctctctctcctgcccttctctatttttttacacactggctacctctatggtcactgtgctaggctgaaaaaaatgacatctcttccgagatatagccacttcctaagccccagaacctgtaaatattttcttacatagtaaaaagtgaatattaccttatatggcaaagtatgtgattaagttaaagatattgacacgcagtgcttttcttgaattttctcggtggggcctaaatgcaatcacatgtgtaagagagaggcagagggagtttagagacaaatacagtcacctaatctggccagaggggtcaacagctggttgctgtgtatgattgttgggattacacatgaatatatatattagctttctattgctgcataacaaattgccacaaacttagtaacttacaacaacaaatatttattgtctcacggtttctgtgtgtcaggactctggccgtggcttagttaggtcctctgccaggctgcaatccaggtgtcagccagagctgagttctcatctagaggctcaactggcaatggatctgctaccaagctcttgtggtcgttggcagaattcatttccttgtgtttgtaagactgaggactctggcttcttcctggttattggctggaggccgccctcagctcctagaggcttccatagctccttgccacatagccctttccataggtccactcaacatggcggcttacctctccaaagccagcaaggaagaaagatagcaagttagctagtaagatggagttatataatgtaatgtgattataggagtgacatcccatcgcctttgccatattctgttggttacaaggaagtcacaggccccaccacactcaaagagagggaaccatacaaaggtatgaactccaggggttggggatcataaggccaccttaaagcctgtctactacaatacattcatttaagaaattatatggaaagatgttggtcaaagggtacaaagtttttgcaggataaataagttctggagagctaatatacagtctggtgacttaaattaacaatactgtattgtatacgtagaagttgctaagagggtagatcttgagtgttctcaccacacacacacacacacacacacacacacacacacacaaaagaaagaaaacggtaactatgtaagatgatgaacatgttaattagcttgattgtgattatttcacaatgtgtatgtatatcaaaacatcaaattgtacacctcaaatatatacaatttttatttgtcaattatacctcaataaagctgaaaataaattattaaagaatgagaaccttttcctaattcacacgaaagtatcacattggttagtagcagctttttgtccaccccagcactctttatttttttctgacaaaagtagtgctaaaatgataaatcaagggacagacatgtagttattagctgatggaaagtgataaaattggagaggatgtaatcatggtgtagttttacaagcgttctttccattttgataacttttattagaatgtgcctggttttggaaaacagaaatcttaataaataaaccaccacaacttaaaatatctcctattggctcaaattcttcttttttatcagacaaattatctcccaaacaggtcctataaatatgcatttattacaaagttgtgtgttcgtcttagtgaatttagaaagtaggggttgctcgttagtgttgatctagtttctctgggttcctgtaactagaaggtatgatgagctatagtgtgttgagtgaaaaatatttgaaaatattttcttcttctttgaaatcttgtccattctcattggcccaagcaggttttaggcctgagtcaccacttacctggactgttgccaaagactccagacttctcttattctagtctatgcctctctgatttgtgtttctcctcagcttacatactttgtatagtgcttcattcccctcaccttaaattctgagtccttttgactgttctcaaaggccccacatggtccccctacaggccagttccttcaggctcttcctatcagagtgaaggaaaaaaacatgctcttatatgccataggtctttgcacattgtttcttctacctgaaataccttcttccctttcttcaacttgtaaactccaactcatttctttagtgctttgttttatgtaattattaacttacattatgaaacctttcaaacataaacaaaatagaataacataataaacaaacatatccctaccatctgttttaaaaatattggtatcttgccatatttacctcagatgtatatttctccaacttctatagtaaacattttctaacatacagaaagttgaaagaatggtactataaacactcatatacctggcactgagttttgacaattgctaatattttgcttattcattctccttctctcatttcatttattttatttattactacctcctccaacaccacatacacgtggaacatttaaaactaagttaggtcattgcaggcatcatcacttcaccccaaaatatttccacatacctctcctaagagtaaggtgttctcctacgtaatgttcacatcattgctgcacctacaaaaattaacaagcattcccttacttcatgtaatactctgtcaatataaatttttccccaaagtatctttttataactattttttctatgcaacatccattcaaatttcactcattatgtttggttttgtttctttaaactatttcattctagaacggtcatacctacaattttttcttatgatactgactttttgaagtcatcaggacaattgactaagtggcataatgcataatctggacttctcagaatctttccccatgttttcatttaacatttactttagaacatatgtctcctgataactgaacattttcctctttcccatgactcttttacctaatggttttagcataccttgacgcctgaatcaatgatataattagtgattctaagatgatggtaattttctaattctttcaattattctacatttattagttgccattcagctaaaaagaagagcatttatcactgatcaactgggagtgaactccagtttttcctctagggtgattacttcattcttttcctttaattagcaatttttaaagtaagtcatctcaattgatggcagatgagtggggttttccttcttttctttcttttgaggattattgtgggctatcttagtgtgggtttccccagaaacagacccagagacagaactcaagcgaaggtagttatttagaaagtgattccaaagacactggtagaggagtagggaaatgagacagggaagagatggaagataatcagggagtgttacttagtggctcaccactgcaattaactagagcttaatcctgatgcagaaaagagccacgtaacacatgtgccacagagctgtctcatttgagaggtatttattcaccaatttctgtcagtcattctttgaagactgctcctaggagcattaattagttggtattatcaactggccatgtgggcaggcaaaagggctccaatatccagagaaagccctccagcaaagaaacacaagtgctggcaggtactggcactcagaagtctactgattaaggggtatgagcaaggcaccaacagttaaggtcagctacactgattcatgagtttttatttattaagggtgttaccatcacttattaaaatctcccaaatttggccagtgggaaccttttcaagcctactggccttggattcttttggtacactttgattagctttgggcactttctaactttctgacacatgatgaaccagactcacttcatacttcctctgtcccagacctggaattaaccatttctccaagaaattctgattcatattatgaaggaaactaggatctgagagctaaaaatactcactgttactgagtgtgggattgcttcttggccctttgtgtgacctagtttcacaagttcacattgacattctcaattcaaatttatacagaattctttatttttaacttttcttttctcttacactgaatatactgtttctagtaacactattatttaaaaattagtataccaatattactactgagtaaatattattataatttctttgcaattctttttgttcttaccatatcctaataagtatatacagagtactgtgctctacaattacctgaaataattttctctgtctttcttttgtgctttctttttaaacattttgatacagttatgatgatttcttgtcattttagaggtttcttttatttttgaatatagtaaaacatttacacagtgcatatatcaaaacacatataagaaaatactcagaaaaatctgcctttttagtttcctggtctgcctttcctgtgcttgtttttgcatatgtatttatatttcccgtactttcttaccaagatggtagactagtgtatatactgttatgtactttgccttttccttttaacagtatatcctggaattgagtttacttcaattcatagagatcttcctcatcaccttttaaagttgcatagcactccattttgtggcagtaacacagctcataccactgctgttgaatgacatttgggttgcttccaaatctttgctttctcaaataaagttgtaatggataatattgtgtgtgtgtgtgtgtgtgtgtgtgtgtgtgtgtatgcatttataaatgtgcaactttagagtagattctctgacattcatagcctcatcagtagtttgttgttattaatgcacttgtttattcccattgtactcatattatttacactgttgcacttttccttctaaagccatttgcctccaagtttccttttgtctaattgctttggctaatacctccaatacaatattaagagtaggggacatagtgagatccttgcactgtttctaactataatgtgagtggcctgcactgattccctattaagtaagatgctggctttattcaatcttattttatcacgacaaaggaccaatgcctattttattaagtgttttaaaagaatggacttcgactattaccagatgccttatttttaacatgtatggatatgtaattttaaagatatattaatataaagcattacattaatagattttttaaaatattgcaactttcttacattcttggaataaaccctttttgttcatgatatgtgaggagttctgtggacccgctccccagttaaactgctataaattataaaaaacaaacaagcgtttaaagtctctgggaacagccctaagggcaaaatgaaaatgaagaaacatttattcaagatgatttagtaaatcagttactaaaactcaagaagaactctaagagtctgtagtatttgtaccctccctcccttctctccgttcggtaactcagaaactccactcaatactggtatagccaagaatacagggctcctttttctcccagctcccaattgagggcttacttactggaagaggcacaaaatcaccatttctcatcctgccctcagctgtctgtttctgaatctaagctctgggcaagtacaggtgagagggaggggctcccttcttctgcccagccctcacgtatggaatggagtctctctaccttgggtgtgttgccactgagaatactagggccccattcatctttaacccagctcaaggcacatgagttccatgctgcaacaggcaagcagagaagacctggtttcatctaggtttctgaacataattataacgactacttgtagtctttaatctgtcaaatctgacatttggtcactcacaatttctgctgcttgatgtttgtttgtttggtcagttggttggtttgcagtatacgggttttaccttcttgtctttttgcatgtcttgtaatttttttgttgaaatcaaaaaatttagataatatattgtagcaactctgggaagtagttactccttttcagggctcattatttgcttgtttacttgtttaattaccagcaaaattatttcagtgaaatctatttacctctgcagtgtgaatcccctgatgctgcttttcatggagtgcagacttagatgtacccacagtcatgctgggatgacaatggttttggcagggctctcttactgtctctttccctgaccccatccagcagttgagcttcactaattgctgcctgattgctgtatatttcaaacaatgacttaggatagaaattgcttccccataaatccagtgaaatctgggctcctttgaaaggatagttcccaaagatactatttgaaattagttattacttcagaagggctcttcaactttgtctttccctatttctctctggaaaactagccagcctacaatttagcttgttgttccacctatcagactcctcttgagtctgggttgcctctgtgactttctttgatcaacaggatgccatggaagtgatataagaaatatgagatcaccgtactgtgagcaagcccaggttatccatgtggagatagagagttcacataaaggagcatcaaggcaccacataattgagttaatatttcttggacattccagccagctcagtcaccaattaaatgcagctgagtgtattatcctagccaccacataaaacagaaaacattccagctgatccctgcctgaattcttgacccacagaatcatgagaaataacaaattgttgttttcagactcagtgtaccttgtcagaaatggaaaactgaaatgcccatactgttataaagaaaatccttgtaactttttctaaaagttctaaagttttacattttgcattgaagtcattattcaggtgtatggagtcacctggagcttaatgagctgcatccaggtatcacagacaatggccaagaacaaatcaagagaacagggctggctgagtgcagtggctcacacctgtaatcccagcactttgggaggccaaggcaggaggatcacttgagcccaggagtttgagaccagccatctctgcaaaaaagtgagaccccctgtctctgcaaaaaaaaaaaaaaattaatttttaaattagccaagtgtggtggcatgggcctgtggttccagctacttgagaggctgaggtggcaggatcacttgagccaggaggtgggaggttgaggctgcaatgagccttgatgttgccactgcactccagcctttgtgacagaaggaggatttgtctcaggaaaaaaaaaaaaaaagagggcggaagtccagaaatgtattttacatagccagccaagggaaaaaaaaaaaaaaaaacctttaaggctaaaaacaaagcaaaaccagttactactaatattaagaggataaatattatgaatgatgaaaaagttaacaaagtgaataaagcttttgtaagtatacaaaaggagcttgcatgcttctcaaagggcctttcttttgaatctctgcagaatgaactgattcctcagcaggtcatgaaagaaaaccagctaatattgatgaagctacagaattaatggctcacttgtaatacagtagtgatgcatctaattcccccaaaagaccaataaataaatgttttatacaacaaaagtctttcttcaacctagaatgcattcacatattatgagggttagaaatctgaggttgttttattataccatttgttgtataatccacattttcccccactgatttgtaagatcacatctgtcataagcaagtggagcaaattgtccagaaataaacttatgcgtatatggaaagaccatatttatctagccatatgctagtaccatgcagtattaactactataattttacaatggttataatatttgatatggcaaacaatgctgcccctgtatccagttattcataatttttttactattgtcatatgactcttgggattagtttgtcaaggtttatgtaaaatcctgtttggattttaatcgaaattgcggtgaaattattctctagagatgtcttgtacatatttgctaagcttatttctagatacctaatgactattgttccttgtaaatggagtgttttttcaatagcatttaaaaattagttaataatatataggaatgctgttgatgtttgtatgttaatgatatattgaacaagcttgccaaatcttaaatccaattattttattcaaaattctcttttattttctatgtaaacagcaatagatagaaaggataaagtttataagtaaaaaacaaaaaaaaaaagaaatgagaatagatacgctaaaatatgaaatggtgttactttgtgttttaacttgcgttttcttgcttattaatgaagatgaacgtctcttcatttgtttgttggtcatttgggtttcttattaattcttcctttcctgggaattcctattcctacttcctagtctgcccattcaggaatcctattcctgttctgacctgaatagaattcaacacagaattattttatttaaaaaaatctgtactgttatgtaggattttgcatacttaatattgcatttatgtacattttccgcttgtaattatctcagaatatggctttatttggagataggggctttattgtttcttgaaacaaccttcttttcagtgtgttgatctgctctattttttttgttttctatttcactacatttctctcatatttattatttttttctcttcatactttaggtttaattatattttttctaacttctccattgaatgcttacctttagtttgaatccatttaatattttaaacaatgaatttaagctactgattttctctaactgccattttagctgtagctcccaaattttgatgtaattcttttgttaaagtttactttctaaacatttaaaaatttctcttgtggtttctctttaacctgaaattcttagcccttgagtttcgaaagtatacacacttaaaagattcttcaattatattttatttttaaccctgaaaaaaatcccatcattttattacatatgatccacaggtccagctaatagaatataattggaaattaagtgaattaggttttgtttattagaattcttagtggctgcaggcagaatacttctatttgcttcagtcttcctactgatttaactgggacaataataaaatataacctttttttctagcaataacctcaaacaatcaaatctttctggcaatcagactgactgtcagtgtgcaaaagcaataatatactgcccataactttacaaggtaattatctgtgttagcatcctaaaatgttttaagctttggtgggaattgcgtctaactttgaggagaataatccccaaaagactcgaggtagagccaaccgactattttaggacgaactgtgaagctatgcaaagaaatagaactacttttgatttttaagtttttttttaatttaattgcattgtggtcataaaatatgatatataagatatcaattcctcatactttttgagattatttttgtgacacagtgtttggtcaacttttgtaattgtttcaagtgtacttaaactatggtctctgttgggttcatgccattctctttctgtatataaatatatgtatgtaagtatatatatatgtatatatacatatatatatacttacaaaccgtttttcaagtctcaaacctatgctcttactttagttgcttgatctatcaatttatgatagaattatgtttaatattcatctaatactgggcttaacaatttttccttgtaacacatcttgctttatgtgttttgaggctatattatttggtgcacttaaatttatgatttataatactgatggttatatttttttacactgactctttgttttaatgtaacattcctacttatccttaataatgcttttcacttaaatctgttttgtttaatgttaatgtgactataccagttttcttttgtttaatgtcttcctggtatagttttcccatctttttattttaaaactttctctatggttttgtttgagaagtcttttttatatgaagtatatagatggaggttttttttagtattcactatctttttgcataaaaaggaagttagtacgtggattgatacatttttctctatatttctattctttacttattttgacagtagatgcttttaatttttttttactagttatccttaacactttgacatatatatttatgtctttttttaatactgtacagaatcatttcctaattttggtcttttccctaacttactaaagactttatcatgcttttactacccgtaaaatagcacccatcttattattgatggctagagatttagttttaccatttgtaagaaaaatattttttacgaaaaataatgaattatactttatgttttcttgttattttttaacctactctttcctccagtatttattttttcttcctaaagaacatcctataatatctcttttagtaaggatctatgagtggtaaaccttcttaatatttgtatatctgaaaattttgttattctctccatctaccttaactaataaataatacttaatctgggtataaaattataggttgatagtttatttttagcaccacaaagatatgatcttacattgatttctagcatttattgctgatatgaattctgctgacagtctaattattattctttagtaggcaatcttccctttttgcatgataactcttttatagcattttttcttccatatttttattcaccacatttattatgtacttgagtaaggatttatatttatttattcaacatgtttcttggaaagcacttttgattttaggcttcttctcttccttcaactttaaagttattctgttctctctataggtctcagtacagcctcaaactcaccaaagatctcactgcttcccaatcaccaaatcccttccaataggtcttggagctcatagcctatcatcagtaatgtccattatatccacagactcttctctgtatttctcttttctatatctacttaatcttggttcattctgctttgtaattaaacactttgtctctgtatattttccaatctgctcactcctcccttccacttgggtcccagacccccagtgcagaatcagctcagtgctttctgccctggtgatgttggtgatgtggcaaatacattctctatgctaactgtcagcttggcctagttcctacatctgcctcttctctctttgctagcttgaagctgtctgtcattaactacaggcacagctgtgtttttcagcctctttctaggagttggggaggtatatcccagcctgttgcttcagttgataggccaggctctgtttcctcactttatatgaggtgtttttagtccctttaccctatagaaggtaaactgccagtcaccaaaggctgctgtagtctcagagcccagcaagcctaccaggcccatggcctcagtacttcaccattatgtgtttctgttccatttcagatctaatatgtatttggtttgcaagcctgcttatgactatttttggttgttatagtttgtcagtcatgcaatatattggagcagatgcaatgccttacaatatgggcttgcttccacattgtgtcgagaggttcactgttcattcttaaaatcccaacttagacaatacctcttgcagaatgccaccgttggtcacccacagcccattctacccccaaccaaagttgataattttctcctttttgttttgtctgcacatggttcatcgctacacccataacactgtaagatatgctgtatttggtattttcttccacttgtagtgaatctcccctccccacaaatgatggagtcctgatatgttgagtaatcctcaagtttcagaatccagctcattagaatttgctatgttgattacagtatgctttcagcatttagatcactgtggcagacattgttggtgctaaaatcttctcagatcccttttatcctttttagatccccctcttttggccttggtatgctttagctttgaaaacctaacacctgacattcttctttggaggcttgcccttgggctactggaggctctgcctgcatgtctgggagctgggagtgcttgcgtgtacaagttagcccatggctgccctcaatcaatgactaataagtatgggagtataaaagctcagctcacttacttttggcagcagtgactctgaggcataactcagactatagagttagtttccttgcaggataaggcagaagctaccctctataggattttgcttgtaattgtacccttgcttggtttcttcccctttcccaacctatttcttccactcccttagtgttttttcctgggaaaaatatccttaataaattgcttgcatatgacttctgattttatggtccacttttaaggatcttgacttaatataccaacagttaagaaagcccaagatctagaggtagagagaagtaaatactctcaccactgatgcacccagatgtcttcaccccagagcatttcctcttgtatgtatctatggtttttcttctttgttctttatctatctgtcttacctgttaattgctctgtccctcctttgagtggagggtctatttgtcttttcctccctttcttttaaaatttccttcctcttctcactttgcctgaggctaatgattactcctagtccccaggaacatatgtctcaactattccccttgttcatattaattggaagcctcatatactaacaaacttgtggtgcaattttgagctgaaagatagaaggaaccatggggtccccttttaatataggggttctgggtgtccctggattactgggcattttaagactatgtgttgtaatatatttttggtatgttttccccatgtgctagacttgaagggcacagattaacttctttatttttgcatccaaagctcctagaaaaagagcctagggaagtggttttcaaatcatctgcagatggggagatggggaatttagtgtgctgggccccaccccagatacactgaaagcagaatctctaagggataaggcctataatactacttcttaaataaaatcaccagggaattcttacacggtttgaaaattcctggcctaaaacttagatccctcaaaaaacatttattgaattaaatgggcctgcttacttaaatgacaaatataagaaataaagcatattacagacattagattactgcagatttgataacactttttaaattataaaagaattctggaagcattctatccccctgactgatggaagttcaaataggtaacttctaaaacacaaatcaacttgaaacaaaattatgaaaagaggcactaggcaattacctatagatagatgctgcagctaaaagtttgggtcagcaatcattaggtaatactcttttcctcagataactagtccttggttttggttgtgaaaaaacacctgtaatggcagaaattagttggactttcatatctgttgatgttagagaaatttagtcgcagcagataccagcttgaactcaccaaaattgataagctatctctgacgtttttactgcagggtgcagtgacagcctgtttccatggaaacagacaccagcttgctgaaaacagaggaaggaactttagcattaattactgtttcaatttgaattcaattgatttcagagtaaatctagagacaacttggcagtattattgtgagagtgctgtaggcatgccccacactatattaaaatagtttaacaaatataacaaagtgttgtggcttataagagaattaaagctcaactgttgaagtaagcagaagaaaagtatacaccaaagtctcaaaagtcagtagtttttaattcctttttttttttttttaaattcagaggatacatgtgcaggtttgttatatgggtatattgtgtgatgctgaggtttgggcttctaatgatcccgctgccaatgtagtgaagagagtacctgataggtagttttccaaccgttgttaccctcccttcctcctcgcttttggaagccccagtgtttatcggaacccccagtgtttattattttcatctttgtgtccatgtgtacccaatatttagctcctacttgtaaatgagaagacgtggtatttggttttctgtttctgtgttaatttgcttaggataatgacctccagctgtatccatgtcactgcaaaggacatgctttcattcttttttatgactatgtagtatttcatggtgtatatgtaccacactttctttatgcaattcaccattgatgggcacctgggttgattccatgtctttgttattgtgaatggtgttttgataaacatacaagggcatgtctttttggtagattgatgggatgggattgctggatccaatggtaattctatttttagttctttgaggaatcttcaaactgctttccacagtggatgaactaatttgcattcctaccaacagtgtataagtgttcccttttctctgcaacttccccagcatctgttattttctgactttttaataatcacccattctaactggtatgtggtatctcattgtggttttgatttgcacctctctgatgattagtgatgttggacgtttttcatagtttattggccaaaaaactcactttttgaactgtgtagatgaaagattgacttgcttttaattaatctaattcccttcaaaaaagccacatcattataggattgctcttgatgtcccttccaccaacaccgaggaagaaaatgcaaaaagaagtaaatttttaaaaagtctaattttggagtactctatgtttggctctatgaggtttgaggatgagaatgctgggttccttaaattatttatcctattggccattggattgcttagcctcatttcctggcttccttggggtgcatgtgtgtgtgtgtgtgtgtgtgtatacactaaaatcttaggaagcttttgtcaattttggtgcactcaagcttggactggttaggactgaatttctctccaacaccgacagatatgagagtctgactaatttttagaatagtttcagtatatatttatatgtatatgtacacacacatatatatacacatgcagtatatacacatagacatacacatatatatacacacacacacatatatatacatacatatatacacacacacacacacacacattcaagagtttctattttgaaagtccttggaaggagttatacagtagaacattatttgccctggaaagtaataggttgggtttagtagttagttagaagttggcacagaactagaagtgaatacaacaaataattggtgagaagtcaggatgaggagtccaaaggacagaaaaacaccaacaaatcttgacaaaagtgaattttgtctattgaactatttcattgagactgtaaaattatatataatgtatatataatatttaaatgtaaatatataattagtatatattattaatatataaatatttattaaggtataataaatgtgtattacatattaaatatatactatgtatttatatataaatatgtaatatataatatatatttaagtatattatttaaaaccctagataagcaagatggagagcataatgactatcaagaagggcttcaagaaagtcacatttctctctagagaagtgtgtgcatttcttggtcacagttttaaagcagaagatcttaacaaagtcaaaagccaaatgttgcaagatagtatttaagaatggggattctagagtaggatataaccaaaagtagaaggaagttgttagggcctcacctagatttcctctgttccatttaccgaatctctgagcccagctcccagcttctgtgtgctatcagtagctattaataacatctgtgacctttctggtactatcttttcggttattggagctgtttcctttgcatagacagccagagcctggaagttcacaggccatgcctatatcttactgttgtaggaccacaaaagcctggatctttttttcttggagtgggacaaactttgagatgcaactaacacttcagagttcacagtaggatcagggtgaggcagggactttgcgtgaaatcttactcttgtttggcttctaccccttcttggcatatgtggtagccagcctccaaaatgacctccgacgacccttgttttctggttttcatgcctttgtagagtccccttccacaataaatagggcttacctgggtgaccaataggatattgtgaaaatgatatgtgtgacttccaaggctagatcataaaattcactgtggcttctaccttgctctgtattggtctgtcctccctgggggaagccatttgccttgtgaagcagacactcaagtagtcctatgaagaggttcatgtggcaaggaactgagccctctctccaatagccagtacaagtttgccatttacatgagggagccatcttggaagtggatcctccagcctcagtcaatccttcagatgactgcagccccagctgacaatgtgactacaacctcataagagaccctaagccagaaccacccagctaagctactccagatttctgacccacagaaaaatatgagaagataactatttgttgttattttaagtcactaggttttgaggtactttttagtgtagcaatgagaaaagtgataaatattctgtcccccacttcctttgttggtttcttctggtaccacatgcttaatgaataacttgcacctgaattttatctcaggctctgctactggtgagtttgacttaggacatttggattgaaatctgaactctgccatctctaagctgtgtgaccttgggcaaatcactaatctgtttattgtgcctcagtgaaatgtgaataatgatagtactgacctcttagagttgtgcgaagattaaaggggcaatgctcataaagttcatagcattgtggcaagcacattgctggagctcaaaaaatgttagtaatcactatgagggtagcagtacagggtggcagttgttagccttaagatctaaaccaagtggaatttttcttctagcctctgtggcccctgttatccaccatgctggcttttgaccataaggaagtatgaacaggaggctgtggatgcctcagcccaatttggtaaaaaacaaaacaaaaaaacacaaaacataaaaataattcaaggcacatgtgtttcttctccttgcggtaggtcaatagtgtcatctttataaatgaaactcaaaccattgcattattgtgataaaatctgccattttaccttaagtaaacaaaccttgctgcctgatccgtcactgttcctaccacaaaggaggtgtaaagctgaagcagttatttcaacagctaagtgacaatatttttctgctggaaacaacagaccagacagtgccatcctcccatagctttttacattcaggaaacagtgttataaggcaatgccccaattaagaatctttttaaaagagattcttttattctagtaaggctggtttaaaaaaaatcttcatgtaatattaacatatgcgtatgaatagatattggacaattgtaatagactggagaaaagatgatcatgttctgacaatgaggatataatgaagaaaaatcagaattctgcaagctgaacaggcagtggaagatgaggggattctggacatcggactccagttaagtagcaacaagagagaattctgccttaatgaggaatataagggaagaatctcaaccataaagctgccagatgaaatggcttaatgcacagagacccttagaagctttctcagtgccatttcttcctctacgatggctgagaaaaacaccttcagcagccccaataaattcttggagaatgttttctcctgaattttgttttagcatctatagtctaatcatcagctacaaagacttgttgattttttttttttttttgagacagagtctcgctgtgtcacccaggctggagtgcagtgtcgggaacttggcttactgcaaatttcgcctcccaggttcaagtgattctcctgcctcagcctcccaagtagctggtattgcaggtgtgcaccaccatgcctggctaattttttgtattttttagtagagatggggtttccccatgttgcccaggctggtctcgaactcctgagctcaggtgatctgtccaccttggcctcccaaagtgctaggattacaggcgtgagccaccacacccagcccccagaaacagttttgacactcaacactttgtgagtccattgcagtttgtcctatttccaggattctctgaggaatactccctaaaacaggcatggctagttatgttgcttattcagagcctttcttgagattcctgtggaatttgtgattaagccaacccatgaaactggcatctgataccaagagaaatgttccttttggctcagtaatagttctgcttcaatgcatgtgggctgagcctgccaatagtcatggaaatggtgcactgaggtttaaaaaagggacgtttgattgagaacaaaagtcacagagaacttttctgaaggtctttggtcagcacgagaattattctttaatggcacagggagaggggaatcttaagcagctctgaccttttatcaatcgtgaagaattggccatcattgtgtacatcattgaatttcaaagcatttaagctcttgcttatccagtactccccctagcagtctgcacgaagtgggttaactgggcactcacacactgttggtaggaggacaaatggctacagccttttagtaggcaatttaggaacgtgcatcaaaattcaaaatgcatggtatcagtcaaggtcctggcatgaaacagatggcactttcaaactgggtaattgagggcatgcgataaagggcttagggaagccaacaagggatggttggccagagcagcaaaccattactaccctaggtctgaggggtgagagtaaggagtggttagcagaacttggaactgtatggaagggtcagcttgccaggagctgtggcctttgacaaaatgatacagccaatctactccgatagcagggagggtattgagagaaacaaataacccagagtcactctcttcctttcttccaatctcttccctgtacctcccactagcaaaatccaaacagaagccagaggcaagggagcctatagttatagtccatatgggtcagtcttcttgggcaagaaagagggtgctaaagggtacgagtgggtctgcagtgacaggcagaaactatctggcatatgcatataccttttgattctgcaatcctatttttacaatccatcctgtagacatgttccttcaggctttcaaagatcatcagtatagaatgtatttgtaatagagaaaaactggaaagaacctaaatttccagtaataaaaaaaaaaaaggttaggctgagggtagtggctcatgcctgtaatcccagtgctttgggaggcccaggcaggaggatgccttgagcccaggagtctgagaccagtctgaaaaacatagtgaggccctgtctctaagaaaaataattttaaaaaattagccaggcatggtgacatttggctgtaggaggcaggaggactgcttgagcctagaaattcaaggctgcagtgagctaagatcctgcattccagtctgggtgacagagtgagacacagtctctaaataaataaataggaaaaaaggaaaaacattaaataaagacacatccatattatagaataccatgcagctattaggaagaataagatagactctctatgtgctaatatggaaatgtgtccaagatgcagagtcatgtcagaagatgcaaaaacagtaaacaaaaaagaaacacaaaacacaagtggcagatcagtatctagagtgtgatcctatttttgttagggaaacaacaacaaaaaaaatcataaacaatgacatgtgcatttaaatacttatactcaaacctgattggggatgagcaggtaaaaaggaacttttagtatttttcctagatgcatttttattgcttgaagtgcttatcagaacacatttgtatattacttgtgtaattagataaatctaagaaataagaaagtgcaactgtaaaacttggggtaggtaaaatggttaactcctgatgggcagaaatgaatcccctcctcaattcctttccttccttgtcgctctgcttctagtctgttttgtgggcattgatggcctttgatgttcagtctcagtcctgccacttgacaagacaatgcttggcaaacctagggaattaggcttcatgtttaattctccttcagcctgttgggcgtaggatgtgcttcctgagctgtttgctttcacttttcgatcttgctgtgttagttcctaaactcaaccatgttgtactaagacttaagcaaaatgtaggaaatgcacagtgacccatgcctgtagatcatgtgtagctggaatctttgaacttcctatctgagtctcacaccttctctattgcacattgtcctgttgcttcatctctgtcctactttctgattgctcaagtcctcccatttggtatccacaatgtttgagtatgctagcttgcccttgtaacttattattgttgtttcattctgtcatttttttttttggttgtacttctactagccttcccctttggctagatgaaggagccattgctatgccctgccttatctgacagccctgccgggcatggccccatttcttccctacactctgactctgacctaaaaagcccatgtctagagaagctcctgccttggtttccaaatgcactaaggtttcttcatttgtgcagtcttccctggacccaacttgcatggttgggacctgcccgtcttgtctaactcttactaacgttttctcaccaaagggatattcaccttgcttcctgtacatccaagttctttctgtcttgctctaaatcaaggagaccacatggaaccacttgctgcaaactcttgagtctttttgttattgagtggttctcaaagtatggtccctagcccagcagtattattatcacttggaaacttgtaagaaatgcaaatcctcattctcactcagacttattgaatccgaatctctggagctggggcccagcaaactgcttttaacctccaggaggttctgatgcatgttgatgttagaggaccactggcctagatactctgactatcccacaatggctcttaaatatgaagttctcagattttagtgtgtataggaatcagctgaggaacttgtttgtaaatgtagattacagcattctacccacagacagactgatttatagagtgaggttcaaagatttttattcaaaaatattctactcaagaagtctggggaaggtattttgaggaatattgtcttagtttttggatgagctccaagttctccagggagttgggccacttacaagtgacccaggccctcctttagagtagagttagatgtctatactccagtctatttctacccattaatcactttccccatttataaacttcttatagccaagatcttagaatgcctcacagctgggttcaatacaggaattacaatgacacagaattactatctggtaaaagattatcaattcaaatggacagctatttcttctccatgataggagtggaggtgtattgtgagacggatttttttagacctcctatctttttctatttcagtcaggaaagttttctggtgcccaggcaaactgcttgccatatgtttgcattgactcaaataatgcattcatagaagctgacacagtgattataacactacctggtaagtcttatcatttcagttaagcacatattttggagcatagtttatatggggcatagttattgacatatggttgtatcaattggcatacttaataaactatgccaagcaaatatgtgtctcttgactggtttcccttttctattgtgaaaaggtgctctatcatatctccactattggaagtagccttctgattttcagagcaaatatcctgccaaatttgcccttaatagcaaccttcaagaccaaatttgttcctgtctggaggttgtaacctaagtctgaactgcttgtcttaaactctttcagctgattcagttcattcaactcaggattcaaatcttgtttggccttcaccaaacaattcagcctgaaggtctaggatcattcctggtcttacctcaagtctgactcatcatccaagtccagggtccaatgacacctgctttgtcaagcctaccttaacaggtcccctccctatcagtgttcctcttaaacctctgtatttataccaatcatcatttttgttcacaagaaactgaaaaaggccatttgaaattaagtaccagtgtgactatctctctatactgcatgtttcttgaaagtaagaattatattttcatacacccttgtataccttgtagcatatcaagcagtgctctgcatatatgtgttcggaatgtcacctggattggatagaagaatgaaagactactttattgtctgaagggcacctgggaatcaagttatccatagcacagtccacagggattagccatcttggtccatgttgatgaagtggatatgactattctccatgccaagaaataagaaatagtaatacatagtaaagcatttaaggcagccctgggtgtgctaatgtggggtatagatggtagaactatttacagtacttttcttgttcatttacacatctcttcaacttgtatctatcgagcatccactacatcaaatgcactgtgctgagtactaaggaggatacataagagaataatatgaggtacccacccctgactcttttgacttcaaggagcttcaggaataactttttgggagatgagaaatgtacataaaaacagatggcaatgcaagatagtacttaagtacaatatgaagattgttgaagctcagaggcagaagtgatcatagtggactggaatggtctggagaaagtgtgctccactttctccagtggaaggctagaaagattaagattacaaggtgttggatattctagccaggagaactgttgatggaatatgcatgtgtgtctatggaacaatagataaactacagtttttaaagcatggaacctagcaaccttgagctctcggatctcagtcagtgggatcatggacatcgctagtgctcaatcataatctggttcctacagcactcaaatctcttggttactagatatccacacactaactaacctgagccacttggttatctccctcatgggtcatctctgctggaaagatgcttacctttcaaatagtatttttctctcttttctcataaagttgcctctttggggtttagttatgtatgtcttcagagacagcactaagggagactcaagctcagttcactttactacctatctgttgcacaatttgaagcatgtggcatgcattggttgtccactcctaggattgcagtgtgtgtagttaaaccataagctccaaaattctatacacagtccctcctatggggcctgggaatttctctacttattgagccccagggcctgcctgactaccccagggcttcctgaggaatgcatgcaaattagacccaaacagtgacaccagatgacacttaatttttatttgtgcttgaatacctcttaaaaaatgcacataacatctagaaccaccctcaagggacttattttgactatctcttcatggaaataactaatatgggttcaagctgaatatattatggaactatttcaaggatgatttcttgggtttgttttccctttctcaaggatatcactgtgctcttcataattggcaaattagatattgtgaaagggaaggaaaaatgagcaatgagagcagtaacatgccaagagggcagcaatagaagcagctaatggtgagggttgcttcacaggcttgcactgtgcaggtgcagctccctaaggagaagagccaatgtattatgccgtagaaagacaaaagaagcaagtgagacaaaagaagcatttgggtgttggtgactgctttgcaaatattttaagagctgcgtttttgacttgttttcctttctagagatattaccttggtactatcatttatatgacattgccaggaagctctcttgaccagtgatgccttgttagcatgggcctccatgccaagaacagacattcaggcttccatgagcattttcagccaggggtaattgagataatctggaggctaaagtcagaatgagacccactgtgtgttcagccagtactgtacagcttcctaaagcttccatggcaggatttgtgtttctcatggcacagcttctactcaaccaacgtggctcctttcaagaaaatcgtaaattttttttgtaaagaaaaagaggcaaaagaggctggaaggggttagagcaagatggcagaatagaagtccccattgattattccccccaatagggacaccacattcaacaaccagctacacgaaaaagcaccttcataagaaccaaaaatcagttaagcactcacattaccggtttttaacttcatatcactgaaagagacactgaagaggataggaatgacagtcgtattaccaacactacccctctgccatttctccacaacagctgcatggcatggagaaatctgtgcacgtgggagagggagagtgcagtgattgagacttcatactgaattcagggctgccctgtcacagaagaaagcaaaaactgggctgaactcagctgatgcctgtttatggaggaagcatttaggtgagccttagccagaggggaatagcccatctcagcggtaggaacctgagtttagcaacccttgccactgtgcgctgaagtactctgaaaggcaatctaggccacaaggactgcaagtcctagggctgagctgagctcagagccagtggactgggtgggggacagatacatgacttactggaacaccagcaagacaacttagagattgcttgtgctacacctttccaaaccctaggcagcacagctcacagcttcaaaagagaccctttccttctacttgaggaaagaagaggaaagagtaaagaggacttttgtcttgcatcttggataatagctcagccatagcaggatacggtactgatcagagttgtgaggcccccatttcaggccctagctcctggatgacattactagacacattctgggccataagggaacctgctgccttgaagggaagaaacaagtcctggcaggatgcatcacctgtcgattaaagaaactttgggccctgaataaccagcagtgatacccaggtagtatgccatgggccttgggtgagactctgagacatgctggcttcaggtgagacccagcaattcctggctgtgatggctatggagacagacacctcttgtttgagaaaagcagagggaaaaacaaagggaactaggtttagcaccttaggtaccagcttggccatagtggggtagagcaccaagcaggctcttggggtccccagcttcaggctttggctcttggacagcatttctggagctgtcctgggccagaggagagcctagtgccctgaagggtgagtcccaggcctggcaaaattcaccacaggctgactgaggagcccttgagaattcagtgaacatcagtagtagcctagaagtacagcctgtgggccttttagtggtgatggccacagagagaggctcctctgcctgtggaaaggggagggagagaagagttagaaggactatgctttgtaatttgagggccagctaagccacagtagaatagtacaccaggtagaattctaaggtttttgattccagtccctagctcccaagtagcgtctctggacctgcttagggcctgtgggagtttgccaccctgaatagaagaatgcaaacctggatagccttgtcacctcctgattgtggagccctagggtcttcagcaaacatagacaatagccaggtagtggttacagtggtcgctgggtgagacccagtgctatgctggctacaggtctgacccagacagtcccagtggtggtggccacagaggtgcttgtgtcactccacagcactatttactcaatattttcacttcaatatcacctcaaggtcaacatgtccaagactgaatttataaaattaaacttatggtcacttctcactatcttccaataaaagaaaaataaatgccacttatccctgttttagaattccatattttagtgaatgtcacctttatcaacagtgtctcaagaaaaaacagaggtatagatgatgcctccctttttacatgccagtttcttatctatcaccaagtcctgttgattttacttcttaacatttcacaaccctgtccacttcttttcatttccccagcaccaccattttcctagaccaaaccatcagtatgttttgagtgaactgctgcgaaagctcacaaactagtctccagagatccatctttcagtcagaatggacacaagtgatatcatgtgtattttcattcatttctctatccccagcgctagaatagcacctagcaatagtaagcatgctaagtatatgctgattatttaaataaatgactttcctcaagacattaaagagcaatatctttgacatggccaataggatgctgcattatttgtccctgcctagcacttcagtatcatctgtcatcagtgtccttcccaaggtcttactttctgtgcctcaaccaaactgggattctttaagcttctagaacaaatcctgcttcttatatcagcagggcctttgcacatacagtccgcttggcctgggttgtagtcctccttcaactaatgagctacccttcattcaactcttaggccacatgctgcctccccaagaaagcctaccctccccgttctcccagacctcacagatttcttagtaatttcttagtaatcctaagaggcccaaaaccctttcttttacaacacttttctccatttgtaatgatgtattcattattgtggtcaattgactagtttctgtttccttatttaaactggaatttccacaagagcaagggaaatgtcttcttttgctaactagcacctagcaccttgcctggactataactggtacactatgaatgtttactaagtgaaggcaaatactttattgagaaattaattaattataactaaatatttgattatgttgtgacatttctagatgtcactgcaaataaagtaacaatttgagcacacttatggtattgtctgtcttttctattactttcccttcagtagagtgtagtctactataggtgtgtagtttttaaaaattgagtcgttcatcaccttagggaagacagtaatgaaagtattcatttagaatacaagctgtgacagaaaaccaaacaccgcatgttctcactcataagaacattgaaaacacatggacacagagaggggaacaacacacaccagggcctgttgaggggtgggaggtgaggggagggaacttagaggatgggtcaataggtgcagcaaaccaccatggcacacatgtatctacgtaacaaacctgcacgttctgcacatgtatcccatttttgttttagaagaaataaagaaaaaaaaaaagaatacaagctgtaaacagacagaatcctaacttctatgtttatgaagttaaaagtttagaagtttatcatttgttactgccatcaggtagcaagacacttttaactggtgtttcaggacctaagaggaaatgaactgggtaaaaacaaatagagtcagccataaaattaaatggcttgattctttactctgccaagtgtctgagggggaattatttaatttagccagtgagtcaacaagtcagtctaattctctaaatctggttattttccttagcaaaatgtatttgttctcttcaccacaaaagcatatttgcagaagatgttgactatgaaattccttttgccacagttattgaaaaagaatataaagagccacataataattagacaattgatgttctcaaaacaagattaagattctcattcccactcaaagtaattctttgtcaactgagctatgaaaactctctctgcccaaaagggaaccaaatttaagcacttaaatgtctctaatataaatcctgaaaacttatgacacttttagtcatttggtggtagcgtctttcttaaaatatttggaagtattaaatattattttacctatttcagaattgtaagccccaactgtttttccaagtctacatatgtatcaaattaaaaatatttttaaaaagttaatgaaaacaactatgtatttttcttggtggatattccaagtaaatcactatgctctgtaacagtatcctcttgtagtttacagcatgcgttgcttaatttgatccacagaataatcctatgaaaaaagcatttttatcctcccctgctattcccaaatggcaaaactgagtgttcccctcatcatcaaatagtaaatagtgaagcttataattcattaatatcttcagattccaagtcccataatggtttgctctacacaagtctgaagagaagaactatcaataagtttaaatcactgggagaataagccagaacaaattgtcaaagtttccagtatccccaaacttcaataagagaagtctgaggcgggtgatagtgattatcaaatttctgcagggttactaagatctgttcttgtccctcctaactccagaataaaaagaaatggactcacctaaagacaagttctgttcatttattgagctcccaatatataccaagcactgtccaaggttctggaaatacaaagatggctaaaacatggccccaataccctagggcttcatggtcctttggagaagatgaacacataaacaggtagtcatgagtcaatgtggcaaatgcagtgaaagatgtgcagaagggcttttggaacacagagaaagccatctacattggcctacagtatgtcagagaagtatccttactgaagatagccccaaaggccaactggacatcatgatgcatttgggatacaagttctgtgagaataagaggactaattttacttatttttgtattccccagtacctaatacatgactagtgctcaatgcattagtgtatttaaccaaactgaactgccagatcagagattctgaagaggctcatgaaatgcttgtcctctttcttggaaagaaatatggccctcaggcatgtgtgaggccattcttgcattgctgtaaataaatacctgagactggttaatttataagtaaagaggtttaattggctcctggttctgcaggctgtactggaagcatagcagcacctgcttctggtggggccttaagaagcttacaatcatggcagaacacaaagggggagcaggtatataacatggcaagaatggagcaagagagaaggaggatgtgccacatacatttaagcagccagatctcatgaggaactcactcactgtctcaaggacagcaccaaagggatgacactaaactcttcatgagaaaacttcccccatgatctaatcacttcctaccaggccccacctccaatactgggtattgtaattcaacatgagatttgggtggggacaaatatacaaactatgttattctgcccatggtcccttccaaatctcatgtccttcttacatttcaaaatacaatcatgccttctcaatagtcccccaaagtcttaactcattccagcattaactcaaaactccaaagtctcatttgagatgaggcaagtcccattcacctatgagcctgtaaaataaaaaataaattatttacttccaagatccaatgggggtataggtattgggtaaacattctcattcctaaagggataaattgtctaaaaaaggggctacaggccccatgcaagtttgaaacctagcagggcagtcattaaatcttaaagctccaaaataatctcttttgactacatttcccacatccagggcacactggtgcaagtggtgggctcccaaggccttgggcagctctactcctgtggctttgcagggtgcagcctctgaggctgctctcacaggttgttgagtgcctacagcttttccaggcacagggtgcaagatgccagtggatctgtcattctggagtctgaaggatggtggtccccttcccacagctccactagacagtgtcccaatggagactctgtatggggtctccaaccccacatttcctcttggtattgttctagtagaggttctctgtgaaggctccgcccctgcagcagccttctgcctgggcacacaggcttttttataattcctctgaaacctaggcagagggtgccaagcctcatttactcttgcactctgtgcacccacaggcttaacactacatggaaactgccaaggctacagtagcttgcactctccaaagtgatggcccaagcagtacatggggctctttgagccagtgttggggacagagtggtcaggatgtggagagcagtatcctgaggctgcatagggcagcagggctctgggcctggcccacgaagccattcaatcctcctaggcctcagggcttgtgatgggaggggctgtctcttagatatctggaatgcctttgagacctttttcccaatgtctcagttattagcacttggctccattttatttatgccagtatttctagcaagtggtttcttgatagcctgattgaactcctctcctgaaaaagcctcttctttctctgccacatggccaggctgcaattttccaaacctttatgctctgattcctgtttaaatataaataccaagtttagatcatttctttgctcctacattgagcatagtctgttaaaagcagccaggcaaaatattaaatgctttgctgcttagaaatttcttccaccagataccctaaatcatcactctcaaattcaaacttccgcacatccttagatcatgaacagaaagaatgcagccaactctttgctaaggcataacatgtgtgacctttgccccagtttccaataagttccccgttttcatctgagacttcatcatcagcctggacttcactgtccatgtcactataagcattttagtcacagctattcttgtctataagaagttgcacactttgggaggccgaggcaggtggatcacgaggccaggagatcaagaccatcctggctagcaaagtgaaaccctgtctctactaaaaatatgaaaaaattagcagggcatagtggcaggcgccgtggtgggcgcctgtagtcccagctactcgggaggctgaggcaggagaatggtgtgaacttgggaggcagagcttgcagtgagctgagatcccgccactgcaccccagcctgggcgacaaagcaagactcagtctcaaaaaaaaaaaaaaaaaaaaaagaaagttgcaatcattccctcatcttcctgtcttcttctgagtccttcaaactcttccaacctctgcttgctacccagttccaaagttgcttccacatttttaggtatctttataataatgccccattcccaagtaccaattttctgtgttaggctgttattgcattgctataaagacattcctgagactgggtaacttataagcaaagaggtttaattgtcccatggttctgtaggctgtacaggaagcatagtgctggtatctgcttctggggaggcctcaggaagcttataatcttggaggaaggcaaaggggagctggcagcacatcacatgatgagaatggagcaaggcagtgggggtggaatgtgccacacatgtttaaacagccagatcgcatgagaactcactcactattgcaaggacagcaccaagaagatggcactaaactattcatgagaaatccacccccatgatctaataacctcccccaaggcccatctccaatatactagggattacagttcaatgatatttggaaagggacaaacatacaaactgtagcaggccacatgatgaatgtcttttcagttcctcagttaacctgatttttcctatcaagaaatattttcaaatctgtggaatttccttctattagaactctgggcaataaatttaatcttttttttttaacagtggttctatctgagagagaaacacaaaaggtttcctccagcccagtgatctttgactcttgccctggatttttcttacttaaaagaaaaagtggttttgtatgctaatcagtgcctattgcattaaatggcctcatatattaacattgcatttgataaaaccataaatttaacagtctcttatttattcagttatcaagttctattaattctacctcaaaactgactcttgaatctctccttttttcttattttttaaaattgtatactgccttgtcatcatctcttgcctagacttttgcattaacattctaatcccatgtttacaaagcttccaaagttatctggagactatttttcaaaaacctttgatgggtctccatcactaatgtgataaattcaacaccctttagcatggtttactaggtctttatgtcctgaaaagtgaattgggttgaagtgaattacattgtgttatttgtaaacagaatggtcacagcccatgatcagtgagttattttaataagttgaagtcaatctttaaaacactgtcttgtgatatactaatttcttatcctaccaaatatatttacaaaacagggctacaaagcagagtcacaaaattgccatgcctagatgctgaaaagactgcctgtttgacaaaaatattgctctcttggagcatgcggaagctaagaaaataagttttccactgatggaaggcccctgctgtactctctgatgatgattgggaaatatttattttaccagaagtgggattataaccattttcatgcatcgacggaggttcaggagtcagcccctcaaattctgttgtcaattctcctgtcaattcagctctgcatttagactctctccagggtctgctggaactttaactgctgaaaactttaaagattttgcctccttcaaaaatattatagagagcttgctgtgttgacttaacttgtgtgtgtgtgtgtgtgtgtgaatcttgttcttcatactctactaacacaccactacctccaacaataggggagacatttttgaattgatgtctcagcaattgtggcacatcatactgaatcattcaccttttcctgcccagcctgctttactttcagatactaaagagaatgttttaatgagcaggggaaaattatggacagtcagaaaaaataaactgattgaattcaagcatcttgtttttgaagttgaagtctgtctggcacaacagctggagcttaattcagaggggataccacagtagcttttggtcttgaaaagtgagttaccaatgttttcttctaaagaatatctgccatttccttttatttctgtgccttgactcctgtttctttactgtaccaaggtaatagaaaaaaaactagtgaaaggtacaatctgttaatatagctctgggaagtgtaaaaatgaatgagatctctgtctactgtgcttggaatgtctgagaagcacccctggctggatgattgatatttgggtttaaatcctgatttattcaagacttactataaagttgattcacttataggatgaaggggttgtcctggttgatttatgaatatgtatgtgtgagggggtgggaggaaacgtctttttgtatctagcattccctgactctgtgatctatacccataattctaataaggatctctctgtgtgtaattaaggggtttcctggccttttgcagaagtatgtagaacagagaggacaaaagaaggaggagaaaatatagaaatgcaacttgggccaataatgctactccccaaatcttctcatctgtttctctatgggtggctccaatcatgtttcctccatgactcagtacaatttcaggcctaggtctgactctgtacttctaagagaagtaaactgcatctttagtttagaggtaggggaagagtgagcataatggtggtaaaaggaggcagatgcttgtgtcagatgataggtatgctcgaactagagcacatgattgtcatgtaaggtaaagcagagcttgaggtggtcacggatggaaaacatgcctgtgctgacaataatagatacaatgtactgaatacttactatgtgctagggactactctagatgctttatatgtgttgactgattgactctttcaataactctgtgagttaagtattaccaaccacatagtacatatgatgaaactgagactatcagagattaaatatcttgcctaaggcctcataactcgtaagcaataaaaacaggattcaaactacgagctggctatattcttaaccattctacctcagtggtcttacatagccataatctgatttttctctttattcaaaattttgagagtaatagatgttgcttaaaacaaatggggtttgaaaataatccatttgagaccaggcacggtggctcacacctgtagtcccagcactttgggagtctgaggcggatggatcacctgaggtcaggaattcaaaaataatccattagcacctttttaaaaaaatcttttaagatcttgttttaaaattatacttaaattctgggatacatgtgcagaacgtataggtttgttacataagtatacatgtgccatggtgatttgctgcatccatcaacctgtcatctacattagctatttctcctaaagctatccttgccccctctcccatccgccgacaggccttagtgtgtgatattcccctccctgtgcccatgtgttcacgctgttaaactcccacttatgagtgagaacatgcggtgtttggcattttgttcctgcattagtttgctgagaaggatggtttccagcttcacccatgtccctgcaaaggacatgaacccattcttttttatggctgcatagtattccatgggagatatgcgccacattttctttatccagtctaacattgatgggcgtttgggttggttccaagtctttgctattgtgaattttgctgcaataaatatacgtgcacatgtgtctttacagtagaatgatttataatcctttgggtatatacccagtaatgggattgctgagtcaaatggtatttctggttctagatccttgaggaatcgccacactgtcttccacaatggttgaactaatttacagtcccaccaacagtgtaaaagcattcctatttctccacatcctctccagcatctgttgtttcttgactttttttttttttttttttttttgagacagactcttgctctgtcacccaggctggagtgcagtggtgtgatctcggctgactgcaacctccacctcctaggttcaagcaattctctgcctcagtctcccaagtagccaggattacaggcacctgccaccatgcctggctaatttttgtatttttagtagagatgctgattcaccaacttggccaggctggtcttgaactgctgacctcgtgatccacctgcctcgacctccaaaagtggtttcctgactttttaatgatagccattctaactggtgtgagatggtatcgcactgtggttttgatttgcatttctctaatgaccagtgatgatgagctttttttcatatgtttgttggccacattctttgaaaagtgtctgttcatatccttctcccactttttgatggggttgtttttttcttgtaaatttgttgaagtcctttgcagattctggatattagccctttgtcagatggatagattgcaaaaatgttctcccattctgtaggttgcctgttcaccctgatgatagcttcttttgttctggagaagctctttagtttaattagatcccatttgtcaatcttggcttttgttgccattgcttttggtgttttagtcatgaagtctttgcccatgcctatgtcctgaacggtattgcctaggttttcttctagggtttttatggttttagatcttacatttaaatctttaattgatcttgagttgatttttgtataaggtgtaaggaaggggtccagtttcagttttctgcatgtggctagccagttttcccaataccatttattaaatagggaatcctttccccattgcttgtttttgtcaggtttgtcaaagatcagatggttgtagatgtgtgatgttatttctgaggtatctgttctgttccattgttctatatatctgttttggtaccagtaccatgctgtttggttactgtagtcttttagtatagtttgaagtcaagtagcatggtgcctccagctttgttctttttgcttacgattgttttggctatatgggctcctttttggttccatatgaaatttaaagtagttttttctaattatgtgaagaaagtcaatggtagcttgatgggaatagcattgaatctatgaattactttgggcagtgtggccattttgatgatattgattcttcctatccatgagcatggaatgtttttccatttgtttatatcctctcttatttccttgagcagtggtttgtagttctccttgaagaggtccttcacatcccttgtaagttatattcctaggtatttcattctctttgtagcagttgtgaatgggagtttgctcattatttggctctctgtttgtctattatttgtgtataggaatgcctgtgatttttgcacattgattttgtatcctgagactgctgaagttgtttaacagcttaaggagattttgggctgagatgacggggttttctaaatatacaatcatgtcatctgcaaacagagataatttgacttcctctcttcctatttgaatgctctttatttctttctcttgcctgattgccctggccagaacttccaatactatattgaatagagtagtgagagagggcatctttgtcttgtgccagttttcaaagggaatgcttccagcttttgcccatgcagtatgatattggctgtgggcttgtcataaataggtcttattattttgagatatgttccatcaatacttagttcatgaagtgcttttagcatgaaggggtgttgaattttatcgaaggccttttctgcatctattgagataatcatgtagtttttgtcattggttctgtttatgtgatggattacatttattgatttgcacatgttgcaccagccttgcatcccagggatgaagctgacttgatcgtggtggataagctttttgatgtgctgctggatttggtttgccagtattttattgaggattttcacattgatgttcgtcagggatattggcctgaaatgttctttttttgttttgtctttgttatgatttccgttctttttcatttgctgaggagtgctttacttccaattaagtggtcaattttagaataagtgctatgttttgctgagaagaatgtatactctgttgatttggagtggagagttctgtagatgtctattaggtccacttggtccagagctgagtccaagtcctgaatatccttgttaattttctgtttcattgatctgtctaatattgacagtggggtgttaaagtctcccactattattgtgtgggagtctaagtctctttgtaggtctctaagaacttgcttcatgaatctgggtgctcctgtattgggtacatatatatttaggatagttatctcttcttgttgcatggatccctttatcattatgtaatgcccttctttgtctttttttatctttgttgtttcaaaatctgttttatcagattgcaacccctacttttttatgctttccattttcttggtaaatattcctccatccctttattttgagcctatgcgtgtctttgcatgtgagatgggtctcctgaatacaccacactgatgggtcttgactctttatccaatttgccagtctgtgccttttaattggggcatttagcctgtttacatttaaggttaatattgttatgtatgaatttgatcctgtcattatgatgctagttggttagtttgcccattaattgatgcagtttcttcatagtgttgatggtctttacattttggtttggttttgcaatggctgacaccagtttttcctttccatatttagtgctaccttcaagagctctcataaggcaggcctggtggtgacaaaatctctcagcatttgtttgtctgtaaaggattttatttctcctttgcttatgaagcttagtttggctggatattaaattctgggttgaaaattcttttctttaagaatgttgaatattggcccccattctcttctggcttgtagggtttctgcagagagatctgctgttagtctgatgggcttccatttgtgcataacccgacctttctctctggctgcccttaacattttttccttcatttcaaccttggtgaatctgacggttatgtgtcttcgggttgcttttctcgaggagtatctttgtaataaaaccttttgttttttgccactggagatatagatatgcagagattgatgataactaagaaacaatctacagagtatgcttgtaagcatggttatgaacagagactgtggaagctcctaggagtgatttgccaaggtctattactctctcagatcacagtgcaataaaaatagaaatcaaaactaagacaattgctcaaaaccatacaattacatggaaattgaacaacctggtcctgattgacttttgggtaaataatgaaattaaggcagaaatcaagaatttctttgaaactaatgagagcaaagattataatataccagaatctctgggacacagctaaggcagtgttaagagggaaatttatagccttaacacccacatccaaaagttagaaagatttcaaattaacaacttaacatcacaactaaaagaactagagaaccaagagcaaaccaatgccaaagatagcagaagacaacaaataaccaaaattgcagctgggctgaaggaaactgagaccccaaaaaacattcaaaagattcaggagcttttttgtttttaaaaataatattacaaagtagatagactgctagctaggctaataaagaggaaaagagagaagatccgaatgaacacaatttttaagtggcatatggggtattacccctgaccccacagaaataaaaacaaatatcagaaattactattaacacctctatgcaaacaaactagaaaagctagaagaaatagataaattcctggacatttagcccctcccaagattgaaacaggaagaaattgaatctctgaacagaccaataatgatctccaacattgaatcagtaataaatagcctatcaaccaaaaagaaaaaaaaagtccaggaccagatagatggattcacagccgaattctgccagatgtacaaagaagagctggaatcatttctactgaaactactccaaaagctaagaaagagggtctcctctccaactcatcctatgaggccagcatcatcccgataccaaaacctggcagagacacaacataaaaagagaaaatttcaggtcaatatccttgatgaacattgatgcaaaaatcctcagcaatactagcgaactgaatctagcagcacatcaaaaaacatatccaccacgatcaagtagacttttctctaagattcaaggttggttcaacatatacaaatcaataaatgtgattcacacataaacagaactaaagacaaaagccacatgattacctcaatagatgcagaaaaggctttcaacaaaattcattatctcctccagttaaaaactctcaacaaactaggtattgaaggaacatacctcaaaataataagagccatctgcgacaaacccacagccaacatcatgttgaatgagcaaaagctggaagcattctctttgaaaaccatcacaagagaaggatggcctctctcaccactcctgttcaacttagtattggaagtcctgactagagaaattaggcaagagaaagatataaagggcatccaaataggaagagaggaagtgaatctatccttgtttgtagatgacatgatcctatatgtagaaaaccccatcatctcagcccaaaatcttcttaagctgatcagcaacttcggcaaagtctcaggatacaaaatcaatgcacaaaaatcactagcattcctatacaccaacaacagtcaagccaagagccaaatcaggaacaaactcccatttaaaattgccacaaaaagaataaaatacctaggaatacagctaactagggaggtgaaagatctctacaaggagaactaaactgctcaaacaaatcagagatgacacaaatttcccatgctcatggatggcaagaatcaatatcataaaatggccatactgcccaaaataatttatcaattcaatgatgttcctattaaactactaatgagattcttctcagaactagaaaaaaagctattttaaaattgatatggaaccaagaaagagcccccaaatttcaaggcaatcctaagcaaaatgagcaaagctggaggcatcacactacccagcttggtaatgcattttcttacatttgctctccctcctttcctgtctcacttctccttttccttacaagtgaataccttgaatttcatacccctagaagtgttagcatgtacctcaggctctgttttctaggcaacccaagctaaaatgataaaatattggtgcagttagtaacatgatgagttggtagttgaagggctttgaaaattgtgcttaagaatttggatttgggctttatccacaggttgtggataaggagaagggtatttagatagagttcctggcataatacttgggtgatgatataatctgtacaacaaacccccatgacacatatttacctatttaacaaccctacacatcctgcacatgtaccactgaacttaaaagtgaaaaaaaagttgcttagaagctttgttacttatgattttgagattagagagaaaaaatatccatagtgtcctcaaaaaagaaatgtaatgaatgatgtctttaacatttatatagtaaatacaataacatatttaataacataatttcttatagcttctttcttataagtaggccaagggcaagatagcatagaagcaatgtactctatatttgcataatgtatatagaaattggcccactcaagcggcttcttaaaacagcctagacacagtcgaaaacttacctagtggaatgaccatgccaaaggaaactcattgcacctgggtggttcagaccaatgtctgatggccgctctataaaccacagataaaagatctgattcactctactggcccttcttcaaaaaagaacaggagtcctgagagatctgtaagctcaggactattttcagcttgtaaagggctctctccagtccttgcacatagtaccctacatctcagaaccagcaatagggtgttgaatgtttctcatgatgccatgtctccaacccttcttttgtcacatctttttctgaccaagctgggaaagattctctgcttttcaggattttgtgattagacttagtcaacccaggtcttacagccaattgccccatctcaaggtcagtatccttaatcacatctgcaaaatcccttctgccatgtaaggtaacatattcataggttccgggcattagggtgtggatataatgggaatgcggggcattattttatgtaccacaatgcctgttttgatcaaggtgtagtagtggagataaagaaaagcaggagattccgaatatgttttttaaggtagaaacaatgggatttgtctgttttgctgagattacaaatgaaagagaaaattcaaggatgactctaagttgcttggcctgagtaatgggaattattgaattgccattaattgagatgaggaagactgtatgaataggcttgcagggtctatatgtcaggataggttaggttatgttgtagtagctaacaattataaaagctcagtggttttacaaaggacatgacagccaatttttaaaaatttttatagatttagggggtacaagtgccattttcttacatgggtatattgcatagtggtaaactctgggctcgacagccacctgttttatttggtccttgcctcaaggtatagttttaaaagcccttgtgattcaaagaatttgtcagttttatatttgatagttggtggcaaaaaccacttacatcttacaatcctgcaagtccctggagttttgaattctatttcctctcactcctgtttcaaattggcagagctcatctctttcttgaagtacagtgtcaaatacagtcaatagtagcagacataatactaacattctgttttgcaacattttaagccataaagcaacaaacttattaagaacattatttatctttgaacttattgcaggcaaacttttcagcactgcatactgtagatcaccataccttccatactctggtaacattttttttttcttctcactacctggccctgaaaccaatgccatgtttttttctattatagcagaactgacttctggcaccaatttcactatcagctaggatagactaggtcatgtagcaccatcacacaccataaaattctaatggcttataaccacaaacgcttatttcttactcacacatctcattcatgtcatcttcactctggaacacacaatgataaaatacctactatctggattattgccagtcttctgagaggggaaaaagagagaacatgaaaaccgtgtattgactcttaaagctatgcctaaaaatgacacatgtcacttctgtttatacttcttttgcccagaataaggcaagtagccaactcgatatcatcaggacaaggagtatcatcctctgccagactgggttagtaaatacttacaggcaataaaatagtctaatataggagaccagctcaagtgtttggttttggatgtattatatttgaactatctcttagatgtccaagtggagatacgaagtaagaatttgcatttgaaagtttggagctcagaagagatagaaactttaggaatcgagatcatatataaagtagttaaaatcaggagagtggagtgattatgatcattaaagaaatgagtacatctagagaagagaagagatctaccatcacttagaagtgaagcaaaaagaaagtaaaaatttaaaaataaatgggggagcagttgtcaataagttagaggaaaaactggggatgtatgatgtcctgaaagccaagcaaagaaattatttcagtgaagaggcagtgatcatctttgttatgttgccaataggtcaagtaagataaagactgaaaattgaccattggctacatttgcgtggataccattggtgatcttgagacagttttttgtggggcagtgggtatggaagtctgattagactatacttaaagagagggtgagagaaaaggaattaatgatagttaaaaatgggataatagaggggtaaatagggccaagagagggttttttttttttaaagaaatgtgaatggtatcagcatgtttatgtgttaagtaaaaagttctactctaaaaagatcttactctaaaaagagttagagatgttagtgatgatacagcacagatagaggagaatcgctggaacaaggtttttgagtaagtgagagaatatgggacccagttacaagttgaagctttggtcttagctagaatcatagacagtccattcttagtaacagtagaaaatattgagcatacgatacaaatgctaatacacagataaatgtgttggtggcagcttattgaagttctctattgatttcttctatgtaatcaatgaaacaagcaacaaagtcatctgagaccaagaggaagaaagtgttggaaggctggaaatagtggaaaatgtatgaaattgtcctatgagagaacagtggagagaagaaactagggaaatataatttagtgatcaggtagcattaagaacccttctgaggccaataatcataaatttaaagaccagtcagtatggatgtatgttttgctccagtcacattcagatatagaagtaaagccatggaataggtgaaaaactgaatttaactatggttggagtcttgccatgtgagaatgatgatttgagagaggagaaacagtatttgtgttatatgcatggcggtggttataattgcccatgggctttttaaactggataataagggaagtagtatcattcagagggctacagacagtgaaaaaatgataggctcaatacatggtaaatctaagtgggattgaagaattatgggattcaagttactccaggaagtgaactgtaaagagagcagcaatggctggaggctgggatgcatgaaattgaaattatgaaaagattatacatatacgtaatgacaggatctatgcatcatcatctttgttctctcttttgtcagaaaaggcactgctatttcctctggccagaaagaaatgtatgtttgtagcactagaaacccatgggttgggacttatgggtgaccttaaattatctgggtctctgttatctcatctctaaatgggattgataatattgccttttctttggattaatgcaaggattagacataatatatgtttgaacccaggagttcaaagttgcaatgagctatgctcaccccacagtacactagcccaggtgacagggtgagatcctgtctctaaataataacaataataataataataataataataataataaatgtaaagtgcttgaaacataccatttctgaatgcctgttattattgttgttattgctattatccttatctcaaacagaactggcgcttggcatttcttacttagagattactttcgatggttttggagtgaggggagagatgagacttaccaagaatcagaaaagcctgtgaggtcatgaagagaaatagcattttcttttcccagccttcatgtcctcattctactctttacctcacactatgtttatgacattaaactgacatggttgaaagtcagaaggtacatcaacactgtgttctataagaactgatcttttgataaagtttgtgcataaattgttgacattgtgacaaatgtaaaagcctgtctcagccaaaaaccccatcccaggtagtttaacatattccttataattattatacatttatccccaagaactgataatgccaagggctgagagcctgggaaacttggacataacctgctccaagctcaattccagttatccttaaaagaggggtgtggtaatgttgtcccagagtgacagcttcagccagtttcctgtcccactcttctgccccagagtttctttcttgtggtgaagagaaggaggaagacagcaggatgttggtggaaaccctgctggctgaagtggacagaatggtgttcagacactgttcatctccaaaccttctgctttacttttatgacaacattcccatgggtaaggcactctggccatctggcacactgatcccccatctcctgcaccccagactgcttcaggacctttgttttgagttcttggactgctcggtgaacaggaccaggaggggacataaattttggattgttagtaccagctaactaagtgaccatgtcatttcctcttgttgggcttcagtttgggagtaggggtaggcaagataccaagggaattctatgatctcatgggaacccaagaacccagtggtgcaaataatgtaatcatttgaaaaaaaagtttgaaaacaagtattgagaaactaccatgttggtcaatttcaatttaaatggctgcctcagaataatgtggataaaatgcacagcattgactttacctgggttctctgagccctaacattcttaatttagacaacacattgctattgttcttgagaaatactagattataaaaaaattcaaattcaatgaaaaaaataaataatttaaaacatattttatattgttcccagtaacttcttcattttctgattaaaaactattacccttgagagattatatttctcctcactgatgatttgaaggagttatttggcttattttttggtcagagttgctgtaatgttgaacttttttgtggggcaaagggtgcgtctaaaaacttccaaaagttgtttactaggcatttttgtttgatcaaagtattaagaaatcacaataatggatgataaaaatcttagtttaaaagcaatggaccacctgcacacgtcagctgtggtgaatgtcaaatgactgccccatgtgagaataagcataagaagcctaaccagaggtctggaacctgtagcatctgttttaagtttccttcctggacttagaccctacgtggtataacagacaacccttatgtagatcctttcagcttcatctatctccagggccacctattctgccctagtcactcagtgttgatggacttcatgggagacccttaccaccaggaatctctggcttcttccaccacttttttttttcttttttttttttattatactttaagttttagggtacatgtgcacattgtgcaggttagttacatatgtatacatgtgccatgctggtgcgctgcacccactaattcgtcatctagcattaggtatatctcccaatgctatccctcccccgtccccccaccccacaacagtccccagagtgtgatattccccttcctgtgtccatgtgatctcattgttcaattcccacctatgagtgagaatatgcggtgtttggttttttgttcttgcgttttcaggacataggcatgggcaaggtcttccaccacttttagacttaaatatggcttcacatagtcatgcataggatctacgttccccagctgtggctgaaggggccttgcgatgcaactcagaactgggaggctgttaattccctatgaaattagggtgtgaactttaacaagttgggttagaagataagagaaaactggttgatgaatttccagtctggcaccccatcactctgtttagagatagtagcttcataaatctctctaaacatccaacatgagtgagcaattgactgtatttttacaaagctttggctagcttgttaatgcatgctcttacatttgctctccctcctttcctgtcttactccttcttttccttacaagtgattaccttgaattgcatacccctaaaagtgttagcatgtacctcagactctgttttctaggcaacacaagctaaaacagataaaatattggtgcaattagtaacatgatgagttggtagttgaagggctttgaatattgtgcttgggaatttggatttgggatttatccacatgttgtggataccgaagagggtttttagatagggttcctggctgcaagcagcagaaaccagctctgactaaagcaaaaaaggagatttatttgagaaatattatagaaatcctcaggatggaaggtaggacttgggagggataggtgtgaagatagtactggaaaactcggtggtggaactcctgggccctctctttaaaaactatcatcaaatcaacttcctgcaaattagaagtggaccaggtatgaaccaatcattgtcaagattcgagagtgaaataaaggggaaatgaagtgtaaaaagaagattgaagatgttggagaaaagaggaactggtgaaggagttcttccttaggcagttgggagaggtggtaactgagactgtgaagcctgtagaaagaagtaggatatgttgtcttcctaaataggagagaaagaagattatgattttaaacacaaaaattatctgagatggtgagaagtagtaggtgagggaatgaagtctggatagaacttcccagaggatgaattcacatttgttcatgtgctccctctgcagtgtgattatgttatttacttcacttctgtgattcagtttcttcatattttaaaacagggtttcagacccaaaagtccttttctacctaaataagctataattctctatctcctttggtggtagaaagggtgaagagtaggttggggggactctttggtctatcttggatagatagagctctttaggtttctccatttgcaccaacatttctcagacattttcctccaaagttatgccatcttagacaatatttgtgtaaatggatggattaggctgtgattcttacatatcaccaagaagagatattttcactatcaaagtcacttgatttctcttcaatttgcctctccctacaggaagatgctctcctggtacctgaccatcttaccaaggatgaaatacactgacgcatggtatagaaagctgggagatgtcatagcagaatacctcccctttgtattgtcaggattagccatatgacttgccttaacaattaattgttagcagaaatgatgtgaatcacctttggcagaaactttaggagcccgtttgaagctcttttttccttctgccatggtgactggaaacattctccaacagtggttgctccttcggcctgagacttaaagtgacaataatggcaatgcagggaatagcccaagccaaccttctagaattgttacaaaagcgagaaatcaacctttaggctacaaggacttgaggattgtttattagtgtggtgttccctagattgtcctaattgacacaaggcctcaatactcttctattgagtgtagaattgtttaggccaccaaaaaccaaagaaatgctggtagtgcacacccccttgacttctttaattgcaatatagcatgatacagttacaaaaactaattatgcctttagcttcatttctccctccccttccattgttctttttctgtcttgctactgttcctctttataatgttgggggtgttaagactctttcttttcttttgtaggaaagaagtcacccatgcttggcccaaagatccacatattatctctttgattgtaggcatcgagacattttttaagcacatattattcaacaaatgatattctcagtttcagtagataataaaaaataaaaagcccaatgtacattctattcctgtagaaacagacaaccagtgatttattttatcataataaaaagtatttatgccatgactcatatctttaatgcagtgtcattattctgtggctgtgctaactgtagaggaagagttgtttatagtcacagacagagcgtcagactgagacccaagagttattccaagaatggtgacaagaacagagtgtgttagaaggagctgcccagctgagaggaggattgtgtgaagtagaagtaacctaaatattctattatcttctgtgcttttcttctctccagggagaatttctttgttctgatctttattggagcccctagttccttcacattccattctttaatgatgatttttttgaacatccaagttcgtaatggaatctctctccacaaatttcgctgggatttccacagaaaaaggtgtacacatagctagcttaagaatacatgcgccagtatgggctggtccagaccaatcacagagcgctagtgcacagtgtatagtcagaccatttaactaatactaacaaagccttctttttctcttttcctgagacagaacaattataactctgggataatgctagggaacttgattttcttttagaaagttatactttttcaaatgataacataaggaaacacccatatactcatgttccagatttaaaaactcttaataatttttatatttccttgtagcctttgtgtgtatgcttttttaaaaaaagaccacaagttatatagatgtattcttttttcaggtttaaaggtttttttaacttttattttgggttcagggatacatgtgcaagtttgttatataggtaaattgcatgttgtgggagtttggtgtattgattatttcatcacccagctaataagcatagtactcaataggtagttttttgatcctcaccctgctgccaccctccacacaccctccaccctccaccctcaagttggccccagtgtctgttgctcccttctttgtgtccttatgtactcaatgtttggctcccacttgtaagtgagaatatacagtatttgtttttctgttcctgtgttagtccacttaggataatggcctccagctccatccatgctcctgcaaaggacatgatctcattttgtttacggctgcatagtattccatggtgtatatgtaccacattttctttatccagtctaccatagatgggcatttaggttgattccatgtctttggtattgtgagtagagctgcaatgaacatacacctgcctgtgtctttatgatggaatgatatatagtcctttgggcatatacccattaatgggattgctgagtctaatggtagctcaattttaagctctttgagaaatctccagatggctttccacaatggttgaactaatttacactctctccaacagtatgtaagtgtttccttttttccgtagcctcactgccatctgttgttttttgaccttttaatagtagccatgcagacgggtgtgagatgctatcttattgtgattttgatttgcatttctctaatgatcattgatactgagcttttttttatatgcttgttggttacatgtattccttcttttaaaaactgtctgttcatgtcctctgcccactttttaatgcggctgtttgtttttctctcgtaaatttaagttccttatagattctggacattagacttttgtcagatgcatagtttgcaaaaattttctcccattctgcatgtttactcttttgatagtttcttttgctgtgcataaggtctttagtttaattaggtcgtatttctcaattttagtttttattacagttgcttttggtgttttcatcatgaagtctttgccagttttttttttaatatataagatgtaatactcctctttgactgtatttccagaccattgctctctccctgttcctcagagacaaccactatgatgggtttgatattcatccttttaatacttttacatatagcaatagaaatttagaaacaagatataatatttctaagttttgaaaaactatatgtatggaattgttccatgcatttcattctgcaatttgtttgttttttaaatttaacgttgttttagggctattcttactgattgatatagctctgatctctttcttttagctggatagcaatccatttcattaaaattccgtattttatctattcctttaatgatggatgtttggattattcttaattttttttttttgctattcctgacaatgctgtaataaacatccatttatgtgtcttcttgtatacatagtcaaatatttctctagggtgtacacccagaaggggaaatgttaggttgtaggtttgacatctttctcattttactaaatactgttacattcctctcccaagtggctgtttcaatttacacaccgaaaagcatggtatgagattatctgtttattcatcctccttctctatactgatgattgtcacactttttaattatggttagtctgatgagtaaaagatgctctctcattgtagttttaatttacatttccctgattactggtgagattgaatttcttttcatatgtttattgaccatttatgtttcctctggatccattatatgcttacattatctctgctgattttttcctacatacagaaaaagtacactcaaaagcatttatgcataaaaagaagctggaggaagagggaaaaccattttcagtattgtttactagagcagttttctttaatctacctgaataagatgacttcattgtgcaatttcattttaggaagaagagactacggtatcacattcatttactgcatagatgttatctaatcacaaagcaccttcaaaaccgatacaaattctatgcaacttccttcaaaattaacacattagcatgctttaagtaaacatcagtgtgtaatagctaaaacatgggttttggagtcagaaggagttggcttcctatttcagttctgccagtttcttcctagaaggaacttggggagtccatttagtgtctcagagtcattagtatattttcttggactctttttcagcaccagactcagcgttcacctctccatccacttccttgttataattcctggcattttcatgataattatacagcctggcttcacagtctagaatttttcattcggacactgtctccttgctacttctgttgacctattagtatggtctcacatagaaccaggttattacttatgatccacctccaagaaccccaacttcaaactttttctttctggccatcgtgctccttcatttctgatccttcacttttcttgttatattatcttccatcccactagctctaccctatcttcacaggtcctcagccccttttctctttaccagcttgtctagcagtctaaagccttgttcgacaatgccttctctctccagggctcccctggtccttccattgcctccacctggtaagtcctcagtcccaaacacacctgctgtgagttttctctgctcttcccatcatgagctagtcagcaccaggataattcgattacatacagcagtggttctccaaacatgggtcctggaccagcagcatccacatcacctaagaacttattaaaagtgtacattcttgaaccccaccccagacctactgatttagaaattgtggggctgggacccagtaatctgtgttcaacatgccctccaggtgacgtactacaccttcttgacctcagctgaggtttcttgacaaatctattaactcttcagttgaatgcctgccaaaattttcaaactaaagtgcagattccccaatgttaacaattctaatttagtatatcttagtgcaactcaggaatctgcatttctaatatgcattccatgagttctgattcaggagtgtctgtggaccacaccgtggcaaacattggggaaaaaagaaccctcatggtagtcttctaataccactaacctcaacccatctctcgaaaaagacatggcctctcttttgagctcaaggagttgaaagctcaatccgattctttcctccctcctctgataactcattcaattacttcccacttatgttcccccacatacggaaatctgttttatgtttaaaaacgtttccatgacattgctacacctttggattctaattttattttattccatttcttctttaagtatttgcaagagtgaagtaaccacacaacttacatatcttcacgctcacactcactcacttctaccaccgtcaacacttcactgaaattattctcttgacgtttcctaaagacttcaaaattgtccaatcaaatgaccttgtcagtttacttcctcctctcccattctaaaattttattctgatgaccaccctctcttattaaaactctcccttcgactggcttcccatgacaacaacttctctcggtttcccttctatggctcagatttccccttctctttctctgttttgtggcttccatccctccaattctctcagtgaagagtatgttttccttgctcttctcttttctttttcacatatgttaatcatttttttcactttcaattgagctgtaattgacatacgataaaattcagcatttaaaaaatgcaattcaatagattttgttatattcacagagttgtgcaaccaccatcacggtgtactttcagaatatttttatcacctccctcctgccccctcaaagaacccaccctgtacccattaacagccactccctattcctccctccctgctgcctctggcaaccactaaccttttgtctctacggatttgcttatttgagacatttcgtataaatggaatcatacaatatgtggccttttgtgtctggcttccttcacttagcatgatgctctcaagagagatccatgttgtatcatgcatcagaatttcattctttttatgtccaaacaatatttcattgtatagttatatcatattttatcctttcattagttgatggaaatttgatttgtttccaccttttcactatcataaatattgctaccatgaaattttgtgtacaagtttctgtgtggacatatattttcaatccttttgtatatatacctaggagttcagttgctaggttatattttagctcaatgtttaagtttttaaggaactgccaaaccattttccaaagcagctgcatcattttgcattcctaccagcagtgtatgaggattctggtttctccacatccttaccaacacttgttactgtttttatattttaattatagccaccctaatgggtgagaagtggtataatttcatgattttagtttgcatttccttaatgactaatgacgttggtaatcttttcatgtgcttattggctatttgtatatcttctttgaaaaatatctattcttacttttgcccattttaaaattggactatttttctttctttcctttttttttttttttttttttttttgagctgtcaaagctctttgtgtattctggatactactccagtatcagatttatgtgatttgcaaatatattctctcttcttctatgggttgtctttttactttcttgatagtatcctttgtgtataaatgtttttaattttgatgaggtctaagttatctattttttctttccatgtttatgcttttgatgtcatatctaagattccactggcaaattgaggtcattctctagaaggctgtgtatgctctgaatcagcatctaatatatggtagtgtttctcccgtatccaggattcatgtgtccaggaatcaaggggtagaaggggaagtggcaccactcaccaccaaccctagtgacccactaggaaaatttttgcttcctgttcctgcgacattatgttctgctggcctagaggtcttagttccagagggaggccaccaggagacacaacaatgattccattaaactggaagttaaggtgactacctggccactttgagctcctcctgcctctaagtcaacaggctaagaagggagttacagtgctggttggggtgattgacctggactatcaagatgaaatcagactactactacacaatggaggtaaggaagagtatgtgtggaatacaggagataccttagggtgtctcttagtattaccataccctgtgattaagatcaatgagaaactacaacaacccaatccaggcaggactacaggtggtccagacccttcaggaatgaaggtttgggtcactccaccaggtgaaaaaccatgaccagctgaggtgcttgctgaaagcaaggaaatacagaatgggtagtagaataaggtagtcatcagtacaagctatgaccatgagaccaattgcaaaaacaaagactgtaattgtcatgagtatgtatacacctgtactaagaaaatatccttgttttatctcctttctttttcctttatcatgtgacataagatttattgacttcatattagcatttaaatgttgttaactttctgtattagcatttaggttaagtattaatatgcttccagttgtacaaagggtagctgtactatgttaggtataattatgaccttattattgtctttatttggagattaagtatgatttcaggagatgcgtatgggttcaagttgacaaggggtagacttgtgatggttaatattaggtgtcaacttgattggattgaaggatgcctagatagttggtaaagtattgtttctgggtgtgtctgtgagggtgttgccagaggagattgacgtttgagtcagtggactgggagaggaagacccaccctcagtgtgggtgggcaccatccaataggctgccagcactggtagaacaaagcaagtgggagaaggtgggctaagctggcttgctgagtcttctggctttcatctttttcctgtgctggatgcttccttccatttctcctgcccttgaacatcagaccccaggctcttcagcttttggactcttagacttacacctgtggtttgcagggggctcttgggcctttggccacagactgaaggttgcactattggcttccctgcttttgaggctttttggactccaactgggcaactactggcttctttcttcccctgcttgtggaaggcctatcgtgggacttggacttgtgatagtgtgagccaattctccccaataaattccctgataggatatatatagcctattagttctgtccctctagagaaccctaatacagttttacccctatattttcttctaagagtattaaagctgtagcttacagctaggtctcttatccattttgaattaatttttgtctatgatgtgaagggctcaatttcactttttgtttttgcatctagatatccaattgtaccagcactatttgttgaaaagactattctttcctcattaaactgttctggaaactttgttgaaaatcaattgatcataaatgtaagagtttatttattgacttttaattctatttcatctgtatctctattcttatgctagtaccatgctgtcttgattactagtagctttctagttgattttgaaatagaaatgtgtgagttctcaaacttcatctttttcaaaattgttttggctattctggatcccttgtaattccataaaaacattaacattaacttctcaatctctgtaaaatatccaagtggaattttgttagggattgcattgaatctgtggatcaattttgggagtagtgccattttaataatattatgttttctaatcaatgaacatggaatgtctttcaatttatttacatctttaatttctttaaataatgctttgtacttttcagtgcaaagtcttgtacttctatggttaaagctatttctaaatattttgttctttttgatgctcttataaatggaattatcttaattttgtttcccagttgttcattgctactgtatagaaatacagttgacttttttagactttgctataactattttttggatattgatcttgtattttgcaacatagctgaattcatttattagttcaaataggttttgttgtgaattgcttaggatcttctatgtgcaagatcatgtcatatgtaaatacatacagttttacctcttttttaaaatctgtattgcttttattttttttctgtctaattgacctgtctaaaatctccagtacaatattatatataagtggcaagatcagacatccttgtcttgttcttgatcttagggagaaaactttcaattttttgccattaagtatgtgttagctgtgtgtttttcctaggtgccctttatcaagtcgagtaaattcccttctatttctagtttgctcagtgattttatcttgaagttgtgtttaattttgtcaaatgcattttctgtatcttttgagacaatcatgtgggtttttaaaaatcctttattctattaatacagtgtatcacattgattgctttttgtatgttgaagtaaccttacatttatagaataaatcccacttggccatggtgtataatcccttttatatgttgttggtttccatttgctaggattttgttgagacttttgcatctataatcataaagtgtgttaatctgtagttttcctgtcatgactgcctggtttgagtatctgggtaatactgacaatatataataaaatggaaaatattccctccttttctattgctttagaagagcttgtgaagtttggtgttaatttttctttaaatgtttggtgcaattcaccagtaaagccatgtaggacagggcttttctttgtgggaagtttatttttattaatagctcaatttctttatttattatagatatactcaaattttgtatttctttttgagtcaattttgtagtttgtttctttctcagaatttgtccatttcatttatgtaatttattgacatgctattgtttatagtattcccatataattctttttattttggcaatgtaagttccccctttccttcctgattttaagaatttgcgtctcctctcttttatctttggtcagtatagctaacggtttattaattttgttaattgtttcaaagagccaagtttgatttgtttgattttattcattgtttttctattatgtatttcattaatttttgctctaatcattattatttccttccttttctttgctctgggtttaagttgcttttccttttctagtgtcttaaggtagaagtttaggtaacagatttgctatcttttttcatttttaataaaaatatttacagctgtaaattttcctataagcactgttttcactgtatttcatatgttttggtgtatgtatttttgttttcattcatctcaaagtatatttgaatttccctgtgatttcttctttgacccatttgttatttaagagttggtctccatatagttgtaattttcccaaatttcctattactttctaatttcattccactatgcttgaaatacatactttgtataattttaattcgcttaaatttactaagatttattttatgacctaatatatggtctaacctggataacgtttcatgtgtacttgaggagaatgtgtattctgctgctgttggatgaagtgtactagagatgtcttttaggtctagttgatttatagtgttgctcaagtcttctatttcgttgtggattttctgattcctgttctgtttttgaaagtggatattgaagtctccaaatttaattgttatattatctatttcttcaatgctgtgaagttttccttcatacattttaggactctgttgttagatgcatacctgcttggaattattttgtcttcttgatgaattaacccttttatccttatataatgtccttgcttgtctttagtgacaaatttgtcatcttaactctatttttgtctgatattagtatagccatttcatctctcatttagttactgtttgcatggtatgtttttttttccatctatttactttcaacttttttatatctttaaatctaaagtgtgtttgtaaagcatggacataattggccatctcaacagaggccatgaatagagatgggactattcagcagaaacactgccatgtgagactaaagaaaacaaagaaaatgtcataaaatgaaggaagactgttggacttcttagaccttataggactggaccataaagctatttctatctcttttgatattctctgtttggtcagacctcattctcatatttcctttagttctttagaagtggtttcctttggttctttgaacatgtttaaaatagtttatttaaaattttgtctaacaagtctaatgtctggtttccttaagtatagtttctattcactgcttcttttcttgcatatgagctacaatttcatatttcttctcatgtcacatatttttggttgaaaactggacactttaataaattgtggtaactctcaaaataagattatgccctctccctagggtttcttgttgctgctacttgttgtagctgttattatatctttccttagtgacttttatgaattgattctgtaaagtttgtattctttgacatgtttggccataagtttctgttctgttagcttagcggtcagctaattattggactgagatttccttaaatatctgaaatcagtaattctcccagtctttgcagaaaggccctgtatgtgttttggcccatgccagcaacactcaggaaatttacagccctatcatagcctttacttcctgcttacgcaaaacctcaatgtcagctaaaggtgagtgcttagagccttctcaggctctttcctgtatgtaaacatagccttgggaatgcacacagccctatgtatgtgcatggccttcttggattactaggaatgtagtggatctttccaaagtcctctgtgaacatctcattctctaacaatttcttttgttttttttggcctggttcttgtatgctccaattgctatcactacttcaggcagctgccttgttgaacaattgctgctgattgttttcacaaatgcctccaggaatttttctatactgtctgcactgagtgaagtctgggtcaggtcaaataaaggcaagtcttgcgaatgagggtttacagataactgctagatacatcaactaatgacagttctctaagaatggtgtatttaggagactccaaaaacattctgtcctttcaacttctgctaggctattgggatgggaatagggaaagttaaaatgttccaaagcttactgcccttaatgagatttagtaatttttctttaataaatgctcctcatattgttgcaaccttttggttaatttccagacttctgaaaatgttgattttgacagtttttgccagtgttctctttgcttttatgggggaactggcattacggagatccttactctgcttttcctgttgatgtcatcactgttaatttaatattggctgctacatctgtgttcccatttcacttgacctccacctgaatttcccttgatacatacctcaaatttaataagttgtaaatagaactaatagtctctttcctcaaatttgctcctgcttccaatgttcctgttaaaggctttactgcaaggccagagaaaattaagctggcaaagcagatggaggagtcatcaaaatggcagtaaaatttaattataattatctgtgttaatctggtgctgctgggtgtgaaaggaatgaaaagattatgaattggaaatttaggaatttgattcacaagattgacaccaaaattcccactgcctctgtactctcagactcaattgaataattatttgtgctgtgcaattaattgcttgctccacagaccagctgaattataacccacttcactgaatttcctacacgtagtaggtgctcaataaatgactaatagcataaaacttaagtaaataacataaataggtttcttttattctctcactcactctgtttctctgcctcataaaccagggatcttgtctctttcccagctggaaatttctctaaaaagtcatgaatataattactttttaaagtatttcattgacatgtcaacctgaattatatatcaaagagagtccaaatgagagtttggtatgagatataagacctaatatgatttcatgcctccttgtgggcatttaataaatattaattgtgctgggagccaatctagcaaatgatggctgaatctgttattgcccatcttttacatttcatacctgtatacttgacacagaacactggaaatcaaggactggcattcaccacaatgaaataaacaacaaaattattagcagggaccatggcccatggagctgacctaaaatagtaaagtccttcatttaggcctttaaggaaaaaatggcactgaaagtctcaggacaggcccacatgacataagtatatctaaactattttttacagtggaagatttttactttactgtttccatgtgcatgaatgtgtgcatgcgtatgagagagagaaaaaaaagagacagagggaattgtgtagacatatctgaatgttatattcactgttcctcaagctgaaagctttatacagtaagacaatggaatgtaaaaatgaaataaaaattcattaatagatgcctacatgaaatatttcaaacatttaaacattatgtataattattttccttaaaattaaataaaaaataaatatatgtatttatctgagtaaatacattcttggacaatagtgagttctcatcatttgctatgtgaatgaatgaatgaacaatgaatgaaaacagtttctcttaaaaattaaatggaaatacaatgttgcatgtaggtatttaagtaaataatgtttgtgtcttttgcaaaaacataatcaagtccactgtctagtgtgttacttaatgtcccttattaaaggaaagatattttttatcagtctcttataaaaactgaggctagggtattatgttaactgtctaaagatacagtattatgttaactgtctaaagatgtctggcccaggttcaagtactttttaaaaaattttttaacaagggatagtttacatatagtaaggtgcgtgtatctaaagggtacacaacttgatgaatttttacccactttgagaaatgaaacatttacgtatcagtagactccctcatgccccctctcagtcaatacccttgcccaaaggcaactactttcctgactttttacaacaaaaataaatattgtctggttttgaactttacataaatggaattatataacatgtattcctttctgtatgaatcctatcacaccacataatctacattgttgcgtgtagcactagtttattctttttcattgttgtgtagtattccattgtatcaacataacacatgttatttattcagcctactgctaatggacatttgacatggtctccggtttttggctattttgaatactactctatgaacattcttttgtgaccataaacacatttctttgttgggaataaaactctgtgtcatatgatatgggtaaatttaactttagtagatactactaaagagttttccaaggtgagtctaccaattttcattactactagcaatgtatgagagctccagttgctttacatcacgcgcattattttttaatatatcattcaggatcataggtcctctttgttcatttgcattttattagaagttttttcttctaattctaaaatgatttcagttggtggtggagggttctcccaagtatacattttttttttccaactgagaaacagtttcctttttcaatggaaatgaaggtacagacttctacaaaatatttctttgctctgcaggtctatcaatgagaagaaagtgccaactgaaaacttttagaaaatacccagtttactcaaggaaaataacatgcattgaaggtgattgctcaatagagagaagttgaaacagcagactaattgcctgtttgtgacacccatgtaatcaacttggtaagtaaaaactcaagaataatgttcaatgttctctaaaatgggccagaagcccttcagtgcagattcaggctctctctctttctctctctcacgcactctctctctctctctttcgtttacatcttatggcagatctttcttagggtcagtagagcacatgcagatttcacactatgcactctctctagctgatatctgatatcgagtctcatgggagtgattggagaagaaaaccaagcacagactctattatgctgagatcctcatttttagttgtggtaatttctattatattttatagtgccaaacactacttttaatctggaactttaggtcattatttccattgtggctccctacagtctagctccaactatgaacaagtactagttgttactgttagctcaatcattatttttgctttgtttaaacaacatatactatactcaggagtatattcagttaatggtttgaagtgcatcagaaaaattagatgacattaaagtacagttacttctgaagaaagcttgtggtactatataatagtggagaggtaaaactgtttaacagattaaacattttttcatgcttcagggaaaatttgaaaaacaattctaaattcagagctatttcttagacttttatgttgctcccctaatctgtttattctaattgtaagttagacacttatattctcccttataaattatatcttgacatataggatgatcaatccatgcacatgtggacagtaaaaatggcctgaaattatattttgtgttttgtttcactcagtcatttaacatttgttcatctatcaaatgtcactcagtcatgtcccttagcattggctctgtcaatataatgtggaaaatctagcaagagatcctttatttttcctcgggagcctggtttttaaacagagttatatcttcccagtgaccaccagagtcacatactatccagcagtactcaagtaagaatgctttaagcggtatattatctttaatacctataagtaataaattatgactttggaaatagtaacattttttaaagatacatacaatttgggcttcaaaatgcccagcttgcctatgtcccataaagatcccattaacagtttatctcattaacagccatttgtactcatcagttcaggctgtgttttcccactgagacatcatttacagtgctctaaacatattttcacaacattcacctgacaacatcagctgagagaaaaattttcagactgccgagaaacatcaggaggccatgaattcttaatcaacacaccaaattatgaaaatggtatgtatatctctttgaaaatatccttggcaatagttaatcgggaaaagaaacagtagatagtccaaagactttggctcagtaccctgctccccagttgttaagaggagatttcaaggcgtttgtgtggtggcaaaggttcatgacttctgtctcccttggggattgccactagagaacatgtggaaagaaaaactggttttagttttttgaagttcacaaagaagcagaaacaggctaaccaagaatcacctggtgaaaggtctcctttaatgagcaaataaaaatgatttataattagtacatatacataattttaaaatgagaccacaccaaaaagaaatctattcccttaaccggtaaataaataattcttcttctaatgtcctttagcacatttatttgtacaataatttacttttacatttccttataaagtgacccttaaacttaaaccagagtttctgtattgtatttcactcagattgcatttcactgtgctgggaacctggagatgcctgatatgataacttagggtgtgaattaaatctacagccacatcccttggtgatgtggttggtacccatactggacttccttggaaagcctttcattgtggtctaggtccttgctactcaagcctactcagagtatggtcttcaaaccatcagcattagtatcacttgggaagttgttagaaattctggatctcctaaccagattttataaatcacaatcttggggtgcagtggaggaccagtaattgctgttttaacaaacattccaggagattctcctacatgcaaaatgtgggaagcacttgtctaggatatcgtgttcataaaatcaaaacgatttattttgccacattgcctcacatgtcattgcctttggatgggctgtagcctctatcataaatttacttttctttttctttttttttttttttcactgtagcactccatgagcctttttgtgggctggttcttacttgtcgtttgtgactttctttaaggaattatctccagaccccaaaatgcacttattcttccctccagattaaagtagacacttttctgcttcctcccttggcataccacacacatcacagcaaccatataagcccattgacaattataacacagtataaggtctttccctctactgtggtcaactcctggaaggcagagctgcaactttaaaaaatccctgataataaaaatagagcttgatttttagtagaatattttgttgataaaaggtagaaggaccctcattgccttcagaatcgtcctcagaatacttcatttttgttactgactgaattgctttgctttttatattccctctccatctcctcatgggacagctctctctcctactccaactccaccatgtatttgtttctcccatctgcctagccaaactggtcaaattaatgtgcatcctttgatttgtccagccccttccctgaggcctgctccaagcctccattgtcttttgtcaataggtacagagtggtgggttagaaagaggttggtaaaggagactgcaggtggccatttatcctgctgattaagagatctcgactggtttgatgaagaagcaccattaaaaacaatagactcaacttccatttcaggaaagagtaggtagacgtgcttttctttttaacttttactatatacaactagaaattctgaacattatatagaaaacaaatataagaatactctgggccaagcacggtggctcacggctataatcccagcactttgggaggctgaggcgggtggatcacctgaggtcaggagtttgagaccagctttgccaacatggtgaaaccccatctctactaaaaatacaaaaaattagccaggcgtggtggtgggcacctgtaatcccagctactcgggaggctgaggcaggagaatcacttgaacctgggaggcagaggttgcagtgagctgagatcacaccattgcactccagcctgggcaacaagagcgaaactccatcttaaaaaaaaagaaagaaaaagaagaaaagaatgctctgcaatgtggagagaagaagacagtccggcaatgcagaaatgcccatgagtacagaaaaataaaatccccaataaaagccttctctctctagccaaagtattagagaaaaggcagcacatgaagagagaaaatttttgatactatttcactctagacaaacatcacagataaaactaaggccccaccctcaccagccacagcaaagggtgactggagagccaggactttcatcaccactgagaagtaatgaggtcttccccacattgtcagtggtggccatgtgagaaacactaatgaactacccctgcctctcccagccagggtggtatcagcagagccctactgggcagccagaagtcccacctccacccagcagtaatgaggaaccccttccttctgggtgccaatggaagctgagtgggtaatgtagacataaaacccatctggaagtagcaaggtggtacctgtacttctctttttaaatagtgtgagaggaagcttgctaaaacataagacttaaataagatccagagactcaagacaatgcctaaatgtctaggtttcaatcaaaaacaattcctcatacaatgaaccaagagaatctcactgaaatgagaaaagacaatcaaaggataccaatgctgagatgatacagatgttagaattatctgatgaaaacttttaaatagccatcataaaaatgcttcaatgggcaattacaaacatggttgaagtaagtgaaaaaataaaaagttataagaaagaaccaaatgaaaattttagaactgaaaaataatttttaaaaaactcgatggatggactcagcatgataatggaaggaatagaggaaagaatcagtaaacttgaaaacagggcaatagaaattaccgaatcagaacaagagtgagaaaatagactgcaaaaattaatagaactccagggacatgtgggattataacaaaagattttgtgtcatcagaatcctaggagaggagaaagagagtgaggctgaaaagtactggaagaaatagtggctaaaaactcctcaaatttgtcaagaaacataaatccgcagaatcagaagctgaacaaatcccaaacaggataaactcaaagaaatccatgccaagacacatcataaataaacttctgaaaactaaagacaaggaaaaaaatcttaaaaatagagaaaaaccatatcttacttatgggggaaaacaattagaataatggcaaatttgtcatcaaagctgtggacaccagaaggaaatgacacaatattttttcaggtggtgaaaaagaactgtgagtcagtacatatttatagcagttttatttgtaatagccaaaaactggaaacacccaaaatatcctataataggtgaatagataaacaaaagatggtacattccataatttgaaatattactcagcaataaaatggaatgaactactgatatactcaacaactggatggctctcaagggcattatgttgtgtttttaaaagccaatctcaagaggatacatgcttcatgatcttatttacataagatacttcatgtgacaaaatgatagagataaagaacagattagtggttgccagaggttaggtatagtggggaggagggctaggtatgactaaaaaggtagcactagggagatcattgtggtgggataatagttctgtatcctgattgctgtggtggttacacaaatctgcacatctgactaaatggcatagaagtatgcacgtacattgtatcaatgtcaatttcctgcttttgatcttataatttcattatctgtaaccaccgtgggaaactaggtcagtgtgtgtggaacttctctgtactattcttcacaatgttctgtgaatctttaattctttaaaaataaaaaaaattaaaaaacaataggcttactatttggcattagacaaagagataggaaatggtattggaggtgacagtaagacttcaggcatttcagtgccagagccagagagaactcaagaaagaatatatgctggttgaaaggaatcctggagagagttggaaactttttcttttgtaagcactaggatgcaaagaagccccacattggactgtgaaatccctaacagccatgatcatgatgtgatgtatgtgaccactgcacagaacaaataaaaatatttgtggactgaacaaatgaaaaaatgagagtgtcaggtcctagggagtggcttgttggtggcaggcagaaagaaaagctagaaataggctttgagaggaccaagaattacatccagtctcatgcaggtgcctgtccgaagctatcctaagttaaccttctagttttcagaatgtgtggattctagtgtttcaaagtaggagggagaaaaggaaaaggcttaaaacctcagttaatgtcaaagcagtcaatctctggccagacttgtggtgtcaggatcaggattctgtgcgcttaggcatttattctacttttgtaacttcttcatttccttttagattcttggtgaagttccttataaatttttaatttatcatgactatcgtaagtcagaatgacctgcttatgcccagaagaactcagaagacaagcattgaggccaggccatagcagcgggagtttttcaagctagacatcagggaagaatctaagggagatgatgctgttaatgaggtggaccctcctaaagagagatgtcagagaaagctgtgacctctgctttcattccaagaggactggtcatttttatgggccctggatattgctcagtgtgtagatatattagtccaatctgattttcttgggcctgtctgcaatataaaagtacataacaatagagtaaaatacacgtacagtattgctgctctcatccagtagggatcagcatgcaattcagagagaataagagataacaagaatgtctcataaaatagtcaacaacctattcaatgacttcatggagagtaacaaatacttgatttcaaaaccacaaagctgaagtggccacttgagttttaaaactaatgcaaaatgcattaagaatccatcctaaaacatttttgaagtgaagatcaaatctacatattttcagtcaatgcttttgtaactgtcatgtgaactttaggacatcaaacagtcagatatttattgaatacctactgaagcaaagaattttatgtattaggatcatagaaagaagtaattttgctggaggttttaaaaagtgtgtgtgtgtgtgtgtgtgtgtgtgtgagagagagagagagagacagagagaaagggagagagaaagggagagagagaaagagatgttctttccttcaccttagacatctactcccacagccttaaaagttgcatatgacttcagtccatttatttattcattcattctacaaaattgtctccagaactaactatatatcagatattgtgaaaggataaatggctcctaaatgacatgaaagaaagattcaagaagaaaaatacatgtgagcaggtggaggaaaattcaaaccagggaacaggaggctagaggatggaaggataaaaggggaacaacagaaaaatgtaaccatttctggagatacttaacagaaaggggttctgacatcttgaaagaagttgtacaggcaccagcaaacatgaataatccagtgaccatccaaaaggacagtcagctccttagattgggggttaagtcctccttatttccctttcattaacctatgcccagtatagaattttatccatagtaagcattcaataaatattagttcagtgaaggaatgaataaggaaagttggtacttcttttctgagaaacacagaaatgctatgtacaaatctgacacaacacatttaggggtacactgccttcctacagaatctttcaggacttatcaaaaccacaggctgatgcccaagcaagaaagtcaaagaagtgatggaaacatcctggaaccccaaggtccttcactttttctttacaggatttgacttcaaagtctttagagaaattcttcagttttcttccaggttaggtaaagattacaattttcaaaaagaaaactactgtagcccattgttttctgtctttaagtatttggaagactactatgaataatggaaatgtatagtaggtgttaatatacataggattggggctttggagaagctgatcccaccaaaatacaaaagatcctcaaaaagtattatgaacacctgtatgcacataaactagaaaagtctagaggaaatgaataaattcttggaagcacacaatctcctaagtttgagtcaggaagaaattgaaaccctgaccaaaccaatatcagattccaaaattgaataagtaataaaaaaacttcaccaaaaaattccccacaccagatggattcacagttgaatcagatgtacaaaaagatctagtagtaccaattccactgaaaactattccaaaaaatcaaagaggaaggattcctccatcactctgataccaaaacctagcaaggacgcaatgagaaaagaaaactacaggcctgcatttctgatgaacatattcataaatctccaacaaaataccagcaaaccaaatccaagagcacattaaaaagttaattcaccataataaaatagatgtcattcctgggatgcaaagttggttcaacatacacaaatcaatgtgtgattcaccacataaacagaattaaaagcaaaggctatctgataatctcaatagatgcagaaaaatcttttgataaaatccaacatcgcttcatgattaaaaaaaaaaacctgaagaaactaagcatcaaaggaacctacctcaaaataataagagtcaactatgacaaacctgcagccaacatcatactgaatggacaaaaactggaagcattccccttgaaaaatggaacaaggcgggggctggagccaagatggccgaataggaagagctccggtctacagcagaagacgggtgatttctgcatttccatctgaggtatcaggttcatctcactagggagtgccagacagtgggcgcaggtcagtgggtgcgcacaccgtgcgcaagccgaagcagggcaaggcattgcctcactcgggaagcacaaggggtcagggagttccctttcctagtcaaagaaaggggtaacacatggcacttggaaaaatgggtcactctcaccccaacttttctgatgggcttaaaaaatggcacaccaggagattatatcccgcacctggctcggagggtcctacgcccacggagtctcgctgattgctagcacagcactctgagatcaaactgcaaggcggcagcgaggctggggaaggggtgcccgctattgcccaggcttgctgaggtaaacaaagcagccgggaagctcaaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagctggagatctgagaatgggcagactgcctcctcaagtgggtccctgaccccgacccccgagcaggctaactgggaggcacccccaagtaggggcagactgacacctcacacggccaggtactcctctgagacaaaactttcagaggaacgatcagacagcagcatttgcggttcacaaaaatctgctgctctgcagccaccgctgctggtacccaggcaaacagggtctggagtggacctctagcaaactccaacaaacctgcagctgagggtcctgtctgttagaaggaaaactaacagaaaggagatccacaccaaaaacccatctgtacctcaccatcatcaaagaccaaaggtagataaaaccacaaagatgggggaaaaaacagagcagaaaaactggaaactctaaaaagcagagcgcctctcctcctacaaaggaacgcagcttctcaccagcaacagaacaaagctggatggagaatgactttgacgagttgagagaagaaggcttcagacgatcaaactactccgagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactacatgaagaatgcagaagcctcaggagccgatgcaatcaactggaagaaagggtatcagtgatggaagatcaaatgaatgaaatgaagcgagaagggaagtttagagaaaaaagaataaaaagaaacaaacaaagcctccaagaaatgtgggactatgtgaaaagaccaaatctacgtctgattggtgtacctgaaagtgatgcggagaatggaaccaagttggaaaacactctgcaggatattatccaggagaacttccccaattgagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcaggttacccacaaagggaagcccatcagactaacagcgtatctcttggcagaaactctacaagccagaagagagtaggggccaatattcaacattcttaaagaaaagaattttcaacccataatttcatatccagccaaactaagcttcataagtgaaggagaaataaaatactttacagacaagcagatgctgagggattttgtcaccaccaggcctgccctaaaagagctcctgaaggaagcactaaacatggaaaggaacaaccggtaccagccactgcaaaatcatgccaaattgcaaagaccatcaaggctaggaagaaactgcatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacatgcagagtcacacataggctcaaaataaaaggatggaggaagatctaccaagcaaatagaaaacaaaaaaaggcaggggttgcaatcctagtctctgataaaacagactttaaaccaacaaagatcaaaagagacaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtaaacattagacagatcaatgagacagaaagttaacaaggatatccaggaatggaactcagctctgcaccaagcggacataatagacatctacagaactcttcaccccaaatcaacagaatatacatttttttcagcaccacaccacacctattccaaaattgaccacatacttggaagtaaagctctcctcagcaaatgtaaaagatcagaaattataacaaactgtctctcagaccacagtgcaatcaaactagaactcaggattaagaaactcactcaaaaccgctcaactgcatggaaactgaacaacctgctcctgaatgactactgggtacataacgaaatgaaggcagaaataaagatgttctttgaaaccaatgagaacaaagacacaacataccagaatctctggggcacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaatgaaatagagacacaaaatacccttcaaaaaattaatgaatccaggagcttgttttttgaaaagatcaacaaaattgatagaccgctagcaagactaataaagaagaaaagagagaagaatcaaatagacgcaataaaaaatgataaagggaatatcaccactgatcccacagaaatacaaactaccatcagagaatactacaaacacctctacacaaataaactagaaaatctaaaagaaatggataaattcctcgacacatacaccctcccaagactaaaccaggaagaagttgactctctgaatagaccaataacaggctctgaaattgtggcaataatcaatagcttaccaaccaaaaagagtccaggaccagatggactcacagccaaattctaccagaggtacaaggaggaactggtaccattccttctgaaactattccaatcaatagaaaaagagggaatcctccctaactcattttatgaggccagcatcatcctgataccaaagccgggcagagacacaacaaaaaaagagaattttagaccaatattcttgatgaacattgatgcaaaaatcctcaataaaatactggcaaaccaaatccagcagcacatcaaaaaaagcttatccaccatggtcaagtgggcttcatccttgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctcttatcactcctattcaacatagtgttggaagttctggccagggcaattaggcaggagaaggaaataaagggtattcaactaggaaaagaggaagtcaaattgtccctgtttgcagatgacatgatggtatatctagaaaaccccattgtctcagcccaaaatctccttaagctgataagcaacttcagcaaagtcttaggatacaaaatcaatgtacaaaaatcacaagcattcttatacaccaacaacagacaaacagagagccaaatcacgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacatcccatgctcgtgggtaggaagaatcaatatcatgaaaatggccatactgcccaaggtaatttatagattcaatgccatccccatcaagctacccatgactttctttacagaattggaaaaaactactttaaagttcatatggaaccaaaaaagagcctgcatcgccaagtcaatcctaagccaaaagaacaaagctggaggcatcacgctacgtgactgcaaactatactgcaaggctacagtaaccaaaacagcatggtactggtaccaaaacagagatatagatcaatggaacagaacagagccctcagaaataacaccgcatatctacaactatctgatctttgacaaacatgagaaaaacaagcaatgggaaaaggattccctatttaataaatggtgctgggaaaactggctagccatatgtagaaagctgaaactggatcccttccttacaccttatacaaaaagtaattcaagatggattaaagacttaaacgttagacctacaaccataaaaaccctagaagaaaacctgggcattaccattcaggacataggcatgggcaaggacttcatgtctaaaacatcaaagcaatggcaacgaaagccaaaattgacaaatgggatctaattaaactaaagagcttctgcacagcaaaagaaactaccatcagaatgaacaagcaacctacaaaatgggagaaaattttcccaaccgactcatctggcaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatggaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactggtgatgggactgtaaactagttcaacccttgtggaagtcagtgtggcgattcctcagggatctagaactagaaataccatttgacccagccatcccattactgggtatacacccaaaggactataaatcatgctgctataaagacacatgcacacgtatgtttattccggcgctattcacaatagcaaagatttggaaccaacccaaatgtccaacaatgatagactggattaagaaaatgtggcacatatacaccttggaatactatgcagccataaaaaatgatgagttcatgtcctttgtagggacatggatgaaattggaaatcatcattctcagtaaactattgcaagaacaaaaaaccaaacaccacctattctcactcataggtgggaattggacaatgagaacacatggacacaggaaagggatcatcatactctggggactgttgcggggtggggggaggggggagggatacctttaggagatatacctaatgctaaatgacgagttaatgggtgcagcacaccagcatggcacatgtatacatatgtaactaacctgcacattgtgcacatataccctaaaacttaaagtataataataataaaataaaaataaataaataaataaataaataaataaaatttgttgaataaaatatttatctcattgttaaaaaaaaaatggaacaaggcaaggatgctcactctcactactcctgcttaacatagtaatggaagtgctaatcagagcagttgggcaagagaaacaaatacaaaccatccaagtaggaaaagaaggtaaactatctcttctcatgaatgatgtgattatatacgtagaaatccctaaagattatgccaaaagtctcctaaaaatgataaacaactctagtaaagtttcaggatacaaaatcaattacaaaaatcagtagcatttttatacaccaataacattcaaactgagagtcaaatcacgaacgcaatctcatttgcaatagctagaaataaataaaatacttaggaatacatttaaccaaggaggtgaaaaatctctacaaaaagaactacaaaacaccactgaaagaaattgtacatgacccaaacatgtggaaaagcattccattctcatggattggaagaaacaatatcattaaaatgtccatactgcccaaagcaatctgcagattcaacactattcctatcatgctaccaatgtcatttttcacaaaactagaaaaaactattttcaaattcatatggaaccaagaaagagcctgaatagctaaagtgatcataagcaaaaagaacaaagtcggaagcatcacattacctgacttcaaactatactcaaaggctatggtaaccaaaacagcaatgtactggtacaaaaacaggcacatacaccaatgaaacaatatgtagaactcagaaataaagtcacacacctacagccatctgattttggacaaagtcaacaaaaataagcaatggggagatgactccctattcggttaattgtgctggagaggctggctagccatatgcaaaagaatgaaactggacccctacctttcactatatacaaaaattaagatgaattaaagatttaaatgtaagacttcaaactataagaattctagaagaaaacctaggaaacaccattctggatatcagccttagaaaagaatttacaactaagtcctcaaaagcaattgtaacaaaagtgaaaattgtcatgtgggacctaattgaactaaacagcttctgcacagcaaaagaaactatcaacagagtaaacagacaacctacagaatgggagaaaatattggcaaaccatgaatctgagaaacatctgtcatccagaatcgatatggaatttaaacaattgagcaagcaaaaagcaaatgaccctattaaaaaattggcaaaagtcatgaacagacacttctcaaaagaaaacatataaatggccaacaaacgtgaaaaaatgctcaatatcactaatcatcagagaaatgcaaatcaaaaccacaatgagataccagctcacatcagtcagcatggctgttattaaaaagtcaaaaaacaatagatgctggcaaggctatggagaaagggaaacacttacacactgttggtaggaatgtaaattagttcagccattgtggaaagcagtttggtgatttctcaaagaacttaaaacagaagtaccactcaacccagaaatcccattactgagtatatatcaaaaattctaccaaaaagacacacacattcacatgttcattgcagctctattcacaatagcaaagacatgaaatcgacctcggtgcccatcagcagtggattcgataaagaaaatgtggcacatttacaccatagaatcttacaagactgtaacaaagaatgaaatcatgtcttttgtagcaacatggatgcagctggaggctattatcctaagcagattaactcaggaacagaaaaccaaatgccacatgttctcactaaacactgggtattcacgaacataaagacagcaacaatagacactggagacttctagagggagagtcaggggagcaagggttgaaaaactattgggtactatgctcagtacctaggtgataggatcaattgtactctaaacctcagcatcatgcaatatatccaggtaacaaacctgcacatgtacccctgaatctaaagtcaaagttaaaattatgaaaataaaaaataaagtctttagcttaaaaaaatgaaaaaaaaaattctaaatatttcttgccttttctatatctttagcttttatatattttctggaagattgtattgactttatcttccatcttcaacatactttttagaaatttcagcaattatgttattcatttattttataaagctctttcttgttctttgttcattttcatggtctcctttttctatcaattaaataacattttaatctttcaaaatactttttttattattgtgcatttatttggatctctctgcttcatgatatacacttttaaaaaatacctggtgatatgtggtaaaaagaggtaaaaaagagaaagaaaaataaaaccagactgggagacttaggtaaattatcttctaggtagagggataattttttattcattattatgattttccctgaaaataattccaaccacagtcatcactggtcactggcttgtggcaatcgggcctcagtgggattttacctggaatgagagagtcccatttctgtgcaaatttttacttcctttcattgattctattaatgcctcatttaccaatgatcattagataattatactatttcaaaaatagccttgcttgctaaagagggactaaaagtgttttcacagtaagattagcttattttgcagagataatccaccttgtagtagtcatggaaaataaatgtaatgttagcggtgccagttgctttttttctgtattgtgaaactgaatcatcaattttgaataatgaaactttaagctacataagaaatatcaagcttgttcattcatgttcaaaacttacaaccaaatacctttgtttcctcttcacatttgctccctaattatatcactggcctctccaggtgtatgttttaactcctggtttctccaaaatggatatctgacattttctaaaaccctctatgaaggggcattcctgtggggatatatgttttttgtgactctagggccgtatgagaagagaaggcatttggggatccctagacgctgattctactccctctcatgaagatgagatgtcaccttgatgatgctgagtttgttttacaaattggctcttttggttagcattctagctgaataaaagggcctactcaaactgggcaatttgaggaaagtgtaataaagggaatatttttaaattcatgggcatagggataagaaaaccaacaaacgatagtgtaggtctccacatctagcaacagtggggacccataaccatcattagacctgaaagtgcaagaggagggcacagagacaggatctatattaagagggcagcctgacagcaacagctttccataaaaggaagcagccaatccatggtgatcctgtagagaggcagccagggaagtaaaatatcccagcctgattcttctttcatctttccgtctcagccagtgtctctcattggctgaagccaaccagaagccaggcaatgaagcctgttgacagagttcatacaggtcagtttcctggagtgcagagaagggtggggaaggccagagtggatttgagacagacgatggaaaatattcagcacaccatgaaaagctcatgcctgtaaacaatttcttaaacagagtagttggtgtcacttcttccagaatgataatgtaagtccatgaattcagaaggaagtagtatagtgagatctggattatttctcaattctggaggactacctgcatggagaatgacataggcagtttcatattctgtagaaaacccaggtatgaccggaaagccatgtgaagatatattacatctgctcatactctgcacggtcacctcattctatatacttggtaaaattattgaaaacttttatcctaagtgtatatatgtctgtctgtgtatttagttttttcttcccattaattcacaatgtacctgaaacactataccttcatatttctcaaacacataaatatttcacggtacacatatacttattctttaaccatagaaatagataccactggctgggcgcggtggctcacgcctgtaatcccagcactttgggaggccaaggcaggtggatcacgaggtcaggagatcgagaccatcctggctaacacagtgaaaccccgtctctactaaaaatacaaaaaattagccgggcgtggtggcgggcgcctgtagtcccagctactcgggaggctgaggcaggagaatggcatgaacccgggaggcggagcttgcagtgagccgagatcacgccactgcactccagcctgggcgacagagcgagactgtgtctcaaaaaaaaaaaaagaaaaaagaaaagaaatagataccacttaattctgctaaagattatactttatgaaacacggtggagtatgattcatttgattactgttgacactagtatttaatttccataattaacatccatactcattgataatgttaataaaagcatcctaagtgtctttggatggagagggaaccctgggtagtggccaagtgaaggtaggagagacagctgggagtaaaagaaacggatgaaaaaagggaaagtatttgaagtagagtgctgaatttctattgctgcagagtaaatcctgacatggctgcattaacttgggataaggattgttagccagaaacagatctaggttttgtgggacctgaagatgatacaatttgaaggatcctctttaagaaaaacaattcaaacttataaatgtgaagttctatatgaaagtaaaatgtcttgagaaattgcatcgaataaattttaagaaattaacatcacaaacctcaaagaatcttgaaacacaacataatattactataaattagctgccttacatatctctataatacttttctttttatattttggctgtgtactcctttatttcctcttcatatgcaacctttttataataccattttctataaagagaatagaaggtaattcagtctttcctctagtgtgtttttgttcctctatctttatatttcccatgctggacactatagtttgtgttcttatttcataaaaactttggcccttcattggcatagtagttctgggttagttggcacaatggatggcagaagtatttctggaacccattcttacccttgattggctaacaatagcttaactctacgcagtgactgtctcccgcataaatatatctcgctaactccaaattaaaattaagcccaactcaagttccctctgaaatgtctgtgcccactccattgctacctgacatgagtagaaatgtgacagaatggaaaattgtcataaaaatagtcagtggttttagcagagcatgattaaactatcttattttgccattattccaaaatacataatgttaatacattgcttatgcctcttctatggccttggaaaggaactgtgtgagttttacttgcttcatgataaatccaactttaggtaattgaaataaactgcacagtgcttcaccttcctcctgtggaggtgacaagaggaggattcagtgtggagtcaattctgctgcttctcccatagagtgaaggtagaattgggaaattaaagttctcatttttgcccattcatcactcatcctggcagggggcagggcatggggtttggcggggaggaatgcttgtaatactagctatgataacttattcatgtattcaatcattcaacatgtatttgatgattatgtgccaggcactatttgagataatagtgtcattcctatcacaatggtgagtaaaacagatgcaatctctgtcttcagtgatcttaaagtctaaaggaggacagacaacttacctttccatctttgagtaaaacaaatatgtgaaaagtaatagaataatttgtcttaccatcctgtccatatcttggcacaaagcactggtaatcccagaaaaataattctctaaagtcccattcatggccttggtatctgtggtctctttctgttcctaaaacatggcagaaagggaaggcaagaactccaaattggagtggagagtgtagaacctgagaaatcaacccatctccaagtttttgttctttgcagtcttgtgcttcattggattgtggacaatatagaaggggtataatttcctatattcaaccaatcagtgataaaagattaagagaataggtaccacatgaagcttctcttcttctagtctctcatgtcattcctatcacagtggctgtaaaacatttgttggcaatgtgaaggcttccgttattgaatagagaggaagataaaagatttccctctatgttcattcttgccacagactttcagaaaactatctaatttcttagcacctcagctgcataccagtgaaatgaggtcaactatacaaattccttacttatctaattgggatacaaactgctgcaagaattacagctgtgaagtagtgggttccagaggacttgtctgcggttacagaaaataggcagaactccgtgggccctcaagaaagaataaccatacaaagttgtacatacctaaagaggaataatttttttttaaagaaaatccttaggcagaaagggtttttaatcaacattgaatgttgaatcaatactaaaatcagtactctctatggccaaaccatgcatactgctctcattggtctctgattgacctttttgtcttgagatataccttcacaggaatgtcagtattctggaaatggtgatgggaattctactcccaggtaaaaactcaatgaggtaatgaatatgcaaatgacctattgtatccaccatgcacattacatttcttaaagtctgttaagctctccctaggccaagccatgtgatctttggatgagtcaaagctcaggaaaaaaacactgagtttgaatcctcgctctgcaactttctgggttcctgtgaccttgggcaagttatctaacagctgtgaacttgagtttccttggcctatgaaataaggatagcaataactcttgcagaattgcttaattatttaaaaaatttatactcatataaagcatgtgctataaagcaggtgctcaatgaattgtaagtattactaattataaacttcagcacaagaataagctttttaaaattattttttctttccagtatttaaactttgggctgggagagattttatcgtaagattattatgatgtgtaaacatgaaccaacttctctatagcaattattttgctgggaagtaaacaaggtcataaatcaataatgactcttgcaacctcaggacttattgatcttgctgtttgtcttctgtaatgttcctggaaaacccaattattttgggaagttatccaaactagtttacccagtattctatattagtgttattagtaacaagttatgaaagcgtttgattgattttcttggaaaacaatccctttatagtataatagagatatttattcaataaatgtcttagcatattacatttcttaaaaagaacaagttgagacaagcagctagagattctagaatcatgtgcttcttttaaattccacttttctgggcaccatggtcgagagtgcaaataagcactttaggaaaaattctagagatatgtgagtcctgtctatcttatggggctggccattggcagtaatttaaagtagaagtatcttttaatatgtctggtgttgttctccaatactcagtatagtgcttggtgtggagtaaatgcccagtaaatgttggttagatgaatgaataaatgagtgaatgaaagtataagcaaataaatcacaaatacataagtacttacccactgtaaatgcttgcgaaggtggctctactttccttctcagtacaaatgttttcttggatttatagtgatgtctaaaaggcctatttcattaacactgaactctattggcaaattcaactgcctctctgttccctttttcaatttagtctgtttgataagaagtagtcactaagatgcataagacttttctttatgatggtgaggtggcttgaatttgagcctaatatttggaaggccaaagggaactatttattaaaacaaaatggagtacagaagaagttaatggttccccaaatttgtctgatggaagaatcacttgatgtacttgttaaaaatacgaattcttaggtgtcagccaagaatctccaaaagcaatataccaagtgcttcttatgaccaggcaggttgggcaaagactgggatagggtatgactgttaccttgctatcagaagaccaatggagcttgcttgaggtaacaattttccttaacttctgttttctcagacttaatatagggatatcagtatctccccagaccacatcaaagcgattctaggagaatcgtaagaggattaattttcaaacctttatactgtatgcaaacttttgaaatctatcctgaagatagtaacaaacccatcagaattgcaatgtttctgtgagaagacaccttcatagtttgacaaatccttgtttggcaacctctcatgtgacctttccaaaatcactatggccaacccacactaactaggagctcccagcctaccttgtttgtcactatttccctggaaatgagctactatatttgtgcaataaataaatatttaaatgtagcaaaatatgtgtctttgccaaaggaaaacaagaacctagtctattagcaggttactattagaaattaatcatttatatttggctgattttcttgtctagactaatattctgtcattagcaaatgctcctacaggtatattgagaagaaaataaaaataacaaaaacagttgtcactacattaataaccattgtaatattaatacctttttaactcagtatgtgtccgggcattttcactagaattgggaatttgcattactggaataagacttctgcaatgtaaaaatgaaggtgataaatgtaatgttaacctagccaagaaagtacgcttggtcccttcatggttattgcctaataagatccaggcatgaagaaagattttccctttattttaacaataaaaattattattaataaaaatatgagaaaagctttgagctaagtgttttatatgctgtatttctcttaaacttcatgacatccttctggagcaagtattattattatcatcatcattttacaaatgaggacattgaggctaaaaaagttataacttgccagaggtcttgcagctaaatgacaaagtcagaatatgtattcatctctgtaaaactccagaagccaaattcttaattaccatcatttattgatttttaaccaaaaacaaatagaaacttaatagttcatattcctggtttttaagataatgtatcttcatttatttatatttcctgcctgattttctttaagatctcaagaaattggtaatggtacaattaccaattgctttaggctaaaactattttttatttaaatagccatttctaattattgttattaataaacaactatatatttatatatgtatatgtattaatatatgtatatttgtgtctgtgtatataaatatgtattcatattgtataaatatgtattcataatgatgtgaaaacaaaaaactcaaattgtaacatctgttatcttcattctgaagcctttcttcttctgggtcttcctagtttaaatatctatcctagttgctgctaggtactagtagttggtgaatgatcctaggtttgtgctcagatttgactgaacagctttctcaagagattacaaggtgactttatccgggtttaaatttcaatgttgatgcatgttggattttctggaagcataggggagatagaatttggcataagaagtatttattagggagagggaggaagcaggattaggcagagggagacgttgaacagcaaagcagacttggcaaagccttggcagaccccacagggggcttaggggaccatagggccaatcggggttgcctgatttagcaaataaaatacaggacacccagttaaatcaaatttttgataaaatcacaaatcactttttagtatgtgtatgtcccatgcaatatttatcccatgcaatattttgtctggcaaacctactcccattggaccaaaatgtctgggtgtttatatcccaattttgatcagtcattggatgtagccaaggccaggaaagatacaaccttgggagaggtggctttttgcagtggaggcagaccctgaaggagctgagagctaggcaacaaacccttccacaaaaggagatctgggaggcatgtgtctgtgttcaccactaatttatagccacgggaagtctcaaggcaactgaaagctccagaaaaagggttttaatgaagggattttagcagctctgaattttgctgcttagtggtggatttgcattgatactacagaggatttacctaacgagaaagctcttctcagtcaagtgtataagcagtgagactggacacatatccatggaagaaatatgacaaccgaaaagtttggagcagggccagctttatgggtgtgtgaccaatgcagtcacacagggcctgggctcggaagggccctgaacttgatttaatgctttgatgactctgtcttgaagttattggtaattttatctcttttattttgttagtgaattctgatggacaaaggaacatgcatgtgagcagggaagaagcacgcacgatatgtgtgtgtctgccattgctggtgtccctgttcacatgtagttttcatgatggcacatgagtccccgattcctgtggattagctatccatgggagttcagtgagactcagagtgaatacaagataagcaggctacatttacgaacaataggccaggacactgacagccccaggaggccatgttttctatttgaattagagctttccttgaatgcagaaggaaggacattgtattctaagaaatacaaatcaccaggaaaatctactatattctttcttattcacattatattctggtattagccaaccacttatgctgaaaatgatgacaaagaaggaaatgatgagcaacccatagttattttttcttttctctcagacctttctaactcactagtaagctgagggtagagagtgctggtagaatgtgtgtgtgtatgaagaagtgaaataaaaacagttaagttcatttttccagtgtttctactgttctggtaagaataaaatacatatgcatgtatgaactatgaaatatatattgggtgtttttagtgataccacatatgaattaaatgttcttatatttgcagttaaaactagcattgtacaatataaaagtgaacagtaaaattcatgcaatagtttaaaatttgaatttttctttgcttagaatcacattaaatggctgataaaaaatcttagcaaatcaagaaagaaactgcagaagaaaggaaaaggctttatcttttagtatctttatagacactttttgaacaggaggccctcattttcattttgtactggggctcaaaaattatgcagcttttaggtcagacaaataggattagcaagtataaatggagtggagtgaggcgaggattctgaaaaacagttttaggagagattctggtcttccaggatcatgactgtggatggatggacttgcactacttctaacaatttgttatttgtatcttgtgacctaacatgccagcaataaagaatgctctttattctgtgatcaattatcaaatatttattgagtctgtatggatatagcaacgtattaggatatatgaaagggaaaaactggtggtgagttacagggacaataaatatcagctaccctcaaggagcttgcattcaaataattgacttttctaattatttctagattccaatatgtacctacatcatagtgcttgtgcacataaacacatacaaacacacacccctgacattttccttctttccctcttaaccatattttgttccctttctctttcagctctctggacattgctaggatggtgatgatgacgataatagtgaacattattataagtactttacacatattaatccagttaatccacataatagtcctgtgagatctgtgccattttagtctccttattataaatgaagaaactgaagcccagaaaggttaagtaatgtgtgccccaaatcaaagagctagaaagtagatgagccagagtttgaaccaatatggtctccactatactaaactatgaaatttcctcaaaattttaggcaatagtgaccttgagcagtggtcttcaaatttacatatgtttattgcagcaggagagaggtactaaaaattccagcaaagttttaggaaattattatttccagatcctcagcctcattgagctcctttttaagtaagtggtctgccaagaacaaacctgaagttgaggctggttccctttcccacctcccctttcgcaatacccattatcccttcttagagaaaaaaggccctcatgctaaatgttattatagctcattgtccttgggtataacaacctcccctctgagtaccaactgaagggtaatttaaagtactggtaataaagttgagaaagtgaatgacttttaagactgtgtaacagtatcatttataatgcaggagtttcaaattctttattatcaataaattaaaggacataaacagagtactagctgataggttattaaaaataatttttgatgataaaacactatgtgaattttgttgtcatataacttagaatgagtttaagaactaggtgatggttttatgacaaatccattctcattcttttatttaagtgacaagttttctcagggtttatgtttatagaaacagatcagagaaagtgagttcttgttgaattatttcattctaagaataagtaccattcattcagagatacataaattaattgtataaatgtaatgccatccattcattaaaaagcacatttctgttaagattgtacttttgtttaacatattaaaaaaaactcaacatccctgatcattagagaaatgtaaatcaaaacaacaatgagataccatctcctgccagttagaatggctattattgaaaactcaagaaactacagatgctggcaaggctgtaaggctgtggaaaaatagcagcaattttacactgttggtgggaatgtaaattagttcaaccattgtggaagacagtgtggtgattcctcaaagatctagaaacagaaataccatttgacccagcaatcccattactgggtatatacccaaaggaatataaatcagtctattataaacatatgtgcatgcgtatgttcattgcagcactatttacaatagcaaagacatggaatcaacccgaatgcccatcagtgatagagtggataaagaaaatatggtacatatacaccacggaatactatgcagccataaaacgaaacgagatcatgacctttatagggacgtggatgaggctggaagccattatcctcagcaaactaatgcaggaacagaaaaccaaacattgcatattctaacttataagtgggagctgaacaatatgaacacatgggcacagggaggggaataaaacatactggggcctgtcaggggatgggggaagggagaacatcaggataaatagctaatgcatactgggcttaaattttctttaataattgtttatcaaaatctgtaatgtatttgttgtttctgatcattatttctaacaacaattgtaatgacaattcaaccctgaagaaaattttaatatgtaatgttgtttgatcaaatgaagtttttaaaaaatagatttcaatttaaatatgtatatttactgcatagaaaaaataggttattaaaagattttgaaaggtaaaatatggaaatagtataaaatttctgacagttaaaaaagagcttgttcacataatgatttttcaaataaatgatgagtaacactatagtaacagaatcgaatggatacctttaagaatgatgtgacagttcgtttaaaaatgtccaaatgtaaaagatattcttcatacttgcttaacattataatgaaacaatttaaaggtcaacttaaaaatatataaaggggtatttagtttaatgcaactttttataggtatactaacataaaagttcgaagacctcatgacctggggaaattatcttgtaacctaagtatgttatgttcaattcatctccattacagactacacactccttcagctctttttaatgcccaaagcattctttgaagtgatgaaagtcttgtgccaagaagaaagaaagtattagagaaaggggtgatagaaacccatcaattgtagtgtctccagaggggctgtttaaatgagcaatcaattttattcttctcttcatcgtgttcaggaaactttcagccttcttacttatttaatttgaaaattgcatctctcataattacttttggacatacatacagcattgataagtaaaaaagtatttaccttataacttcccactggtatagccctagggaaaaacaagaataagattttataagtgagaaaattaaacaggacaattgttttcaccttggaaatggaaagcaagatgaccaatagaggtgtaaccaagatagaatgaggaagcgaatcctttctgactagttgtgtgtgcctaaagttacttatttaacctctctgagacttagtttcttcaaatagggaacgaagtaatacctgtcttagaagtttctgtcaggtatgaatgagattaaatgtgaagagcttggcaaagtgtccaatatttttaaaatgttagaaatctgtggagttggctagggaaggaaagaaagaaatttcttgaaaaaaaagtaaggtcaggaattcactttaatatatcagcggtttcctattctaagtaatgccctttaaaggctatatgattatttcagagataatagtcattgctaagatatttttgtaatttctccttggggattgtcttccaaacagtagtttagaatatcctctcttaaaggtttaaaagaggatattctaaacttttaagaaacttttttagttagttgtagatttgtatgcagtcataagatagaatacagaaagatcctgtgtacctcctcccctaataacatgttccaaaactataatacaatatcacaacgagagagatgcaatccactggtctaattcagatatccccggtattatttgtgttcatgtgtggatatttgctagatgaaacctttcataattttcagttatcaggccctgccttcctaatgagaatctggatcagaatttgaggacccctaaaaaggaaaacagatgaaaatccagcaaaatcttacttcttggtaaaatgatgttattacaaagttgagaaaatcttcttcataaaatacgaaaaccacaaagctggaaagggaatgtttgatataatagagtatatcaaaactaaaactttctatacaagaaaataaaccattaacgaagtttaaatacaacatagaagctgggtgaaaatatttgctacagatataaaagacaaagctttagtattaagaatagacagaacgattctgtgaataaatatgaacaaaaacacaatagaaaaatggggactatatgctaacaattcatagaaacaggttcttttctctcagggtgttaaagccattattctactgtcttctggcctccatggtttttggtaaacaaacaaaacagacaaacaaaataaaataaaaaacccgaataagttttttctgttgtttttatttattttgtttttttaattttttatttccataggtttttgggaaataggtggtgtttggttacatgactaagttcttcagtgatgatttatgagattttggtgtacccatcacccaaacagtatacactatatccagtttgtagtctcttatccctcaccctcctcccacccttttccccaagtccccaaagtccattgtaccattcttatgcctttgtgtcctcatatcttagctctcacttatgagtgagaaaatacgatgtttggttttccattcctgagttacttcacttagaataacggtctccaattccatccaggttgttgctaataccattattttgtttctttttatggctgaatagtattccatggggtatttgtgtgtgtgtgtgtgtgtgtgtgtgtgtgtgtgtgtatgtatatagttggtagtattttgttaaagacttatgtgtctatattcatcagggatatcagtttgtagttttcttttttgttctgtcctttcctggttttggcattagggtgatgctgggttcatggaataatttaagatggattccctctttctccgtattgtggaatcatgtcaataggattggtatcaattcttcttggaatgtctaatataattcaggtgcgaattgtgtggtcctggacttttttttggtggcaagttttcattaccatttcaatcttgctgcttgttattggtctgttcagggcttctaattcttcctggtttaagctaggagggtcgtatctttccaggaccttatccatctcctccaggttttttagtttatgtgtgtaaagctgttcatagtagccttgaatgatcttttgtatttctgtggtgttggttgtaatatattccatttgatttctaattgagcttatttggattttctctcttcttttcttggttaatctcactaatggtctatcaattttatttatcttttcaaagaaccggctttgtgtttcatttatcttttgtatttttttgtttcaatctcatttagttctgctctgatcttggttatttcttttcttctgctgggtttgggtttgatttgttcttctttctctgtttccttgaggtgtgaccttagattgtctacttgtgctctttcagtctttttgatgtaggcatttagggccatgaactttcctcttagcaccacctttgctgtatcccacagattttggtaagttgtgtcactattattgtttggttcaaagaattttttaatttccatcttgatttcattgttgacccagtgatcattaaggaacagattatttaatttccattatttgcatggttttgaagtttccttttggagttgatttccaattttattccactgtgatcagagagaacacttgatagaattttaattttcttaaatttattgagaattgttttgtggcctatcatatagaatagcttgaggaatattctatgcgctgatgaatagaatgtatattctgcagatgttgggtagaatgttccataaatatctgtttgttaagtccatttgttctagggtatagtttaaatccattgtttctttgttgactttctgtcttgatggcctgtctagtgctgtcgatagagtattgaagtcccccactgttattgtgctgctatcatctcatttcttaggtttagtagtaattgttttgtaaatttgggagctccagtgttaggtgcatatatatttagggttatgatactttcctgttggatgaagtcttttatcattatataatgtccctctttgtctttttaaactgctgttgctttaaaagcttgttttgttcaatatatgaataactactcttgctctcttttggtgtccatttgcatgtaatgtctttttccacctctttaccttaggtttatgtaagtccttttgcgttaggtgagtcttgtaaagacagcagaaacgtgattggtgaattcttatccattctgccattctgtatcttttaagtggagcatttaagccatttacattcaatgttagcattgagatgtgaggtactattctattcatcatgctatttgttgaataccttggtgtgttttttttttttgtttttttaaatttactgtgttgttgttttataggtcctgtgagatttatgctttaagggggttcagttttgatatagtttgaggatttatttcaagatttacagctccttttagcagttcttgtagtgctggcttggtagtggtgttttctttcaacatttatttgcctgaaaaagactatttttccttcatttatgaagcttagtttttctgggtagaaaattattggatgataatttttttttttatggaggctagagatagggccccaatcccttttaacttgtagggtttctgctgaaaaatctgctattaatctgttaagtttttagttataggttacctggtgcttttgcctcacaggtcttagtattccttcctttgttttgactttagataacctgatgactatgtgcctcggcaatgatctttttgtgatgaatttcccaggtgctctttgagcttcttgaatttggatatctatatctctagcaaggctggggaagttttcctcaattattccctaaaatatgttttccaaacttttagatttctcttcttcctcaggaatgccaagtattcatagatttggtcatttaacacaatcgcaaacttcttggaggctttgttcatttttttaaaattcttttttctttgtctttgttggattgggttatttcaaaaaccttgtcttcgagctgtaaagttctttcttcttgttcgattctattgctgaggctttccagtgcattttccatttctgcaactgtgtccttgatttccagaagttgtgattgtttttcatttatgctatctatttcattgaagatttcacccttcatatcttgtatcttttttttaatttcattaaatcagacctcacctttctctggtgcctccttgattatcttaataataatcaatcttctgaattctttttctgtaaaatcagggatttctttttcatttggatttattgctggagagctactgtcattttttgagggtaataaacttgctttgtcatattaccagaattgtttttctggttccttctcatttgggtaggctatgtcagagggaagacctggggctcaagagctgctgttcagattattttgtcccatggggtgctcccttgatgtagtactccctcccttttcctagggatgtggcttcctgcaaggtgaactgtagtaattgtttttttctcttctaaatctagccacctagcgggactatcaggttccaggttggtaggcatctgcacagactggtgtgtctgcacagagtcctgtgatgtgacccatcttcaggtctctcagctgtggatagcagcacctggcctggtggaggtgttaggggagtaaaatggacactgtgagggtctttagttgtatcattgttgtttattacactagttttgtgctggttgacatcctgccaggaggtggcgctttcaagaaagcatcagctgtgatagtatagggaggatcagatggtgggtggggccctagaactcccaagacaatatgacctttgtcttcagctaccagggtgggtagagaaagacaatcaggtgggggcagggttaggtgtgtctgagctcagattcttcttgggtggggcttgccctagctgctttgggggatggggttgtggttcccaagtcaatgaagttatgttcccaggaggattatggcttcctctgctgtgtcatgcaggttgccagggaagtggggaaagccagcagtacaggcctcacctagctcccttggaatacaaaaggctggtctcattcccaccatgcccccgccaccaacagcacaaagtttgtttgcaggcagtgggtgagcaggaagcaagcagggcttcagatttcacacctccccacctgcccatgtttgcactccagatttacccccttcctcgagttctgtctaggaaactctgcatttggttggaattcttaacaaagttgagctggagatttctttctccctgtgatcttttcccagttcctctggcagcccttccaaaggaccactgtgatataaaatcaaaaatgacttccctggggacccagagagcccacaggaatcttcccactgcttcctctactcctgtattttgcttggctctctaaattatctcagccccaggtaaggtcgaatttttcttttgtgatctggaccttcagattccccagtgagggtgtgtgttcggaggcagacaatccccctttcccactttcacacttgggcactcacagtatttgggctgtctcccaggtcctgcaggagcaatccacttccttcaaagtagctgtggattctcttggctttcctggtatgtgcctgtaatagtttttggagcaaaagttcacaatgtgaatttccacaccctgctctgttcatttgagtgggagctgcaatttagtcctgcctcctgtctgcctttttcccctgcataagtcatttaaatctttgttcccctgtatgtcatttttctctagctactttcaagaatttttctttactttcattttcaaaagtttgattatggtgtgtctaggcatattcctatttgaatttgttttgtttggggtctgatgagcttcttaaatctacaaatgtctgtattttactaaatttgggaaaatttgtctcattatttattcatatagttgttgcatgtcaattgttttttgcttttattctggtactcccaatgacatatatgtcatgctatttggtattattctacaaataccagaagctctgttcaatattcattatttttttctctgttcctgagattgtatattttctattgctctatctttaaattaattgactcttccctgtcatatccattgtactactgaatccccatccaatgattttaaaatttcaggtattatagttttcaattctagaaggtctatttaattatattttatagcttatatttctgttgagaactttttcttcctatatacttcaaatatatttacctttacctcatggaacacagttaaaatatctggttgaaaattaatttttccccaatatttaggtcatctggtgattggcatctgatggtcatcatttttcttaagaattgatcacatttcctctggttctttgtatgttgggtaattttaaattgtattacgtacatgtgttctggtatacagactctgagccctgttatagtgttctgaagggttattttatttttgtttgttttgtatattaacccagttaggttcaaattgcagtttctgtgttacctgctacgtggtttcaatctcagttcagtcttctagctaggcctttgctgttctggttttggttgggtgcacacatgcatagcccaagaatgatcctaagattatgtgggtttatatacagaattaggaaatccctttctttgcttctcttctctccagggttctccttacactctataaccccaatgttctctttcctgatttctctagccagtaagatgagctttctatgggaatagtctacactattttatagttttaaaaacagcctactctcagggcaattctgtaagataaaagttatttttaaaactccgaaattcaaacccttgtgggttatttctctaaatttacttccctccacaatctgcctgccattatttattctttgaagtcctcaggtagttggttttctctgtgttttgtccagtttttagttgtaatcagcaggattttgacatagcaagacaaaacagacctcatttgtctttttttaaaaatcataatcatgttaaagtatttgtcaaactgtcccataatatgatatttgctaattatcaattatgttggttctctttattgctaaaagttttcctcagtattttggaattttgttttgtaaactcattatgagagagtagttttagttatctgtctttttctctctctcatttgattgatggaatctataacttaaagtctatgaactattcaatgaacattcacataagtgtagtacttctatactattaccaatagtaatattagctaacatttgtatatcttttactatctaccaggttctagttgaaatgctttacatcaaatttttgcattttagagtaatgttttatatatctgcaaaatattgtgctgggattttgatagaaattgcattaatctatagatcatttgggaaaactggcatctttactatgttcagtgtttagtgaacacagtatgtctcatcatttatttagatcacctttgatttgtttcaacagaattttatacttgccattgtacaagttctgcacattttttgctagatttatacctgagtatttcagtttttgagtgattataaataatgtcatgttttatcttttggtttccatgtgttaattgctagtatataaaaatacaattaattttggttatttgtaccttgtgaatgtgctgacctcagttatttgtaaaagttatttgggggagcatttttttttgttatgttttttgggattttcaatatagaccatcatgtcatctgcaaatagggatggttttatttctttcttttcaatgtatatgccttttattttattttcttgctttattccactggctagaacttccagtactatgttaagtaagagtggtgtttcaaggtatccttatttagttcctgatcttagggcaaaagcattcaatctttgattattaagtattgtggtggctggagggtttttgtagatgaactttatcaagtcgaagaagttctcctttatttctagtttgctcagtttttgtcatgagtggctgttaaatattgtcacatcctttttgccttgattgatatgatcatgtgatttttctacccattttaaaacacaatggtacatgaacatccaaatttggtgaagataaattagagaaaaatcatttgtttgaccaaacaattgaattctttagtaaaaaagtcttctagggcatttaaaatttgatgtttttattttatcctttttagcagcatatcgactatataaatccagctatacttattcattattactgcctacattttctggaattttctagaacatgtagaattttctagaacatgacttacaaaaggattttggattgcttctgaatgtaaaaacccatcacagatatataatttggagatcaaaattttgaacattgaaatgggttatggatttgccagaatagaatatttgaaataaaaccactccagaaaaatctatgacttatagggacatcattactaggacccacaagaaccaaatgacagacactaaggagtagctcttattctcactgcctttttatgaagattctgcctactcttgtggtatattaggttacccactggaaatggttgctacttgccctgcagtctgtaatgcaaccacatttttctttttaacatccaggctagaactagttctatcaatacaatgttagaactgagttttggcttttttttcttctgtatcctttttttttccttttctttttttaggttgagtgagtttctacttttcaggttagggtgataaataacccatgttcacaaaatagggcatagaaagcaatgccataatagttttgtgtcttataattcacctaaaatttacaacatatgaatgttttgtctttctagtgtaaatagacagcatatctctagacctgtggttatcaaaagagcgtgtgttagaatcaccggacagacttatgaacaaacgaaatgctgggccccatctccagtgttctgactctgtaggtctggagtggggctgaagatttgcctttccaacgagttccaagtgatgctgaggctgcttctctggggactatattttgagaactactgaactaccattctaggagggtgggaaaatgggttttcatcttggagcacaaattatttgcatgaatttaagcaagtcatgaatattctattcttcagtttcttcatctgataaataagatcaataataccagttcagcctactttgttgagttcttgggaggagccagtagaataatgtataagaaagtgcttttgaaaattaaaagaaacacttgtgtgaaattgttaatgttttcagagatgtaatgatgatgtaagaaatattcgctcaagaataccatggctcacacacaatatttgcaattttatttccttcatatttttccctctctttacacttttaaagcacattagtgcttgccttctggttattgacaagcagcaggtaagtggttggtgaatcaataaattctttggccttgagtctcaggctctgcttttttccacctatggtcgctgggtatccctctctttttttcctaatgcttattgtagaaatatttcacaggaaatggggtgacactaagcctcaagatattgtttctttttcctaaacaaacacttttatcactaggggacaatctttccttagttgatgacatattagttgatataaataaaggtgttcctgttaggctagccccttcagctattcaggtttcctgcctataaatcagtgaaagatgcaatttgaacttgattgcttagaaagacacaaaggcagagaggatgggttgcacttcaacaccgaaaattaaaggacaagcttgctgtcaaagccagaccactagcttcatttgatctattggttttaagctaaagggaggctcgaagaaggagtggttacctcataccaacagctaataaggaaacattttcagcattttttatttgtaccaaatgtaataatggagtggtggggttcttttggtacaacaatcatttctttcatttgaatgctaattacattctcaatgtatgaattaattataacttctattgactatgttgatattgtttagaaaaatcatctctcagatcagatgaaaagttttccctgtgtatgaaaggctcaagtgacttgttctgcatatggcattaatattccttgatgtaagctacataaaacattaaaacccaattaaactcagaaagggggccagccctgctgacttatttatttaaagccaagggagtggaaatcccttttcttgttgtatgtgtagataaagacatatgtcttccccactccccatgcctatttggagcatatttaaagatttcatcaaatttacctaaaattattatcttcaaagctagagcaagatttattaaaccctgaagtgtttgagcaaaggcagtaatttttgagagctttgactaaagctgttttgagcattccccgtgccagagagctcccaaaatgtaggaagaaaagctaagagtaaatgagaattgacactttctgcatagatcttgttcaaaaagctagaggattttcaggtgcttcattgctccttcttgctttctccccttggggactgaagtgtagtgtaaagcagcctatggtgtggggaactaaaatgtaaggaaatccatgatgaggccaggatgggaggattgcttgagcccaggtgttcgagaccagcctgggcaacaaaggaagaactccatctctacaaataattaaaaaattagctaggcatggtggcacacacgggtagtcccagctacttgggaggctgaggtgggaggatcacctgatcccaggaggtcaaggctgcagccatgatcacaccactacactacagcctggacaacagagcaaggccctgtctcaaaaaaaaaaaaacaaaaaagaaaaaatccatgatgataattaaccatgaatcatgcttctagaagaaagaccatagaatttagttatcatttgttatcattcctttatgggccaaagagattcctagcctgagaagaagagttgggacaaagtctatattctgattcctaaatgcatacatacataaatacacacacacacacacacacacacacacacatataatatcttattcatttattaattcatttgacaaatatttattaaatgcctaccatgtgtcaagcaatgttttaggtacagaatatacagtagtgggtaaaaaatccctaatcctaagaagcttacactagtggaaggaggtaaaaaataagcaaaaaagtaagtaaatttggaatgtgtcacatggtgtgatgtgcaaaggagaaaaaacatgcagggtgggagggacaggcaaacagggagaatgggaatacagttactgttttatttaaagtggtggggaaatgcctcacctatgaggagggaaaagggtgctcccagaacaatcttctggatgggagtgttcttggcatgaatgcaaataataaagaggtcagagaggctggagaaaagtgaatgagtgggagagtggaaggagatgagatcagagaagtagtgtgtatgtgtttgtgtgtgtgtgtgtgtgtgatgttaaaatgtccccactaaatataataataatgatagtaggtgcaattcttttaaaatacacttaattggcaaaataaaaagtcaatggctcttttttggccccatgcattgcctttttgttaattttcctctttaagacatgcaggtctggaaaccaccacttgaagcaatgcaagctgaataaggtgcagttgctgtcgctgagaatccaaaaaagtaatgtgaaggaataaaatcaggacacaaagttgaggcctgatatgagggacaatattggagaaatacaatgtgtcatgcatgggagtacatagaggacagggaagtggtgggtggctggtgaaccaagaaaatcttcatgaagtctgaattttgaaataggcatgaaagaagagagattttgagagttagggagaatattccagtcagaggacacacagcaataaatatgtaaggaggctggaaaatacgaattgaataaagaagccagcatctagaagtctagcttagttgtgtttttaagggatgcatacagaatgtactgagaaagaatggctgaaaggcaaattgaggtccaatggcaaaggactaaatgaatgatttcatggttttaaaacatggtcacaaaatctttaacattcctcctatcaagaggtgaagtttctgtctctttcccttcaattatgtgacaacatacagcaaaatttacaaggtcataaaaggtcatatagtttcctccatgtttgctcttggatctttaagatattatgtaagaatatcatgtaagaaatccaactactctgaggttaccataccctgaagaaactcaagccacatgaagaggctgcttgggggctttctgaccaacagtcctaacttaacccgggatttgaatcattccagcccaggtgccaggcttgtgagtaaacaaaccttcagatgattccaacccccagctgttaagtcacccccagccttcaagtcttctcagctgaggccaaagatatcataaagcagatataagccatcttcactatgccctcttcaaatccctgatccatggaatcagtggttgttttaaatcactgagtctgcagtaatttgttccacagtaatggatacttggaacaaatgggactgaagaatataactgggaagcagatatcatcctggaggctttagtgatggtatgtgtaagagacatctccacctctacggtatctagttcagggattgggacaccaggcagaaaatgtgatccatgggctcttgtaccatattttaagtgagcctcactcactttactggagtttggagttttactatttctttgaagtacgtggactagacaagggtgatgaaaaaattggctgcaaatatctttgtgacttaggaacagggattgatttctttaaaaaacacaaatcacatagcaagaacatcaaaatcaggaacattatggacaaagttattgtaagttaaaaaataagaaaaggtatttgtctaaaactaacataaaattaatatccagaacatataagcaattccagcaaataaacaaaaaggataataattctcatagaaaattgggcaaaaatatccataaaatttacagaataaaatattctaaaagccaagaagcatatgtgtgataaaaatcaagagtaatcagagaaatgaatatgaaaacaataatgagaatccactttgtacctggctgacaaaaattaggaaacttggtaatgttaagtgttgttggagatataagaatgcactattgctggtttgagtgagcaccagagcggccactatgttggagagcaatttggtactgcttaggataagtacgtttagtttaagtacactgcggcctggtaattttttttacctgcgattaatctgaaaacattctcacgcaattccacaagggaaaatatatgaggttgcttattagagtatcacagtcataatgagttgccgactacctgggtgtcaatcactgggagactggaggaaaagaatgtggtggatacttattgtggaatattatgggacaagtagaaataagaatttagaacatgtatggatcctaaaaacatagtgtaaagtgaaaaaaaaagtaacaaaagaatgagacatataacagagtattggtttcagaaatcaaaatttcatcaatacaaaatgatgatacccattttacaagagcattcaaaaacaattaagaaaatagttgctgatggatgggtagtgggggtgagtaagaaatgcaaaaagaataaataagtaaagaaaataaaagaagagccatacacaaaccagtaatgatgatgtgtcctgaactgaaaggtatgatgaatgtacccttctgcccctgagatccagatatcataaatacaaaccaataaactcagataaaagcttctggagtctctgactattctgaattgttttaaatacttcctggaatctggttcttttgtcctctctacgtttctctatgaacatacacaatcaagtcagactaacaggtgtgggttactcatgtgctatatatttttatcaggaaatgtcattacagctcatttggcaatttctgattctgtaccttgattcaagtgacttaaagttttttccttgattattaagataatccatattaactgtggaacatttagaaaatacaagaaaaaggccaaaaaaaaataattcaaaaaaatcaagaggaaaattatctttactataatctcaccactcagaaataattacagttaatatttgaatatatttattttcagctttttaaaaattatgtctatgtgagtattaatattaaatatgcatattaatatgcaaatgtatatgtatcttatatcttcaattgtaatataggtaaatttctctgttgtcagaattaggtagcatgtctttaaaaatctttgctttgtttacaggtgttaataataatctcatatttcagtttgtgtttatttgattaccagtgaagttgtatttcttatgttttttagctatttctattttcatttttgtgaatgatcttctcaaaaactgtgttcattattccataggattcttgttaaaaatcaatcttatattttccctatatgtgaatatcattaaacctttgctatgcttcttgttgtcatttgatttaatttatgcaaaaagtattagattttctttcataggtagtcaaacctatcatttattcttttctatgtttttctacatcattttaaatgttaaaatgtctttactcacctataatttcttctctcttgtctgtgtatctgtggtgtttatttatgtttttatagatcttattctttgatcaaaccaggaacttattttattagactgtattaaggagatgtctaagttgattttctcagtgcctgtcattacatagtcctttatttttctattaattctcatcgcttcccttatggtgaattaattcacacatacacttacatttgtttctgtctctactgatattaattaatttgtctctccttgtaccagaaatataatattttagttattattggtttataatatattttaataactgaacacagttatggcaattcctgcaatacttttttcaaaaataacattcttctttgcaaatgaaccttataattattttaagtttcaaaacaaactccaattggattttattggcaattattacatttaaacaacataatcatctggcgattatcagaatctttcaagcatttagaaattatatccaaaacaatgcatcccttcatcatgcttgagttatttttttaatctcttgatgaagttgtcatttttttcaaacgtatcactcacattgtcttgaataaggttattcttgtcttctaccagtcattgagcactatacagcgtggcccaccttaactgactgaatgcggaaagaagggtgtcaaggagactgaaagtcaggagacttctacctgctttaggaggaagtttcagtgcaagactgtggtggctctccaggtgtattttttttcacagaccctgcaatttctgggggaagacagtatgggtgggtcaaaggcccaactaacattctgtccttcaaaccctactgttatttcagaggagagattctcaacattttttataaatttagtcccactccaaccatattttgtgaaaattccttgcaggattcagcaaatggttaggtattactcctattgtcattgtgattatggctttgtatcttattttgctcttttatgagcattttaatggaaacatgggtgaattcaggatagtctaaggaatgctgcagtaacaatcgaccctcaaatttcagggactttataccagacaagtttatttttcattcctactgtttgtccagtctggttgtctgggggaatctgatcattgcaggcttgtgtaaattccatgttatcacaggcttacactatcactgcagcagggagaagaaacatggtaaatcatatactggctcttacagcttccatacaggaatatcacttcagcactctctcattggccaaagtaagtcacatggccttatctggtttcaaaatggggagagaattatactcctactatgttccagaaccagagcagactatttttggacaaccctaatgattagcatacattcacattctgaaagtctcacttcagcaacttttaaaaaatggcggtcgtttggcttcttaatcttttacaatacatagactaagtcacttatcagatgagcagtgctttagaagctagaagataatccttgtagaaaagcaatctatttctaaaggcaaagacaaaataagatagtaggcgttatgcctttgatactggaaggtcttaatttcagcatttggcgttcagatgcggattgaagggcataaacgtgtctctgctgttctatccatgggatgactgtaaagcacatgctttcagaactttctttcattgactgaatacattattatgtatattgacttctttctcttccttccaaaggcaaaaccttggagcatgagtgtgatcacttgaatgcagagtgtcatcttctactagtttttatgcattcactgtttctttttaacatcagaggagagggaagtcttgttgctataatatgctactttaaacaatcctggactgtgaggctgccaactctggcatcagttaagtcaagagcaggatacaatgggtagtgagggggtgggaagaatccacctaatacatatctcatattgattaaaataaatgaatgctctatttctaactggtgtcaaaagacatttacagtttccctagcctgtttcccacgtctgtttggcacagagactgccaggatcaatggtccaattttagttccactttcttcttccatcattccctgtattcagctcttcggaagtgagttaataatgtaaaatctggctgaattaaattcatttaactgtgctgccaattcccttcccttcatgcatttttaaaaagatctcaaaccggtgatggatttctaatgctctaggaaaagaaagcaaggatgagacagtaaacctgaatggagtggattgtttattataattactccaatgaattatctcactttgtacccagaaggaagaggaaatatcaacctatataggctttgcaagtggtaatatgcctggtggaaaaaaactgtagaaacggcctcttcagtcagtcaaacaagtgacacagtgcagcttcacatggaaagctgtgaacagtaaaatatgagttttgggggggctgtttctatagcaacccagcatattctagctaggactacgaatgcttttttttaaaaattaaacttacagttagaaacatattagaaaccaggcctcaaacagtgcctgtatgtgacactataactacgtgacctagacctacctggaaaaatggtctaatttgaatcctgttccttgttcccagacttgtctctggttctttccaaatcctcttggcttgttaaattgactgatgcaattagagtgtataatcttaaagtaatattcagaaaaagatagaaagatgaaatttttgtcaaatatataataacaaatggtaaagatttcagcagagatcttttaatgagagaatgttcctagaaattaaatacccatatgtctattagtttgggtgagtctgttagcattcaactgttaaagtcacctgcttccaaagcaagatgttagaacaagagattgttaatggctttttaaagattccttataagtactgaatagatttttcctatcatggcaaacaaaccacctggaatttggactgtgttttattacctacctccctgcttacagtctctggtcccatgaaggtgtcttgtttatcctaactataaagtggttctaatggcctaattggttaataacacagccagttccctagtttgtattctcatgacaaaccagagagcaaaagacttcacattctggttgcatgctcccatttttttgttccttaaatggaaccagggaccatcctgctactagatatgttcttcatcaccacaaacatctagagacttcatttgtgcagtatggacaaaagtttcaatggttccagaaaccatgctcccattaatttcatgtttagcaagatcactctggaaatccagaccatggcaatgacgaaaagttgagtggctcattcagtgtatcatctagcaaagctcagcatccaatagagctttaggagttcaggtgcttctaataaaatggaaaatgcctttcctattaataatgcagcacactcctctgtcctcttgtctctagatccttttgctgactcaaaacaacaacaacaacaaaacactgtgttgtgctttcacacaaataccaaacacctctggagagagcactatatttcagccaatgacagagggaagatttgaaattcgagatgcaggatttgagaagttttctattactctgaatttcctccttttttattttattatccaccaaccatcccccaccccaaccttgagagttaagattctgaaagtgtctcatgtaaactctgaataaattcttggtgtttagcatagccagcttcccttattgctttcagagtcaaacctctctggagccaaatggggctctttgctacatcagtgcaaagactgataaaaattaagtttggcaccacaatggcttctcctgacaagcaattcataactctgacagggccacatactaatgttttcacctatgattgggctattgacatcagttaaactgaccaagtcccccatcttgtcatcccaagccatcatatgtatatttgttctaatgtgttcctgtcccagtaaaatgatagtttttcctgtgctctcacttgctctctctcacttgccgccatgtaaaatgtgcctgcttccccttccaccacgattgtaagtttcctgaagcctccccagccatgcttaactgtgagtcaattaaacctcttttctttataaattatccagtcacaggcagttctttatagcagcatcagagcagactaataatacacttggtcttccttacaagcagggtatgtctcaggataaacagttttgttacagagtggatggcttttctcagagtgtcttccaagagactcaagtggaagccaggaggcttcttatagcccagcccagaacatcacttaggccgtattctattagccaagcaaatcattaaagcccactcaggttcaatggcagggaaattaaactccacctctcaatgggaagagtagcaaataaattttggccatgtataatctaccatatctcatatttcagagatcagagatgggttagccttctctcacctctcttttttcttacttccaactaactcctccatcccctccagtttgggccctggttccattccttccttcaaatacccctcccagttatggtaacatcttattctgaatcactacatctaatagaagttttcagtctcagcttattgatttcagcaacatttggcatgttgcccaatccctttttctttggtttccataacacaacattcctggttttctttttcctacatctgtggccatatcttattccctttgtaggctcagcctcctctaactggcccattacatattgaattccaggaagcagggtcacagggtctcttgtactttagatcaggagggatacaaattacaccccacaggctagcacctattttttgtaaataaagtttcagtggaacagaatcaggtccatttatgtatgcattgtctatggctgcttttaagctacagaggtaaaatggcagagactgtatggtctgttagcctataatatttactatttggccctgtactgcaaatgtttgcccacccctcctctagaaccagtggttttcaaggtgtggtccctggatcagcagcattcatgtcccctggaacacgtcagaaatgcaaattcttgagcccctcccaagacctgctgaatcagaaactctggctgtggggcccagctacctatgtgtttgtttacaaagccttccaggtgactccaatacatgctcatatttgagaatcactgctccaaatagtaagaaaatcaaggaaagagccagacatactgaaggttggaagcaaccaccacatctgccatatttgagttgaggtggtggaggctgagcacccctgtctactggtaggatctgcatcagcccagggctagaagcagcagctatggcaaaaccactggcctatgggtgtttccttttttctgtagagtgggtgaaggtttaggagctccgagcaggaccccagctctgtggcctaaggggattgttttttaacttaggattacttttgtaacttcaaatgtgacctaaaaaaataagcattataagtttttattttcctgttatgtgctaagcaccatgtaaagcactttgtatattttatatatacatgtttaaccattgtaacatactaacagagagcataagtcctaaactcaagcttctggcttccaattcaggccttgttgctttatagttacatactcctggccaagttacttacccactctctgtttctaacatgattaactataaaatatggtcaatggctgtatccaccttatagagttgttatgagaatcaatgcatctaaagtgcttagatcacttcctggcaaatagtaagtatttaatcaattagctatttgtattatcttatttaattttcgtatcagtaccccaaggtagatatcattgcccccagtttacaggtaatctctctgggcctttgattccttgggctaaatttttgaggtcacacatctgtaagtttcagaaccaggattcaaagacaggttgtttaaaagccaatgatcaagctcttaaccacaatagacacacacacatgcacacacatgcacacacacacaatttacatctttctggaaattagtttcttttggtagccatatttccacacagttgtgttaatatttaaaatattgatcaaatcttaaaaaaactagaaattctttaaaatgtcacatataatttaatttcttttatttcatttcaaatagcttgccaaacatattgaacatgttttgataatttggcattagttactgttacactgatcaatgtatattagctaatgtagaaattggtgatgcataacatatgagagtctgccattcaacccttaacagctcttttcttgacaaattcctttgtagcagttttttaaattattatttgcagttttctcacaaagtaaaacatatactcctgtgtggcccctttgcttacttttcacaaaatcagttagtaaaacaaagacgaggacatccttctccaaagtggttttcttaccttctagaaaatccttcaagttttttaatcttggtaacagcattctaattcttttcagtacagttaaaaataaaatttcatcactatggaaaatggaacatgttcagtcgctaacaatgttacctcacttgcatattgagagcatgaggcagggcaaggggcatctctggcattttggccattttagaaagtcatgctgtaaggttatatggaggacttggtttgaacttcatttgttttttatgtggagagaaagacacctaaactgaatggtacattggctgaaccagcatttgtgaagaaccaggcaatcagttaagtgtttgcaatacacagataaataagacacagttcttgcctaaagaaaattcgaatccagaggtaagacatcacagtggggtaaagtgaaggactggaggggacttcagatgcagatgaaagagaatcttctgcaggagcctcagtgaaggtattttggagatgagatttggatgagtgggaatagccataggaaaactggagggtaagaaatcaggtaaaggaggcagcacaagcaaaggtatgggtttaagaaatcccatgatataggtagagcaccatcattactggagccatctatatgaaaacgtgcgtgtggcaggagagagagcaggagaggtcggaagggacatccttgtcatggaggccctagtatgtagtggcaggcaaatgatgttcaatgtgtgagcttgatatttcttatctcacagatgtatctccattgccagtctgggaattgtcttgtccattctgagcagattttatttctactttgtatattggcttttattccttgatctctgtacttatttcttccaccatattcacttatctctgtatcttcccttttgcattctggcagaattattaagctttctatttacattagggattcgattttcttctgagtcatttttgatagctattttctccaatgcaggtttttaattccattactacctttttgattattttgtcatttatttcacataaaacatgctttctttttatctgatcccattgttttttcctgttgcaggtctgttctagattaacattgctatggtttgaatatgtcccctccaaaagttatgttgaaacttaatacccattgtggcggtattaagaggagggcctttggggaagtgattacgtcatgagggctctgccctcatgaatggattaaaatcctcatagaagaagcttcagagagagctttgtcatttttgccctttcacctttggccatgtgaggacgcagcaaagaagccctcgtcagataccgactgctggttccttgaccttggactttccagcctccagaactgtgagaaataaatttttgtggtttacaaattaccaagttttcggtatttcattacagaagcacattaagcacagaaggattaagacaaacattaacaaaaattttatgaattttattgagattaaagtagaaatttccttaacatgttctttcagtttctgcagtgatttcaccaagtgttttcctttcttctaaactaacagggaattaacttctctgtaagtagaatagaatgattcccaggccctgaattgtcaattgttttgtttctaatcataccaaatgaggagaaatctatactggcccctgtttataacaggtagaggcttgatcaccctaaagctaagagaacccccttcttggccataaaggcaggtgctagttttatctgcaaaatccaaagcttgaaattcattgctctgtgttaaatttttacagatttgctgagctggagtggaaactttttctcttcaactgtttcattttttgactctgtagaatgcatgagtgatgatggtgttgaagaaagagaaggaagatggcagaagtaaataatcttgactactctaccaggcacttttctaagatctttaattacttatctcattttattctcttaagaactctttgaagtagctactattcttgccccatgttacttataagggaactaaggtatggatagattaaataactcaaaatcttgcaacaagtagtaagaagaggtcagactactccaggtctgtctgattccaaagtccatgctcttgatctttatgcaatgctctattctatataggctctttcttgaataggttggtgcatgccaatctacccctgacctctgaatatagcttgcttagccccagaggacatttcaggattcaatgatccatcatttctactgctttcaactgctcatcatgttgcacatagaactctgtgtctactgtagctttgtgcttggagctagaggcagagagtccagtggccctaatctccttccactgacttcttaaatgtgttattctgtttagagtttgggcatgctttggctagtgcttgtggggtttttttttctttttaaaaaaatttttaaaatagagatgggatctcactgtgttgcccaggctggtctcgaactcctgggctcaagtgatgctcttgtttcgtcctcccaaaatgttgggattacaggtgtgagccaccatgcccggccatgattgtttcttaattcatacttatgtgatatagttaatgaaaatttcttcccgcttccacactgtactggactctcctccttggtttattttgttatcttattgtaattattaatctattgtgctaccacaatttttcccttttgttatcatatattttttaagggaatatgagaaaagatggaatccaaaacctttagctagctatcattttttgtttgtttgttttttgtttgcttgtttgttttgtgacagggtcttgctccgttgcccagactggagtgcagtgtgcagtcactcacagcagcctcaacctcccaggctcaagtgaccctcccaagtagctgggaccacaggcatgtgccattattatttgtaggacggggttttgccacgttgtccagattggtctcaaactcctgagttcaagtgatctgctggcctctgtctcccaaaatactgggatcacaggcatgagccaccatgcccagttgctagctatcatttttttatgccaaacctccactctcttttcaatgtttaatttaaaataatatcttagaagaaacattaagaattgctgtctttgatgctataggcatattgatattcattcaaattaacaaatgtttattaagtactaggaatgtgcaaagtgcagtgatcagcaatttggggatatagatacagagaaatcataattcttactttcaggtgcctcgtgagagaaacaggtatatctatgattcactatgtcttttttaatgtcctgtatgacactctaatgtaacaaaatgttatgggaacccaggaggagaaggaattatttgctgcagggttactggaaaaggacttccaggatatcttagcttgaattcccctggaagcatgtatcaagagtagtatttgggcacagggtttatttggaaggtgatttaggaagtcaagcagactgcactaataagcagcttactgttatgggcaacgggggctcattcctactggggacctcagggagatagttaagaataaacctgagtgttgttcttcttgaggtgggcagaggaaaatgaaatttttatttaccaaattttatgtatcgctgtttgagggctttgccagggatgttaactttccagtacttctcacctgtcccacatgtgggctgagtctgtgtttgtgcagccagtgaaaggcctcagacaaagagttataaacttgagtagtgcatggaaacaggatttggctgagacacagacagcatctgcttcactggaggaggtggcatttaaattgaaccttggatgatgagaaggtttttcagcaagtcgtgatatgggtgggggtaagcatttcagcatgtaagagtaggacggacaaggcagcatttgtgtggtccatggcaaataataataaagcaccaaagtttgaaaatgattcacatttttaaaattagagaaaattcaaggttatccctataaatattcattctcactcccttgctttgagtgggaaggaacgtagctctcaagagtttgctcagagggaatcgtgcttcaccagcagcctgtctcctttagttaatatctaggttgctttgacttattacgttgttttacttctcggcagaattttggggttctgtccaaatgtgggcatgactatgtgaattgtgttgttgtatatgggggatgtcattacttacatgcgtcacaatggggagaaggttaagaattgctgatacaaggcttggtgatgtggcaggcaggtataaggaagaaaaaataatccagtggttggagcataggttgtagtgtatggggatgggaactgagggtggatgaggaagggaaaggtgaggtggtatatccttatatatctatatatatttatctatatgtataaatatattcctaacttaatatttgggctaatatttggtgagtgttttaaattcagcatctctaaaataatgaagagaggctacacatcacaggagtgaaaatgagtcatgtgaattttccttttacttgcatgtagaatgaggagaaatatcgaaccatattatctacttcacaaggtgcaattgctccctgctaataaaatccatgtgaggtttcacttcaaccttagagaatattgaaatttttgacaaggcaggttattagtaggttgagagtctgcaacaaaatttgcacctgtttgaaaatgcttcattctggacaggcagctgacatctctggtaattcggtaattcacacctgtgagctcctgaagctttggaaaactgagtaaaagcaacaccacatcactgcagtacttatcccgcatttcccatggggcacaaggctatcaactgtgagcaggtgaggcttatttaaaacatcttcatttctagtttgcataacacggaatagagtattgcatgccatatgagtacatggaatactgaatacatagaatacttgtataagaactagccttgtttccatagactatcatagaagtagaaatgacattcttctgagggctgttaataaacagtgacagtgcatagaaattctgtttagagagaaagacaaaaaaaaaaggatgagctttgtttcaaaaataatgtcaaagatgaaggatagttcttaagactccatagtttgttttttgtactatttttttcttttctttcttttttttttttttttttttgagacatggtctcgctctgttacccaggctgaagtgcattggtgcgatcatagcttactgcagcctcaaactctactttcaaagttcagcatcttctgtggtaagaggaagttttatggcatttccattccagttgtctaccccacagtgctgctcttatcccactcctgcttggcagctccatggcttcaggttgaacatctcagccccctgagcattattcagctgtttctcctttatgaaagccagtggcaagtttgcactgggaccagccacacttccctttgataacctctctttctgttcatcactgtatctccacacaaggtaaaaaggatgggatacattttactgacggattgggaaaaaaaaattatgatggagaaaacttcaaaatcagtgctatagcatgatttttttcccacaagtttttgagacaaactggtaaattaaacctctcacagggaaattgccaattttatctctgtttctgacttgcttttccccattcagtctatcaaaaagagaaagagaagtatttttctattttctctgtaatttttaagttctgtcattcaaatgaaatattaattttccattagcattcaaagagtgctgaagtcatctcttttatccttcaccactgctccccacctcctccatgactgttggcaataataaataggccccttactgagtttttttgccctttattagctattttcttagctaccaatagagaaacttgagattatcaccttattagccaatgactttaattttctccacccattctcttgtttttgaggagagaagagggaggagagattatttgttaatttttttaaaaataagataatgtaaaggtcttttggagtgattttgaacaatactgttgttttctaaactttaaatattcagtgaactctattgtaaaaactggtcatagactcctacactaccccatccattttctctcaccttctgacacatattctactgtggctcttatttcattggcttagacatacctattcattggtctcctcctgggtgcaatgtcagagaccatagcacatttgttttggttcctctgaagtcctgtatcgagaaaggcaaataacaggtaataaataaatggttgttgaatatatttgtatccaatctgccaactcaccttctgaagcagttccatttaacaaattctaaaacaatgacattcatattttggaaagcttccagaaacctgtttcaatatttgctaccaaggagaaatgggaaaggagagaagaagatcaacatttatgaaatatcaactctgtatcacatataagtataacatacctcgtctcttttattctttaaaacagttctattaggtaagatctactaatctccatttttccaacaaggaaattggggtacataaaaattctggaggtcatgggttatcatgagacaaaaccaagatgcaaacctgagactgtctgtttccaaggcccagattctttccaccttacttcttaatcattgcctagcgaagaaagaaagtagacttgactcttgaacagcatggttttgaactgtgagtgtccacttagatgcagattttcttctgtctctgccatccctgagacagcaagactaacccttcctcttcctctttctcctcagccttctcaacataaagataaggatgaagacctttataatgaaccacttccacttaataaatgcttttttgttcttataataacatttcttaataacatttttttctctagcttatttcattgtcagaacacagcatataatacacataatatacaaaataacgaaatatgtatcaatcgactatttatgttatgggtaaggcttccagtgaacagtgggctatgagtagctatggtttggggagtcaaaagttatacatggatttttgacttcatgggggatcagtcccgctaacccctgagctgttcaagggtcaactgtattcgtttccacacctcattgacagatcaatttacttgatgctttatttttgcccaaatcctgtcagtcattcccctttgtctaacagagttcatacaacacagcctgaatagcaaggcagtacatcccagtggtaaacaagttatgtgggcttctgtgtcagtgataatgggaactctataatttcttacttgatctcataaaactattctgttaaatgggcataataatagtatctacttcacaacaaagttttttgaaaatcaagtgatataatacatatgaaatgctcagcacagtacacagtaaggacttgataaatataagctggtaccactatgtgttgtccttgttgttgttaatataactttaccatacccttccttactttttttttttttttgagatggtgttttgatctgccaccaagactggggtgcagtggcatgatcatggctcaccgcagcctcaacctcctggctcaagcaatcctcccacctcagccttccgagtagctaagaccacaggcatgcaccaccatgctcagctaattttttttatttttgtggagacagagtttcaccatgttgcccaagctggtctcaaactcctgggctcaagagacccacccacctaggcctcctcaagtgctagtattacaggcatgagccaccgggcccagcccatatccttcctttctaacctttggtttttcctataaaagtgctccatagcacaaacttgcctccagctgggctgggttccccaagctgtgccaaactctatgattatccttgcctttattctttggcttaaactaacacctcttcctctccatctgctcatgcaaatccaatcaattttctctctcaggcaaagctggtactccaaatagccatcctgtggatgttggcttctttcccaagctaccctgtgggagagtgctcaatgtgcaaagtggctatggcatcaggaatgggggttacacatgggcttcacaatgctgactttgcctgactaatgctagtccagctaccaccactattgaatgtctgcttgacaacatcagaaataaagttgagccctgttaggacattattttctgaggatgaagttgtgaggagtcgggtcaggggagcaggggagtccagccagcttcttggtggcatattgattgattacattcaacctcttccaacatggaggaagcagaaatttgtcctcactggaatatatattctaaatatggattggcatccctgcccatgatactattgccaggaccaccattcatagatttatggaattcattattcactatattattttgcatagcagtgcttctcaacaaatattgaatttttcaggcaaagaaatgtggcttggcttcatggtcatgaaattcattgcccttactatgtgctccactcttcagaagcaggtgaccccacagaatgttagaatagcctgttgaagatacagctatagtgtctattgcagtagaagactgtatctttgtggttggaaaactgtcctcagggatatgatatattttaaaccaatgaccaatattgtcaccattttcccatagccataatgcataggtctcagaaccaaagggtgaagtcaatagtgatttttctcatcattccacctaataatacattcactgaattttgccaaaagttccctctggaacttttattttgggccctgctggttgagaagtgttgattccccagggggcttgggaagacatttctactaatggacacaataatggttctgttgaacacgaagctgagagtgccatctgatcttgttggttcctcaggccactaaacttactgcaggcaaagaagggggttactctactagacagagtgcttgatcctgattatcaaggggaaattgaattattgtacataatgggagcagaaagaactttgactagaactcagcaggtttcataggacaccatttctttaattataaaagttaattgaagactacccagttaatgcaggatcactaaggactcagactctttacaatgaagatttgaatcatccaaccagctaaaagtttgaccaggtaaagtgaagggtaattataaaaaaagcatggaatatgcaatgaacaaaagaccttcaatttccactatggattcgtgtccagttacagaaacaagaactattacatactttgtgcagtgtgtatatttggttttttgcttgatttatatgcatgtgtgttttatcattcacttccccttttcgcactattttgtataagcagtgttggtaatacttaatttttaaatttagtcttcagatattaaatacctctgtgggctttttactgatctagaaaagaaattagcctttccagaaagggatatggtgactaataggatcctgtatttcacccttttgggaagagaataagtataccttaacttgtgcaagaaagagttgtagtggtgatgtcataaaaatggtggagtaggaaactccaaaaattggtttgttcattgaagcaagcattaagcaaaactaaaagaatcatttttttttggaactctggagtctaatcaaaatcttacagcaaccaggaaagtgtttaatgaaaacagacactgctaaattttgataagaaaatattgtggcattttcgcttgctcgcctaacatctcccactttccagctcgatagtggctgtgggaacagcagcttgtatacctggcatggtttgctggtgctgagatgggggacaatatggatctcattctcaatacattttggttttgatcaatctaatgtttccctgagggactggcacagagactgacctttgtttgccactacctccctgccctgaggctagagcgacgactttttaggtgacatctatcaaaagtatttcaaaacatactctacatgtctgcctgggacaagggacagaagatggggcaagcagcagacagacccaaaagtctgggaaggaaaagactaaggaggaaatttcttcagggaataagggctctgaaaggttaccacgtgtactgggaaatccagggtgcaacatgcatacccagggccagatgcatcctcacaaaaaacttgagaggattttaggcttgcacttctggttaatctttgggctttgcacaagtatgaggtaaaagctgaagcagagttttaggtggcctggcttagtgttgaaggagtgctccagcacagagccaatcttcaaaaactgggagagtagtttttttcttttcctttttggctccaagtatttaaagaaatttctggcaagtcgacgactgaatgctgagataacaacacagagacttcagagaccacatacaacaagaacctattgcaaaaaatagtttagaaaagtcattaaaccagtggacaattgcagccctcagtaatcaatagcaacaaacccagaggatggggagaatatgatttacatagttaccattttataatatttgcattttctggttttcaaaaacaattcagtgcatacaaagaaataggaaagtatggcccattcaaagtgataaaaaaaaaaaaaagaaatagacagaaagtattcctgggaaagcccataccttggacttaataaagactttaaattgattgtcttaaatatgctaaaagagttacaggaaaccatagacaaagaactaaaggaaacaaggagcaagatgtatggacgaatagagaatatcaacaaagagacaaattataaaaaggaacaaaatagaaattctagaggtgaaaggtacaattactgaaattgaaatttcactaaactaaataaaaaatttactctcagaacttccagaaggaataagtcctgctgacaccttaacttcagcctagtgaaactgattatggacttctgacccccacaactgtgaaacaataaatttatgttgtttcaagctactaaatttgtggtaacttgttatagcagcaataagcagttagtacaacacttttaaatcaattccaaccattaaattcctctgtcattaaaatacctagagtggtgtctgttttcctgtctgagtattgataagtaggtgttctatcaatatttgtggaataaactaatgtataaaatctgtaatgtccaaagctaaggtccaaagtcctccactctcttagtttgggttcctttagaagctgaccctgagctaagaagttggttgcaatgtttcctgggaaatattggtaagggagtgtagacatgagacagggaagggaacacaatcgaggtcaatgcagggaatgacatcaagcaagttatcacgagggaaaattgaaacctaatcttatgggggaactctgggagccagtgttgaacacgcacctcagagttactctacctggggggcaagggagttggagaatttcttaccagccatcatcagtccttccttgagggctacaccaactcactggcacctctgatctgccacctgtaggggcagagcaggttctggtggtcagagaaagttctcagaccacgagatgccaattctggcagttggaaggtaggtgggcatgcactgaagtggtaagggcttggagttggggatagaacatccacaacttcatctatactcacaaaatctactttagccaatccagtccaggtttacctccttcctattaaccaatagacacacactacatgcaccactccctagcaaaacagtgccttggaggcaataatgtgcgcattttgtcccttagtaggtctgcaggatttctgacagcacgggccatgacttgtttttcttttatgtttctcacaatgctgggtgccatagcaacatatatattttgggcacttaatatatattgttgaattgaattgattctcataattgtgtgatatctatttcttatatttgaaggtggctctctgttgagttttctatgtttcttctttttaaccttttccttcattgcaatattttaagtacacattaacaagtgataacgagggaaacaacctaaagattttatttttaatgtaagtatctccctacctaccaatgtgttcagcctttgaggaaatcaatgttaatacttaccattagcctttcacagccttttccattttcttacaaatgcacgtgaatgtgcacatgctatgtttttgtttttacaaaacatatgattatattatgtaccttcctttgccaattgtcaatttacttgataataggtcatacacaccaccaggtcaaaatagatttagtttatttattttaacagttgcagaatattatcttttgtatgtactgtaatttattcaaccattattttattgatgaacatgtaatttgcttccagtttctttttgcctccttaaacgatgctgcagtaaacatcctactacaaatattcatttatattcttcaaagtgctattactatgtcaaagagtatgtgcatttggaattttcatagatattgccagattatctgcctcttcttatccatattgaaaattctcatttctcttaaacatttcatattttatttatatgtaatgggatttgtctaaccagcattaatatatacacggttatgaatgataaactggcatggtactgctaggaatcatttgcatgtatcaattgtcatgagaattttctgctgaaggggaattgtgggggtttctttgtgtcttggagtagagaaatgtggcagaatctgaagcagaggctgtgcttcttttgtctaagcaataaagtatgatgcagctttggggaagcagacttgtccccacttctaaatggaacacagtgtagttgtggcagcaaagaatctggcacacaaaaatgcctacttagcttggaacatcctaggggattagcagagataactgggttgtacttagttcagcagtgggtagcaaaagccaatgagacaagtgttgttgcaattaaagtagctagccactttcctccccctagatttgtacccattggctagcaaggtgtgggaaacttactttacatataaatggacttgaattctcaaattggtctaaaatcttataccactttgaatagactcacttcctgaaatagcaaattatttttctctgttgatccttttattactgtaaaaacatttcagagtagagaaatatagtgatgagatgatgaaacactttattaatatagcactgtgaaccttttaattgaagtttgtgctttatattgtttgcaaatgagtttcaaaaatcataaggaaaactttcctcctttctggaaaattcccacttcaaagctaaaatgaaagcatttaaaaaaattaattttcaacaacaaaacagcgttaatggatatacctaagggcaattcagtggcgagagaaggcatatatgttttatgtactaacccagctttgccaagtttcccactttgctgcaaagttcattttcaaaacattggtaatctatcatttgacagcttgttgcttctgaaattctaaatttctggtatgcagctaatgtatgtacatttaaaaaacactagatctgaattcatatgtatgcaactcttaaattacatgctgctgtcaggtattgacttttatggttgatagctttaatattactatttgtgtctctataaattattttatctgaagccaaaaaagatgaaaatctgggttttattaatagatgtactaagcataacactcaagacataattgatatgaatatcaatagcatgattttaataacatcaaacattttggtgtcatagggaaatgtcttctaaatgcagagtgtgaaaggtgcagtgaatcaggggcaggctcgtaggaggaaatacctgacttgaatctatgaaaagaatggaagagtctgaaaaccattagagacagcatttgaaatagtccagaagattcacatttatcataaccttgatttttacaaccataaaaattacaaattttatgaaccaaaaacaaaaaattggctgcaatgaggccatcaagatttctagaactatgcaaacaatggggatttgttattctccttaaatgttgtatggaaaatatttgtgtgtgtgtgtgtgtgtgtgtgtgtgtgtgtgtgtgtcttaagggaaaatgaggtgtttaattacagagagagactcctttagagtatttcctaatgacaggaatttataactttagggatgtttggtttctttccaagtttggaccttagctttgtagagtggcagatgtatgaggaaggagctttaacagggtttctttgagagaggacaaagtaatgcagatgtaacagagggcagagaatcccttaatgaaactccttgctgatcaagtttgacagaagaagacacagaggaagtcctgacaccagagccccacaaagtgttgaacccctggcagttgactcatggaaaaagggccattgattgacccaaagtgagatagagcaaagtggtctttaacacttcccattcaatcccttctctccctttctaacttcaagctctatggcctcagcttactctccagttactcagaacttgatgtggtttggctgtgtcccactcaaatctcatcttgaattctggttcccataatccccatgtgtcatgggagggacatggtcggggggtgggtgagataattgaatcataggggaagtgccccaggctgctgttctcgtgatagtgagtgaattctcatgagatctaatggttttataaggggctccccacattttctctgcacttctctcctcccaccatgtgatggatgtgtttgcttccacttctgccatgattttaagtttcctgaggcctccccagccatgctgaactgtgactcaattaaacatcttccctttataaattacccagtctccaatatgtctttattagcagggtgagaatggactaatacggtaaattgataccgggagtgagatgctgctgtaaagatacccaaaaatgtgaaagtgggtaacaggactttggaagtgggtaacaggcagaggttggaaccgtttggagggctcagaagatgatatgaaaatgtgggaaagtttggaacttcctagagacttggagcactcagaagacaggaagatgtgggaaagtttggaatttcctagagacccgttaaatggctttgaccaaaatgttgatagtgatatggacaataacgtctatgctgaggtggtctcatatggagataagaaactttttggaaatgggaggaaaggtcactcttgctatgcagagactggtggcattttgcacctgccctagaggtctgtaaactttgaagttgagagagatgatttagggtatctggcagaataaatttctaaggggcaaagcattcaagaggaaaaagagagagttacatcatcatggcagacaggaagctggactagattgcagctctggaaagagcagtgtgtggaggctcacattgtgaatttgagctccagatccactgcaagacaaactgacaatcctgagaggacccacataccctccgaaggaaacagactgctcctgcaggacccgggagacccccatatactctgattgccccaactgcagaagtaggaatgggaagccctcctctcccaaacacacaccccactggagaaaccgaaggtctgtttgcaggaaaagtttccaaccttacctggagctgagttaacttggggagccgagtgaaatacaggaagcagcagaaaggccctcggagctcgctgggtctccaagtagcccattcctgcctggtaccacagagatccatcaggagggtagccagaggagcagggggtaaaactccacagggagaaggaaatctgtagctgaactttgtaacaatttgaatggggcgagaagcctcctggccagaactcaggggagtgcacaaatttggcatgcagactcctcctcaagcaagggaagaaccaagcccttttcttttgtagctggaaggcaggtagcctgggacaagttttcaagcctatctcacccaccacctgcaaacagactctgggcttttggagtggggaacagtgggagtgagactggcccttcagtttgcatgggagctgggtgaggcctgtgactgctggcttctccccactttcctgacaacctgcaagattcagcaggggcagccataattctcctaggcacacaactccagtgacctgggaatctcaccccgattccccacagcagctgcagcaagacctgcccaaggagagtctgagctcagacacacctggcccttcccccacctgatggtccttccctacccaccctggtagcagaagacaaagggcatataatcttgggagttctagggccctgcccaccacaagttcctctccatactaccacagctgatgctctctggaaagcaccaccaactgtcaggaggccaaccagcataaaaagagagcattaaaccaagaaagttaagaaccatcacagagtccattgcacccctctatcatctccactggaacaggcactcatatccacggctgagagacctatagacggttcacatcacaggactctgtgcaggcaacccccagtaccagcctggagccaggtagacttgcagggtggatagacctagaagagagacaacaatcacagcagttcagctcacaggaagccacatccataggaaaagggggagggtactacatcaagggaacaagagaaaggtgaagcccagtgcaaggaaatccaaaaaaaaaaaaaaaaagatacaagaaatgaagcaagagatattcaaggaaatagatagattaaagaaaaatcaatcaccaaaattcaggaaactttggacacacttttagaaatgtgaaatgctctggaaagtctcagaaataaaattgaacaagtagaagaaagaaattcagagctcaaagacaaggtctttgaattaatccaatccaacaaagaaaaagaaaaaataataataaaacatgaacaaagcctccaagaagtctgggattacattaaatgaccaaacctaagaataatcggtgttcctgaggaagaagggaattctaaaagcttggaaaacgtatttcgggaataagtgaggaaaacttccctggctttgctagagatctagacatccaaaaatacaagaaacacagagaacacctgggaaattaattgcaaaaagatcatcgcttaggcacatcatcatcaagttatccaaagtaaagacaaaggaaagaatcttaagagttgtgacacaaaagcgatggataacctataaaggaaaacctatcagattaacagatttcttagcagaaaccctacaagttataagggattggggccctatcttcagcctcctcaaatgaaacaattatcagccaagaattttgtatctaccaaaactaagcatcatatatgaaggaaagatacagtcttttgcagacaaacaaatgcttagagaattcactactaccaagccaccactacaagaactgctaaaaggagctctaaatcttgaaacaaatcctggaaacacatcaaaacagaatatctttaaaggataaattacacaggacctataaaacaaaaatgcaaattaaaaagcaaaaacaaaaaacaaaaaaacaaaagtacacaggcaaccaagagcatggtgaacgccatggtacctcacatttcaatactaacattaaacgtaaatggcctaaatgctccacttaaaagatacagaaccacagaatggcagacaactatctgctgccttcaggagactcacctaacacataaggcgactcatataaacttaaagtaaaggggtggggaaaggcattttaggcaaattgacaccaaaagcaagcaggggtagctatttttatatcagacaaaacaaacattaaagcagcagcagttaaaagagacaaagagggacattatataatggtaagaggccttgtccaacaggaaaatatcataatcctaaacatatatgaacctaacactggagctcccaaatttataaaacaaatactaatagactgaagaaatgagttagacagcaacacaataatagtgggggacttcagtactccactgacagcactagacaggtccacaacacagaaagtcaacaaagaaacaactgagggtggagccaagatggccgaataggaacagctccattctacagctcccagcatgagcgacgcagaagacgggtgatttctgcatttcgaattgaggtaccgggttcatctcactggggaatgttgggcagtgggtgcagtgcactgagtgtgagccgaagaagggcgaggcatcgcttcacctgggaagtgcaaggggtcagggagttccctttcctagtcaaagaaaggggtgacagatggcacctggaaaatcgggtcactcccaccctaatactgcacttttccaatggtcttagcaaacggcacaccaggagattatatcccacgcttggctcggagggtcctagcccacagagcctcactcattgctagcacagcagtctgagatcaaactgcaaggcagtagcgaggcttggggaggggcgcccaccattgctggggcttgagtaggtaaacaaagcggccaggaagctcgaactgggtggagcccaccgcagctcaaggaagcctgcctgcctctgtagactccacctcagggggcagggcatagacaaacaaaaggcagcagaaacctctgcagacttaaatgtccctgtctgacagctttgaagagagtagtggttctcccagcacgcagccggagatctgagaacggacagactgcctcctcaagtgagttcctgacccacgagtagcctaactgggaggcaccccccaggaggggcagactgacacctcacatggctgggtactcctctgagacaaaacttacagcggaacgatcaggcagcaacatttgctgttcaccaaaatctgctgttctgcagcctccgctgctgatacccagccaaacaggatctggagtggacctccagcaaactccaacagacctgcagctgaaggtcctgactgttagaaggaaaactaacaaacagaaaggacatccacaccaaaaccccatctgtatgtcaccatcatcagagatcaaaggtagataaaacaacaaagatgcagaaaaaacagagcagaaaacctggaaactctaaaaatcagagcacctctcctcctccaaaggaatgcagctgctcaccagcaacagaacaaagctggatggagaatgactttgacaagttgagagaagaaggcttcagatgatcaaactactctgatctaaaggaggaagttagaacccatggcaaagaggttaaaaaccttgaaaaaaaattaaacgaatggctaactagaataaccaatgcagagaagtccttaaaggacctgatggagctgaaaaccatggcacgagaactatgagatgaatgcacaagcctcagtagccgatgcgatcaactggaagaaagggtatcagtgatggaagatcaaatgaatgaaatgaagcaagaagagaagtttagagaaaaaagaataaaaagaaatgaacaaagcctccaagaaatatgggactatgtgaaaagaccaaatctaagtgatggggagaagggaaccaagttggaaaacatctgcaggatactatccaggagaacttccccaatctagcaaggcaggccaatattcaaattcaggaaatacagagaatgccacaaagatactcctcgagaagagcaactccaagacacataattgtccaattcaccaaagttgaaatgtaggaaaaaatgttaagggcagccagagagaaaggtcatgttacccacaaagggaagcccttcagaataacagctgatctctcggcagaaactctacgagccagaagatagtgggggccaatattcaacattcttaaagaaaagaattttcaacccagaatttcatgtccagccaaactaagcttcataagtgaaggagaaataaaatcccttacagacaagcaaatgctgagagaatttgtcaccaccagacctgccctaaaagagctcctgaaggaagcactaaacatggaaaggaaaaaccggtaccagccactgcaaaaacatgccaaattgtaaagaccatcgaggctaggaagaaactgcatcaactaacgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggaaacccatctcatgtgcagagacacacataggctcaaaacaaagggatggaggaagatctaccaagcaaatggaaaataaaaaaaggcaggggttgcaatcctagtctctgataaaacagacttaaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagacttagactcccacacaataataatgggagactttaacaccccactgtcaacattagacagatcaatgagacagaaagttaacaaggatatccaggaatggaactcagttctgcaccaagcagaactaataaacatctacagaactctccaccccaaatcaacagaatatacattcttctcagcaccacatcacacttattccaaaattgaccacatagttggaaggaaaggactcctcagcaaatgtaaaagaaaagaaattataacaaactgtctctcagaccacagtgcaatcaaactagaactcaagattaagaaactcactcaaaactgctcaactacatagaaactgaacaacctgctcctgaatgaatactgggtacataacaaaatgaagtcaggaataaagatattctttgaaaccaatgagaacaaagacacaacataccagcatctctgggacacattcaatgcagtgtgtagagggaaatttatagcactaaatgcccacaagagaaagcaggaaagatccaaaattgacaccctaacatcacaattaaaagaactagagaagcaagtgcaaacacattcaaaagctagtagaaggcaagaaataactaagatcagagcagaactgaaggagatacagacacaaaaaacccttcaaaaaaatcaatgaatccaggagctggttttttgaaaagatctataaaattgatagaccgctagcaagactaataaagaagaaaagaaagaagaatcaaatagacgcaataaaaaatgataaaggtgatatcaccactgatcccacagaaatacaaactaccatcagagaatactatatacacctctatgcaaataaactagaaaatctagaagaaatggataaattcctcgacacatacaccctcccaagactaaaccaggaataacttgaatctctgaatagaccaataacaggctctgaaattgaggcaataattcatagcttaccaaccaaaaaaagtccagggccagatggattcacagccgaattctaccagaggtacaaggaggaactggtaccattccttctgaaactattccaatcaatagaaaaagagggaatcctccctaactcattttatgaggccagcattatcctgataccaaagcctggaagagacacaataaaaaaagagaattttagaccaatatccctgatgaacgcccatgcaaaaatcctcaataaaatactggcaaaccgaatccagcagcacatcaaaaagcttatccaccatgatcaagtgggcttcatccctgggatgcaaggctggttcaatatacgcaaatcaataaacgtaatccagcatataaacagaaccaaagacaaaaaccacatgattatctcaatagatgcagaaaagtcctttgacaaaattcaacaacacttcatgctaaaaacctcaataaattaggtattgatgggacgtatctcgaaataataagagctatctatgacaaacccacagccaacatcatactgaatgggcaaaaactggaagcattccctttgaaaactggcacaagacagggatgccctctctcaccactcctattcaacacagtgttggaagttctggcagaggcaatcaggcaggagaaggaaataaagggtattcaatcaggaaaagaggaagtcaaattgtccctgtttccagatgacatgattgtatatctagaaaaccccatcgtctcagcccaaaatttccttaagctgataggcaacttcagcgaagtctcaggatacaaaatcagtgtgcaaaaatcacaagcattcttatataccaataacagacaaacagagaaccaaatcatgagtgaactcccattcacaattgcttcaaagagaataaaatacctaggaatccaacttgcaagggatgtgaaggacctcttcaaggagaactacaaaccactgctcaaggaaataaaagaggatacaaacaaatggaagaacattccatgctcataggtaggaagaatcaatattgtgaaaatggccatactgcccaaggtaatttatagattcaatgccatccccatcaagctaccaatgactttcttcacagaattggaaaaaactactttaaagttcatatggaaccagaaaagagcccgcatcaccaagtcaatcctaagccaaaagaacaaagctggaggcatcatgctaccggactgcaaactatactacaaggctacagtaaccaaaacagcatggtactggtaccaaaacagagatatagaccaatggaacagaaaagagccctcagaaataatgccacatatctacaactatctgatctttgacaaacctgagaaaaacaagaaatggggaaaggattccctatttaataaatggcgctgggaaaactggccagccatacttagaaagctgaaactggatcccttccttacaccttatacaaaaattaattcaagatggatgaaagactttaatgtcagacctaaaaccataaaaaccctagaagaaaacctaggcaataccattcaggacataggcatgggcaaggacttcacgtctaaaacaccaaaagcaatggcaacaaaagccaaaattgacaaatgggatctaattaaactgaagagcttctgcacagcaaaaggaactaccatcaaagtgaacaggcagcctacagaatgggagaaaatgtttgcaatctactcatctgacaaagggctaatatccagaatctacaataaactcaaacaaatttacaagaaaaaaacaaacaaccccatcaaaaagtgggcgaaggatatgaacagacacttctcataagaaggcatttatgcagccaaaagacacatgaaaaatgctcatcatcactggccatcagataaatgccaatcaaaaccacaatgagataccatctcacaccagttagaatggcaatcattaaaaagtcaggaaacaacaggtgctggagaggatgtggagaaataggaacacttttacagtgttggtgggactttaaactagttcaaccattgtggaagtcagtgtggcgattcctcagggatctagaactagaaataccatttgacccagccatcccattactgggtatatacccaaaggattataaatcatgctgctataaagacacatgcatacatatgtttattgtggcattattcacaatagcaaagacttggaaccaacccaaatgtccaacaatgatagactggattaagaaaatgtggcacatatacaccatggaatactatgcagtcataaaaaaggatgagttcctgtcctttgtagggacatgtatgaatctggaaaccatcattctcagcaaactatcgcaaggacaaaaaaccaaacaccacatgttctcactcataagtgggaactgaacaatgagaacacatggacacaggaaggggaacatcacacaccggggcctgttgtggggtcgggggaggggggagggatagcattaggagatatacctaatgttaaatgaagagctaatgggtgcagcacaccaacatggcacatgcatacatatgtaacaaacctgcacgttgtgcacatgtaccctaaaacttaaagtataataaaaaaaagaaacaatggatttaaactataccttggaacaaataaacttaacagttatatacagaacatttcatccaacaattgcaaaatacacgttctattcaacagtgcatgtaactttcctcaaggtagaccatatgataggccataaaacaaccctcaataaatgtaagaaaactaaaattatatcaagcagtctctcagaccaccatggaataaaactggaaattgactccaaaagaaacctttgaaaccatacaaatacatggaaattagatgacttgctcttacatgagcattgggtcaaaaacaaaatcaagatagaaattaaagaattatttgaactaaatgacaataatgacacaacctaccaaaacctctggggtacaacaagggcactgctaagaggaaagttcatagccctgaacacctacatcaaaaagactgaaagagcacaaatcaacattctaaggtcacacctcaaggaactagagaaacaagaagaaaccaaacccaaacccagcagaagaaaggaaatgaccaaaatcagagcagaactaaaggaaattgaaacagaaaaaaaaatacaaaagataaatgaaacaaaaagctggttctttgaaaacataaataaaatcgatagaccattagcaagattaaccaagaaaagaagagagaaaatccaaataacctcactaagaaatgaaacaggaaatattacaactgacaccactgaaatacgaaagatcattcaaggctactatgaacacctttacgcacataaaccagaaaacctagaagagatgaataaattcctggaaaaatacaaccctcctggcttaaatcaggaataattagattccccaaacagaccaataacaagcagcaagattgaaatggtaatgaaaaaattaccaacaaaaaaacagtccagaaccagatggattcacagcagaattctaccagacattcgaagaagaactggtaccaatccttctgaccctattccacaagatagagaaagaagaaactctcccaaatttattttatgaagccagcatcaccctaataccaaaaccagggaaggacttaaccaaaaaagaaaacaacagaccaatatccttgatgaacatagatgctaaaatccttaacaaaatactagctaactgaatccaacaacatatcaaaaagataatccaccatgatcaagtgggtttcataccagggatgcagggatggtttaacatatgcagtcaataaatgtgatacaccacataaacagaattaaaaacaaaaattacatgatcatcttaaaagatgcagaaaaagcattagacaaaatccagcatctctttatgattaaaactctcagcaaaattgacatacaagggatgtaccttaatgtaataaaagccatctatgacaaacccacagtcagcataatactgaatggggaaaagttgaaagcattccctctgagaactgaaacaagacaaggatagccactctcaccactcctcttcaacatagcactggaaattctagccaaagcaatcagacaagagaaagaaataaaaggcatccaaataggtaaagagaaagtcaaactgtcactgtttgctgacagtatgaacatttaccttgaaaaccctaaagactcctccagaaaactgctataaatgatgaaagattcagcaaagtgtccgaatacaagattaatgtacacaaatcagtagctcttttatacatcaaaagtgacaaagtggagaatcaaatcaagaactcaactccttttacaatagctgcaaaaaaaataaaatacctaggcatatacctaaccaagaagtcaaaaggcttctacaaggaaaactaacaaaacactgctgaaagaaatcacagatgacacaaaaatttgaaacacatcccatgctcatggatgggtagaatcaatattgtgaaaatgaccagactgtcaaaagaaatctacaaattcaatgcaatccgcatcaaaatatcaccatcattcttcaccgaattagatacaacagagcccacatagccaaagtaagactaagcaaaaagaataaatctggaggcatcacactacctgatttcaaactgtattgtaaggccatagtcaccaaaacagcaaggtactggtataaaaacaggcacatagaccaatggaacaaaacagagaactcagaaataaacccaaatacttacagctaactgatcttcgacaaagtaaacaaaaacataaagtagggaaaggacaccctattcaacaaatggtgctgagataattggctagccacatgtaggagaatgaaactggatcctcatctctcaccttatataaaaatcaactcaagatggattaaggacttaaacctaagacctgacactataaaaattttagaagataaccttggaaaaccccctctagacaatggcttaggcaaggatttcatgaccaagaacccaaaagcaaatgcaataaaaaaaaaagctaaatagctgggacctaattaaattaaagagcttttgcatggcaaaaggaatagtcagcagagtaaacagatgacccacagagtgggataaaatcttcataatctatacaactacataggactaatatccagaatctacaataaactcaaacaaatcagtaagaaaaaaatcaaacaaacccatcaaaaagtaggctaaggacatgaacagacaattctcaaaagaagatatataaatagccaacaaacatacaaaaaaaactgagcatcactaacgatcagggaaatgcaaatcaaaaccacaatgcgatatcaccttactcctgcaagaatggccataataaaaaaatcagaaaacagtagatgttggcctggatacggtgatcaggaaacacttctacactgatggtgggaatgtaaactagtacagccactatggaaacagtgtggagactccttgaagacctaaaagtggaactagtatttgatccagcaatctcactcctttgtatctacccagaggaaaagaagtcattatttgaaaaagacacttgcacacacatgtttataacagcacaatttgcaattgcaaaaatatggaaccaacccaaatgcccatcaatcaactaatggatatatcaatgctggggcattgcctagtggagctgtgagaaggtcatcgtcctccagaacccagaatggaagatcctctgacagcttgcactgtgcgcctggaaaagctgcagacactcaacaccagcacacaaaagtagccaggaggggagctgtaccctgcaaagccacaggggcagagctgcccaaggccatgggagcccacctcttgcattagcatgacttggaagtgagacatgaaatcaaaggagatcattttggaactttaaggtttagtgactgccctattagttttcggacttgcatggggcctgtagcccctttgttttggccaatttctttcctttggaatgggtgtatttatgcaatgcctgtaccttcattttatgtaggaagtaactaacttgcttttgattttacaggctcataggcagaagggacttgccttgtctcagatgagactttggacttggactgttggtttaatgctggaatgagttaagactttggggcactgttgggaaagcatgattgtgttttgaaatgtgaggacatgagatttgggaggggccaggggtgagatgatatgatttggctgtgtccctacccaaatctcatcaagaattgtagttcccataatcctcacatatcgtgggagggacctggtgggaggtaattgaatcattatttccacactgttctcctgatagtgagtgagttctcatgaaatctgatggttttataaggggcttttcccccttttgttcagtacttctctttgctgttgccatgtgaaaaaggacatgtttccttccccttccaccatgattgtaagtttcctgaggcctctccagccatactgaactgtgagtcaattacatctctttcctttataaattaaccagtctcaggtatgtctttattagcagcatgagaacagacttacacagaactcttctgttagttgttttgtaccagtatatatccttcctgggcagtatcaaatttggctggacatttcaccactagccttcatttctttttaccctaataaaatcttagccttcctgaagtttattccctgagttttacaattaaagcaatttggatcatcagtcaatatgatgtttcttatctaatatactgatgtcctaatagaatctctcggagttgttcaaaggacaggttttgttcaaatggataggataggttcaaatggtggtcttttaatttgaacaggtgggtgggggagcttctttaggggtgaaagatttcttgcttgtcctcaaaccacatcatgtacagagctgcctattctgcctaagcataagcccatttctgatgccttgtccacatgtggtgtgtagctcattgtcacatactcaaggtgatgcccagcatactgtgctcagcttatgttactgcccatctactaggtatcccctgtccccatgggccttggctacttgccttgcttcccagtaagagtggtcctaaggaggacttgggcttttcctgtgctctttaaagctctggctgccctccttccatgatcaaagaggccctcatgctcagttctgactgataaggaaagtctgtcatgcctgcaaactggctggagtgggcccacagagggcctgctttctcagtgattttccagaaggccacagaaactcaacccagacgtgcacgtaggctagtgtcctgttgaccaatcagatacttttttgtatttactctccttcctccccttcctcgcttttattttttccctccttcttgcttccctgggagaatactccccagtaaagggttacaatataagcttctaccactggctctgttttctagagaatcagggctaaaaaaagaagtaaaaatagatgattgacaatgtcaaagaaacatccaagtgtatctctattttcctaactataagccaaacttagtcctgtcacagttgcccaaggattatgggatacaggaagtggtcaagtgtcacatgatgtagcatggagtgatgggggtgaacatggcaggaatgtctggagcctggactccaaagggcaatgacccaaaggcataagaaagttcatattaatgcaaggtgctcggatgtgtttggctacaacagtaagtgtcacttgtgcctcagacagtgtagaaaagaaattgagataaaggaaatggtgagcaaaccctgagggtgatttttttctttccaggcacaggctttgtggacatcttgccttgttggcgtggccaagggtctaagagctgggtccagctgggggtttctagggagtcctgaggagcagcacgctgctccagttttcctctgggtccacacgttctcaaggtcaagtaaagcttatgtgtgtatagacttgataattgacctgcaaaacaaagagtccacctttacatgtggttcttaaaatactttccactttacgaccaatttctacttaccattcttaacaagcagaagatttgaaatgaccgtatgcataacaggataagcgtctccacaggttcatgcgtgaagctagaggcttagagtggacagtgtcctctaaatgaaatgaaggggaaacgtaataatggcttttaacaaggtcacattgaaagggaatgacaggataaattggaccatttgagaactttgccaagtgtaaaaattaaggtaacattactaaaaaatctatctagataatcttgggctctgaaaaaaagttaatgggaagtggacctaattatttgaactgagatgcagaaaatgtagttcatgtacctattaaggatacatcagatgcccaaggtatctgaacaaaaatgctgacaaagatcaatttaatattgaatgatttatttcaggagacccagaattttttttaaataagagacttaggggaaagtctgctaaaataaacaaatcctgagataatatttaatttggatttgggttagtagataagtttgatttttaaaatatgtctaaagttgagagtttaaaaaagacttgacaaaaatagaccaagtgctttttaactgaaaccaaagaattttaaaaatatagaaataatcaggtgtagcaatatgtttggtttactcccttaaaagaaaaaaaaatcaacatattttaggaatttaaggctttcaggtgactttagatgaatttatattgtttggacaatcttcttaaaatataaaaatggtaaaaaaaaaaagaatcttatgaaaactcagtcatttaattttgaggcattaagaaaaaccattccaagcacttggttaagtcttttctgtatattatcttgttgatttttcagaataactttttaaggaaataatttctgtaacctcattatagataaaacaggtttagggaagttagctaatttgcccaaagtcttacctcttgtaagccaggacttgaactcaagcctctcagattaaacggtatggttagacagtgggacttagaccctgtgctgtcaccaatctgctaagtgcacagagcatttcatgtgtgtagttcagccatgcagactagctttttagcttgtcattcttggataattaactgtctttgacaaagtctgactgctcttgcttctctagcattcatttttggtatgaccactttttctagcatgtggaagaaatgtttgcatgtttggatgtgtctttttgttaatcaagatacagactaatatggcaaagagatgaaaagcttgtctccatttgagcaactccatagatttctgacaaagcaacagaatttggcgatgctgatgctctaagaatgattgaatggataaagttcctaatgacaacacccagggaggtatgattggttttcttttgctgctttcaaggaagcgtgtactctagccaaatttaggatgccccataggacaccaggaaatgttacaaaattttgtgcagtaaaaaaaacctttaaaatgtataagattccttcatacttagcagccttggattccatttttaacaaattttataatataccaaatttaatgagctattgtctgaatatagagtttgtctattttaaaaaagaaagtagtaagactgaatttgttgtgacctatgggatcataaaatttatagtcataggctttgaaattaaactgagtttgaattttagctctgctacttctaggctgtgaggctgggagaagttatttagcctctgtttcttgtttttctcatctcattgtaaggattaaatgagatcatgtattacaaatgcatccattgtgttcatttattattttttataaaccatacttgtacagtcagtgtagcaaacttgattttataagcaaatcaagtttcttcaatgtatatattttggattcttaagtcagtgtattgattttaaggggtaaagaactttaaaaaataatatacaaacgtatgtttttccattttctcttttcccctactttcttatcatccaccctccacctgtcatgaaaaggaaagagaaagagagaggaataagaaacaggaaggaaggaaggaaggagggaaggaaggaaggaaggagggaaggaaggaaggaaggcaggcagacaggctagcaaagaatgaaataaaacaaaaattaattttttaaatttcttcataatttttggaaatttaacttctttagatgctgctatttaaaatacatacataggtcaataaattcaggaaggacactaggctgaaaaattttcccttcggtaaatctgacaccagcaactcatacagcttgtcggatctaaggtctcactgggaagcacaaaggaagcaggcagcagaaggagacatcaaatggtgcagcctgcagttcccagcagtgactctcaatgggactgcatgcattaccatggttcctgcaggaactactgcccagctgattgtcagtggaagtgtggacacaggctatcctcatttctcctacccttatctggtttcccagcagcagatggtgatggtagtcacgtttttccagctgtccacactacagaggaggacccaagtttgtctgtacactcccttccctcattttgaggagtctgagggctgaaatgttatgcaagagaaagatctggtttgatactttggatccctctaaaattctgtaatttttatctttaatgaaaattgctaaatagtacaagcttggatagtggcaaattaataaattcaagcactctataaataactaaagtattaataagcatctctctaaaagtttgggcagaaaattatcttaatcttacattattatggagagggcatgaaaaattacttgatcatgagatacataatacttatcagtaaaatcaatccaggggtaatgtaatagcaaaatgttctatcatgattttaaagccattatccaaattagttgctgaagaaagaaactaaatataataagaactgtagaaccattagtagtattttggtctcactaaaagtaagctgtaagaatgctcatctaaaattacaagcataattaaaaaatcacagaggccttgaaccaaaacacaaaatgacaatcatgaaatccatcaactgctctaatagcaacttatgtttatatggtgacttacactttgaaatgagatttcacagatgttattgtaatacaatatcctttgaagtagatggacatgcaccattattcctgtttactagatgaatatactgagactcaaagagattaggtaacatgacaacatcagacctataatccagttttcttgtcttcagagtaggtctttttttttccatctctgcaggtcatagatgttaatttttattgtgtagcagccactggaaacatctcaatttgctcgaagaactcaaatactcatctatattttgtgtatatgtgtgtgggggggatactggtgctaatgttgtgcttctctgttgcattggtggccccaaatgaaacatatctcttgatattcttttctttgcatgttctgccctttgtatctgagcgtgacctgtgtttgcttaaaccaaaagaacacaactgaattgctattattccagttctgggcctaacccttaagaaggcctggcatattttgctttgtactcttgaaagcccaagatattcgtgaaagaagcctgactagtctgctggagaggccacttgcatagagggataaaatggagaggctacttggaaagagagagcctctaaggcagcaaggaaagagagaagctcagacataccagaaccctggctgagccccgtccccagacaatctgcctgctgaatttaatcacactagtgaccccagggggtgactaacagaagaatccccagctgagcacagccgaggctgcagggctgggagaaaataaaacgaatgttgttttcagctactaggttttatggtggtttgctacagacagatacctgaaataaatgtcaaagcaatgggcttcaggcttcattactctttccaagtacacagttactgaatgagtaagcattccacaatcctacatctcaaaatccagatgacagttctatgaattctgcattggatgtgtttcatcatcagggaaaaagaaaggcctgctgtgaaagaccaaaacattcacgaaactgacttattttgtatcagagcaataatgctgctaattgtttaaaccaaaaacccaggcacgatgtggctgccaagatatgaaatgacactccgtaaacttgcaatttcatttcacatccatgaatgcattttcatcctatgaggactgctgtgtatgcgggtgctttcaattctgggaatgtcatctgggaaaagagagcagcagcttggccatgaaactgcaggtttgcaaattagcaaattttcagcactctgttcattagtgaaatcaatgagacttttaaaggactgagaaaaattgtcaaaatatgagcatatgaaatgatgacacaaatgggactttagaaactcaggggtgaatttgggggagacacagcacaggaagaatcctttgataaactcccaaacaggctacagttggttacatcaactgaagtgactgctctgcctctaggtcatttgcaactttggaattcttgcttggaactggcttttttgggtcatcacttggtttaaattatgttctcttcagattaagagcacaccagatgttaagtgattctcttcaactgtgtaattttaaaggaagttactttaagatagttattaacttaactgtatatttaacacttaatgcaaaaaacaatcatggttttcataatggaagcacatgattcagagggggagggaaaggcctaaactggtatatggtaagatctagcttttccaactgttttatcttgcctgccactggcttgtgggaattcttccagaggcagctgatgcttctggaagtaagttaaagatggccaagaaaagcctaacatacagcccctgccttcaaggggcttagagtttagttaaaaaaacagtgatttgggaggttcttaaccattctcacagtcagagagcctcagagatgctagtgatgaaatcggtctttccattatttagaaaaaatgggtgcaagttagatatacacattgctttcctctcactttttgtgtcaataggcagcagcacgattccctagtccccacctcttattagtcaccccaaatacctacaatcttgaaatatatcaactgccctatagcgacttacattaaatgatgccttacaatttaaaatccaacttcgtagttttttaaaaaacaaaataatcctaaaatgtaggtgaagcataaactactattcttattttttttaataaataaactgattgagagagatccacacaatatgtgtaaaagtcaggaggttatacactcatagataataagttgttgacttttagcaaaaattctccagaaacacaattcttattctgtccagttaccccggttggaaatcagagggggtggctgtgaaggggtagaagatttatatggaaagaaagatgagtatcctatggtgtgctgaggataacttttcttgtggaaaaagaaaagtcataagctcagaggccatgggattgctgggatgccattaggaaggagtcagcccctcacccaacttcccacttttaagtgggtgtcaacctgtatgttaattgcagcactattcataatatctaggatgtggaatcaacctaggtgctcatcaagggtagattagatagagaatataaggtacatgtacaccatggaatactacacagccataaaaaagaatgaaatcatgtcctttgcagcaatatagatgcagctggatgcaattatcctaagcaaacgaatgcagaaacaaaaaaaaaaaaaaacaagcactgcatgttctcacttataagtgagagctaaacattgggtacacatggacataaagatgggaacaatagacactggggactaaaataaggaggacggagggagagggataagggttgaaaaacttccctgttgtgtactgtgctcactacctgggtgacggattcaattataccccaagcctcagcatcatgcaatataactttgtagtaaacctgtatgtgtaccctctgaatcaaaaataaaagttaaataaatacatgaatatgtaaatcatttccaaaaagtacacagaaactaccaacttaaagcagaaaagaaatgacaggaccaacatggcagaagcctccttttttaaaaaaaatccagtgctgaaataatgcatgttttctggtgtgtaggagagttccaaggcttaccctgtctgagctgttttcactatggtgtatgcatgcacacatacatgcatactcacatgcatatgtgtatgcacatatgtacatgcacacacatatgttattgctttaatctgctgtatttagtggacacataacctggagaaaacactgtgccttttctattttcatctgtacgatacctgctgagaagctttcagtatcattttgaatagaactagaacaaacggcacgattttgtgcaatctcaactgtcctcaagcttgagctatagagcagagaacactttccgtcttcccacaccaaacagcatccttccgaagtgtttgaacaggacatattttctagaacaaaactaagacatgaactggactgatggaacatttagtttgaatttctggtctctagtaaatggttcaaactctctgtgcctcagttgtctttttagtaaattgaagaggattaggattctttcctgataggaaattttaaccatgtgagaaatttttttatattacttcgacatgagagaaataggtttactgtaaatataggattgttattttttcccaatggttctgtgaactcaattaagagataatctagtatataccctgtgtgcactgacatttattttatcctttctcatgagagccaaaggacagacacagttaatccaatcatggcaaatgaataaacttcctccacagcccaggccagacatttctcatgctttgtctagctgtctctaattttctgtttgattttctaccactcacatgcaagatagagggttgctttggcagaaattaaatgtgcaaaaatgttttaccatctgctggaatattcttggatgttatccttccagtagcactcattattaaaaatatttattggacatgaacaatatatcaaattctgctcaaaatatggctgcctcacagttactgctcaaacaagaatgaaaaaaaatcacatgattttaaaataatgattgcattagttctgtccctgaattttgctgctcttgacactatttttctcgtctgaggaagagtggtactatttttcccctccgaggaagaggaagttatttaaggcaagaattgcgtttctcttatttaaaatatgaacagcccttaacacagtgcatgttagtagaggctaaaaatgttgattcactgataaatttgtaaagcctgttttaccacctaaattgccagtttctcaaggggcaatgacaggatttactatctcttaggtatgtgaacatctgttagtttttggttttgtattttattttcaatgcccagaatctgacgctgtagtctaggtttagaaaaacacccactataaaagctgaaacaccagatacttgtttttcccagcctcccttgcagctagggtactggcagacaacctagttagatcaattaggagctaataatgttaagaataaagtactgtgtagaatttatttgcagcagaaacatttgacattacaggagtggcagtggtagcagagttaataatgaaggctgtagtggccagtgttcatagaagtggcagaaatcctttttccaaatccttcatagttctcattgttttccaagccttattttatgactttgtaggtaattatctagccctgagatacattcaatgaattatcttctgctgaaattaggcaggacaatttctgtggcttccatgttaagaaacctagctgatgtattgggcttattctgaagcctcttcaacatagagttttagtcaacatcctatagtccatttacccaacatcattttgtgttccacccatggaaaattctacattctgttgtatttttaactgtttttatgcattagtctttcctgtcccatgatattataaagaacttgcaagcagaaatcacattatccttctttttaacctcagagtcatacaggattctttaaaaagagtacatgttgaatacatactttactgattgatatcaggtaaataacatcagaacaatagtcattagcactgtgggtatatgactcaataaaaagatagatgccatttttttctagaccaagatagagaatacatgagttgcttaaaattaaaattcagtgccatataagaggaacaaaagatttttactgagttcaaactgctttgaatttaatttagtcaaatcaatttttgtaactagacagtcttaaaatggagactaattgtaggtgtagccttcaggctaaaattagacaaaataagaataaaaggatggattttcaatgtcgttggtctaatgtcagcattagattaatgataatagtgcatgttctacccctttctttatttcttcttttcctgccccaaacacaatcacataactaagtcagaggaaattggtttgagattgagtgtcaaagggattcaagaaaggattgagggatagaacttgatgcaggggaaaatctctgaaaatgtggccttggctatggaaatgggcctgggaactgagctgtatgtttcagggagggaactttggtagttggtggtgggaggtggtgtagagaactgcttgtgtcagagcacaaaagattatatctgtatttaaataattagaatctgattctacagatttcagtgttatgatgaatcaatatcaagcagttccttctgttattcattaattcaacaaccatttatggaagatcttttttctgtcatgcattgctctaggctctagaccgagaatagtgagtgagacagataaaatcctgagcccaaggagcatatattctagtaagagagatagataaaaagccatcaaggaggcagaaatatattctaggtattagacagtgataagtgctataaagaaaaataaagtaggatagggagatagagggtgatagtgctgcaattttaggcagggttgtcagaaaagtttttctctgaggtggttacatttgggaagagacttcaaatgaggaagtaggccgggcatggtggctcacacctgtaatcccagcactttgggaggctgaggcgggcggatcatgaggtcaggagattgagaccatcctggctaacgcgatgaaaccctgtctctactaaaaatacaaaaaattagctgggtgtggtggtgggcgcctgtagtcccagctactcggaaggctgaggtaggagaatggtgtgaacctgggaggcagagcttgcagtgagctgagatcgcgccactgcattccagcctaggcgacagagccagactccgtctcaaaaaaaaaaaaaaaaaaaaatggtgggggagtaatccaataaaacatctaggaagaggaaaaaacaagagaaaagtccctgaggcatggttgtactggacttgcttgaagaaaagcaaggaggctagtttacctggcgctgactaaaccagtggaagaatcataggagatgaggtaggaaagtgtattgaacactgtgatgcactgaccagattccccttcaacgaataaattgttgctccagctgttaagagtgctatgggcagacaaacatcagctgtcaggccttccagggactgccccagctgctaagaaccacctcaaccaaggtcttgccccttttgggggcagcctacacccaaacactgatcagtgagggagtataaaaggccaacatcttgacctaactcaggacaactccaaagagccattccagcttcagagcttgccatgaagttggcgaaaactattgtgcctaaatctcagtttgccctctccctctgcccactcttcctttgttttcctcccttccgcagatgtcgattccaagggcgttccttaataaaaactctgccctctaaactccagagggataattcaacctgcttcaacaatgaggtaggtgattggatttcattgaaagtgttatggaaagactgtggggttctgagcagaggagtcatgtaatctaatttatattttacagaaattacttggctgctgtaaactacaggaggaaaagagagaaagttgggaaggtattgaagtaatccaggcaaaaggtgatgatgacttagactagagaagcattgatggaagtgatgagaaatgagtaggttcaacatgttttccgaaaggagagctgaaaggatcaagcaatgttctttaactcgtcaaagacgctataaaactcaacaattagcatcagaaacaaaagagtcaattaaaaacatggccattttacaaggattagtgttgtttaaaatggacaaaagcattaatataagtcaagtcatctcttatattcataatctaaatgctttgtttatgtcacagaaacaaatatcgctggattacctggtagagtgcccagttagtgctggtgggctatgcactctttatatcaggagttagcaaattacagcccacgagataaatccagcctgctgcatgttttcatgtggcccatatcctaagaatgatttttatatttttaaatggttaaaaaaatcaaaacaagaataatattttataacacatagaaattatatgaaattcaaattgcagcatccatataaaagttttattggcacataaccaagctcatttgtttatgtatagtcaatggctactttcatgttataagagcagagttgtgtaactatgacagaaaccatgtggcccacaaagcataaaatatttactaactggcctttagaaaaagtttgctgacctctaatttatctcagagaagtacagcctggtgaaatgcccagttaatgctggtggggctggtggcctgttcacttactctaactttgttcctgctagataccagtgtgatgagcaatcattcagggtcagtttgtttaggaagggcctacaaaattctggctttttccatggttccttttgtttgtttcaaggtctattgtgataccatggctgttagcagtttcttgtgataaaacatgggcttgagacctcttcaactgtccttgtaactttcaactaatcatatccatggtgcagcatgcagtgacgaataaaagcaaatgacaaatatttcagtaccattttccacaactttctatgtgctccaatttctccttgttctccttgttttccccctgccccagcaatttggacttgacatttaagcttgatcttccaagtattgatccttaatattctctatggattttgcctcatacttgcctttatgttcttccgctcgtagctatcctagaggaagctctagactggctttggccccaggactcaatcctagtactgcccttcctaaaggactctcccttccaccagagtctgccttaccagttggttgtttttccactgtgctcccactgttgctccatggtcatcttctctcctctttgcatgaacacactctgcacccagcttcactttaccccatctccttcctttgagctcttctttgcatccactcttaattaatgctcttctctcttgaccagagcactatatcaatgaagagaggcctcttgggcttctaagggtgcaggaaccacatcttttgccaggagacccatcaatttacttactttaattataacaagaaccgtagttattacaacttacatttattgagcgtatatctctgtctctgatggtgcttgtattaggctggtagagctgccataacaaaataccacagactggatggcttaaacaatagaaatttatttttctcagtttgggaagctggagttccaagatcaagatgctggtagggttggtttctggtaaggcctctcttcctggcttgcaaatggctgctttcttgctgtggactcacatggccttttctctgtgcatgtacaatactggtgtctctttgtcctcttatgaggactagtctgattggattagggctccaactttatgacctcatttaaccttaattacctccctaaaggccttatgtacaaatacagtcatattgggtgttagggcttcaacatatgaattttagggtacacaattcaggccataacagtgcattacaaactttacttacaatgtctcatttatttctctcaacagttgcatgaggtaggtgggtgctcttatcattcccattttacatatgcagaaactgagattcgttttggacaaggttacatttgtggtacctttggtagatttcatgctgaatctcaggtctgatgaaacccacagctcactcctttaatcttttctgtatatggcctctcaaagattacctagctattttaaaggatttacagaagttaactctaattcactggataactctttttctttcattggttatgaacaacttagcgacctctaggactatttagtcagaaacccttgctgcccacatgatctgcaaggcctatactgccttaggctgattgtggaggagtcctggaagacagtggaagtcaattcaatgtaaggatgttaacactggggctgtagctgtgtgcaggattctgtggttcgattttgtagcattctggtaaaaggactatttgacaagcttccatgattttaagtaagaagaaaaatgtgtgtgtgcgttgtgagggagtgagggtgggtgggtgagtgtgtgtaaatgtggcagcaggaagggtggaaggggaatgaaaatgaaaaataaattaatatttatggagcatcaattatgtactagaaaatctgctttgctaaactataacattttgtttcatccttgctaggcctgcttttttaattaaaatttttattgagataattgtagagtcacatgcacttgtaagaaataatagagagaccctgtatatttattttgtgtttgtgtgtgtgtatatatgcatgtgtttgtgtttagttctatacaattttattatacatgtaggtttatatccacaaccactgttaagacccagaagaaatagtttcatcaaggcaaggacaccttatgttctccttttataacatgcttacctcctttcctgtcgcaaaccccagcaaccattaatctgtcctccatttctaaaattttatcatttcaaaaatgttttataactggaatcatacagcatataatattttggaattgacttttctcgctcagaataggtccctgaagagtcatccaaattgccgcatgtatcaataattcattctttttgtcaataagcagtattccatgtatatacgtatcccagttggtttaaccattctctttttgatagctatctaggatgattccagtctgtgcctattactattaaagctgctattgacattcatgcacaggattttgtgtggatataagttttcatttctctggaacaaatgcctgagagtataattgcaggatccctctaggtgaaggaagagagtttggggcccagagcgacaaagaaacttcttgtatggggccaattgctagagttccctattgctggttcttttcacccacttcagcatctctcggtggggtgagggagtctaaggcatgactgaaatggagagcacttctcctggctgcttattgttggtagggctccttgttgatctcccttgcgggagttgccaggtcaggggtagggaaactccaagtctgagttgccttctcttccattgagtgggggcacatgagacactgtgcttctgggttgtccctccagtgttgtagtctcagaggggttcatcttcgcatcacctttcagatatctcctttagttgtctcttttataatttcaggggcttaatgaggagaagcaaggcaaaaggggtctatggagtcttgcctagacaggaagtctaagtctaagtaaagagataggaaattcaggacagaaaaagtctgagcaattggcaatgggtgtgttcactgtcctttattgtctagtcagaacaatgttatagagcagtgacccttactggttttagccttttgcatgtgacagttttcctagttttcatatatctagatcaccattctcacacctttgattatggggtggacgtggagtgggtaggcagacaatagaaggttaatcttcacactgggcatctgtttcaaagccaagattcatgccccttttataatttctttgagaacagaaatgattgggtatgataagacccaaccataactctatggccttattgaggtggatcagtgggcaggtcatccttccctgttctttagaaccaacactgaacatcaagctggcacaagctttggacaaaaaaacctgtcagaggcgttgcaagcattacatgttccatttgttgcgagagcatgaaagtttacctttctgagaaaggagcactcagaattttgttggactaatttaataagttacacaattttgtatgtccgtctttttcttgagagacagaagactaataaatctatgatagaggtcagggcactttcaggttctatagtagaattcgtgtaagaatcttgggaacaatgatcgtaagagtattataaggtaagtattattttctctattttacagatgatggagctctatctcagcaaacataagtgatttaacctctggttaataagggacaagagaatccacctactttgaatcctagtgatgattcaaaagcccatgctgttccttcaatttagttaaacttttattcagtgtaatgtcttgtgttaagatccgaggaaaaaataaggagtcagacatggtcgctactttccagggaatcacaatctagtgggtaccacggactctttgctttaactttattcacaccccatccccagcctttcttgttttgtccatccaatagtaattaaagctaacccctttacctatcatatgctggccttagctaagaaatgtcccattgtaaattttcaaattctgtgattttttttctgtttctttcttcaattttcctttaggtgaaagttacattgatacagacacaagcgaaaaatttgatggccaataggggacatgatccattttccagtgtaaggaatctattactatcttttatatctgatgtcttaaaaacgatagcaatgattgtgtttccgttaaaaaaatcgtttttacatgatttccttaataagtgacataaatagcgcttatttaaatgggagcttaatgggaagctttcataacagattaaatatttcaatgttcaaaaatgtaaattttatccataataagaaaaaagtatttcttactttttgcatcatcactctcttaccctgctatggtaaatattttgtctcttttaacttcatttagatgtggcagcagggagagaaggaagactccaactataaaacttttatagtcaaggacatctagttagaatcttagctctgccattcacttgctatatgaccttaggcaagtgacatagccttgccgaacattagtgtctttattaagaaaaggcatgggagaaaatcaaggtgtcagcaggactccctctggaggctctaggggagaattcattcctttcctcttctagcttctggtggctgccagcattccttggtgttctttggctggtggccacatcattctaatctctgcctctgtcatcacattgccttcttttgtaatctccttctgcgggtctcttataaagacattaacacgggccgggcatggtggctcacgcctgtaatcccagcactttcggaggctgaggcaggcaaatcacctgaggtcgggtgttcgagaccagcctgaccaacatggagaaaccccatctctactaaaagtacaaaattatctgggcgtggtggtgcatgcctgtaatcccagatacttgggaggctgaggcaggagaattgcttgaacccgggaggtggaagttgtggtgagccgagatcacgccattgcactccagcctgggcaacaaaagcgaaactccatctcaaaaaaaaaaaaaaaaagacactaaaattgtatttatggttcacctggataatcgaagataatctccttatctcaaaagccttaactacaacttcaagacctttttgcttataaggtaacatttacctgttccagggattaagacttgatatcttcaagtggccattattcagcctactacaggatccatttaggtaaagcttagtggggtatgtctatgtattttcacagtcattttcttgtgcagttgttactagccatcctgatagaataatataatcctacttcccatgatgctaatttatctctcactgtaacatgaaggttaaggatcatattgtgatatgaacttgtcctttggaacttggaagcatgagtataaaggtaggtagtggaggacaagcaaatataggcagccagaaactgatctgtgaaaaataattataaatatcacagtgtatctatgaaagaaattcgatagagatttttgtaaatttggcaatcctaataatgcacctgtcattgtcaataacaggttgtaaagtggaaagaaacttcctaaactatggatttttaacaaatttccatcatttgcgctagaaaaaaggctgaattatctttctgttttccgtatagaaaatattataaaagattaaggaatatgcagtcaaaatgtagaaaataatgtacaatacaggtgtatcaggcagttaattcatcaaaaatattagttaatttttagaaatgttcatggtatctgccaggttttaaagattttgtaatttgttgtgttttctcattctaaataaaaattaacttttgcagttgattttgtatgtatcttctaaaatggctccccagaattgttcaaattttaggtacaataaaacctagaagagctcaggccctctcccgaatgctctgtggttcaggcatgctctcttgggagtgagtgaaaggacagtttctcatatgcataaaggggagctgcctcaggagacagagctcttcaacaatgacaagaagtcagttttatttacaactcggcaaagctggcaacacagagcagttgctctccagctacttgtctggggtatcttcctgaacttggtgcttctcccaagtgtggccaaaaaaccaaatacttatggtgatttgttgaatgagggatgtgcagtgcattcatccattctttgcacatgctcatctctttccctggaccaaggtagaccatcagagatgtgtgtggatgtccttggcaaattgctcttcctgggttatatttatatggtggcaccaaggggagtgtaagaaacttccctttgaacctgtttctgtatttactgtagggatgctgttgaggaagttgtccattatattcctgtttatgagaatccaggggagacatttctctctggctcttttgagtatcaagtctgatttttattgtatggatgttgtaagacatgtgcctggttttgtctctcacatctcacatctctagtgaaacaatgaggacttagaacacgcatttggggtatcaatataacccctggctctatctcaactacttttattttctcctttaccctgcttttcttctttgcttcttattagtttttatcttatataattaaatgtatttatgtaagccaccctaaaatcagtatgcaacaatgtggccagaaataaataatcatttaaaaaccatgttaagtgattaaaaaaacaataaaacatctaaagcacatttcccctcaaggcattattaattacctgatatttctgcacaggccttttgcgaacaggtcagaaccatatttagtgaaaaaggatccaggttttattaatgaaactttagatattttcagcagaaaagaaaaaaatatttttttccccattcacttttttcttttcccctttgcattatattgttcatttaagggtacagaggttctctgaagcccccagttcttttttatttaagtagatttagtcaaattacacataacaaagacgacaaaggcctttctaatcttcagtgctttctgctcctgggaaaactcaggccttgtgttcttgtttccctttcctgagtcagcgcttggctagtccaaggctatggggctccaggtcagacagttagaaataagcatagagagatagaaaaaacaacagcccatagtttaaatttgaaaaggagccttgctctttaggtggcagcataactttgttgttaacacaattctggagagaaggactagggctatgggatgtcaagaacatgaaaaacatggtgtttctttaaccccacttaaattaattgtgatgctaaactacagagtgggataatacccctctggctgaagagataccgaaaatatataggtaagattataaagtactaaggttattttatgtacctgagtctgaatccctgtttcttattctccaaggaaaagttttctagtcttttgctgatagtgacataagctttataagtcttttaattctgatagtcttatttttttttccatgtttgtttttagccctggtgaaaatagtctctagttaatggttaatatagtttttagattacttccaactaagatataatttgattatttttttcctttgtaggacaggaaaaggtgcagtaacctttcttacccatcataaaaatcacagccaacactcttgtaacaaaagataggttaacaagagaaaagcataacaaatgtatttaatcaaaattttacataacaaggaagccttcagaaatgaagacacaaagactcagggaaaattgtctacttttattcttagttttcatgaagaatggacaaccatgtagaaatatgattccacacaaaaaatgtatgatctaatggcaatagacggagtgggaaacccattaagtcctgcttgtttggcttctccttgacctctgtgtagcattcctttctcccaggtatggggcaggacccctctggaataaggatcttatgacctgctatcagacaaggtaggtcagagaatttctttatggccagctcctactgttgtgccagacctactgactccaatagggatagcaccatgtcctagaagcggaagaagagaggagacccggaaccagcagatgacacatagggtttactgaggacttacatatggggcagtacagtggtggtgggctggactgaaaacctgctaccaccctccacctaacaacctccatataacccaaaacaaaggaccttaatcccctatatggcctgcattccaaggcatgggccagggggtcatatgtccttcatagacaaggagcgaatctctaggtttgccactcctggatttcttagctcagaactccaaacacacattcttcttagacttgagggtctttctcagggtatgcttaagttattgctgtcagatgcatctgctatacacctacacagaaaggtgggggatagagtggctttgcttctgaggcattccaatctcctttagttcaaagtactcagcacactaaagtgccataatttggcatgtcattttctgagccctgacaccttcattactgttattgccaaaatttcttgcctcatcaacatggccaatttttaattacatagctacattagattcaccttgtaatttatttttgacctggtggccatctgatttagagtttaggtagtaatattttatttcaggatttatgaatcagttttctatttgtcatctccctgactgtcgaagttcttatgaccttgacatggcattattttatgtacttccccaggctgaaactccatcttatacaccattctccactttatgatttcctgtctgtttctatatcctgtctactggccattcacaggaacacttcaaatcaatgttcgctttgtggacctatgcaaattaccatcccattttcttgacaatctctgctcatgcagcacccattcatgatggtttcttgtctgccttttcctgggctgccttagagcttttccaagttcacatcctatattaaataaaaggaatataaaattaaaatcccaatacaaatcatccaaactaaacatctaccaatgaacttgcaggactgttttacttagagtatcatttctgcttcaggatcgctccatctttgattcattaaatgtgtttaagcaataattgctacattagaatcttttccttttggttgctctgttgtaaggctctagaagttatgtacactatgtgtaaatcatgctgcacatgcattctctttctttaccccaatccccataatctcagtgtaccacattaacaaaagcatcctaaaaaggaatccaagaaaaatgttacacatcatttgatcagtaaagaccgtattatacagtcaaagggacattaaaacaaacaacagcaatgcttaacatgctgagcacttacaaggtgctaggcatgtacaaagcaatttgcatatagtttaactaatctaataacaaccttaaaagtgtgtaattatagaaatacagaaacatatggttcttgttctccactctagaggggaaaaggccagctggctggctcctagaggaattcactacctttgtgaatttcttgagaaccaggacctggctctcagtctcatagccctaaacacctgatcagcttagtgaatgtggattcatctctcaggggtgaatcataagccaagaaggaatcaccatcagacaaacccagtactcaaacccacatgctcagcatatgcatcagtcaggggctcaacaggagacagatggcatgctgaaattaggatatttgagggagggcttaataaagggagttatttattaataatacaaaagtgtgggcaggattagaaaaaccatacaggatagtatggaactgaaagctagtaaaaatttctctgtttccacctaggcttaagaatggtagcccattctctaggcctaaaggaaagaggagaggaagcagtttcaatgagagagtcttggggtgagagggccaccttgacaagagctgcaatctttagtcaaagaattcagccagcccaaagcaaccttacagggagggaattgtgagaattaatggcctgaaatcacttttcgtctccagccacgaggtagggctttctattggtgaagtccaacaagaagccacaaggcaagactttttttaaggcagtctatacaggtcagcttcctggagtaaagggcagggtagaaagggtagagggtaaatatggacaggcaaagggaagtctttcagcattgaatatcttctccttaagccaaacctgggtcagaacccacttcacaaattcatcatgaataattaccacattaggggtaggaatccttaaagttaatgtagtcggcccattgcccactataggcagactatgtgagaggccagatcatatttagaaatttattggcaagcatggactcaagggaaactaggagaatggagtgatttatgatgtcaacccctggggactggaatgctaaaagctataaagccctgtggtgtctattgctacataacaaactactataaaacttagtgacttaaaacaataaacaagtatttttaataattccgtgggctatctgggtgttttttttggggtctggcaacttctttgaggctggatggtctaggatggcctcacttagaggtatgaggcctcaggtaggatggttggacagctgaggactctctacatgtaggttctcattctccaggagattggcccaggcctgttcgtgtgatgtaggaataattcgcagaagcagagaaggtaaccccactatgtgagcactattcaaacctctgcttatttatatttgctaatatcccattggccaaagcaaatcacatggccaaacccagatacacgggtggaggaacagactccacctcttgatgagaggaccttcaaaatattgtggctttttttttttttttccaatttaccacacctgtaactccacattagcaatggtctatcctgttgaacaggaaacactcaaagtttcttcgcttatactctttctccctaacccagtgcttaggcaattgtattttgtgatgttctgctatgtttctatggttgattacaacccctactgtgattgcagttgctaccagttcttacagccattctgtgttttgagagctattgggccatgagtcattgtgttgatgcttaagcttaattctcaaacataattttattttccttgtttctgatttttaggagactcttacatttagtccccaagtattaataatatgcattattattctcattttacatattgtgggattaggaacacagaccgtagaggttggatcagaatcctagtctaatagaatccacagcctgctctctctctctctctctctctctctctatatatatatatatatatatatatatatatttatatacagttgcttcttaaaatttacgtgaaaacactttctaaatataaaggagcattgtcatcatcatcactcttattaggattgtcagtattattgagagtagagccccccccccagtccacagtgaggtaacagcattacagcagacaatttcatccttcttttttttttctcctgagccagcaataagcacttcataaaacttacataaaaatcagtcttgattagaaggttctgagttaatggttttccattctattaaattgccacttattcttttaaattagctgtcatttcaatagggaagccaattggttgagcaaccaggctatagggtgtacagattaagccatctgtagagcaagcatgtttcatgctcccattatattccatataaaggacaagaacaggcccatagtttgctgaatacttagtccctgcgttccagagaattactgtccagtttagggccatcaaattaaatttcattatgagttacctgagtcaatattcctctatattcaaataaattgtaggtctcttagtggcaggaattgagatgtatacttcttttgtgtagcacctaacacataaggcacatattaagtgtctgagaatattgttgattgatgtattgactgaaggctgagagaagttatgagtaggggttgatggggaatagtggctccttctataaaatactattgggtaaacattaatcctttggatcaggaaagaattaggtttgcctgcactaatggatgcccaaatcagagtagcttgcaaaatatagggagtttacttttatttcacataccattaaatttagcagtagacaataaagaggtgtggaggctttgtggatgacatcagtgacaccatctccttgggtttttctgctgcatcatctcaagcacaagtatttacaacatgcattatcaatttatcagcatcttacaacgcatattttgggaaatgttaatctaaatgaaatctttcattttgcaaaatcaacagaatttaattcagcaaatatttattgaacaaacactatatgtcaaaaaactgtttttgaagcccaggaaaaggatagagaaggaaatcaagatcctaagaggtgaagcaacttgaaagttgacacatcaaatgaatggactgagacaaggctagagtctgaagcatgttcccttcttttaacaaacatgaccaagcctcaaagaattacacagggcaggctttcaggcgttattataataattctcccttttcaggttagtaaatgtggctcagagatagtgagtaacttgccctaggtcacccaactatccagatattgaacagaaactttttcctgactcatgtgaccccagatttcttaattttttactatagcatgtttgttgttttcctatttcatctttgacacagcaaaatatagaaactgcttcaggtatgggaggtggcaggcttaaaggagttcagttcttaagtttcaggttagttccttgtcctagcagggagctcatgcaggaacatggaaacagaggcttagacattcatgaggtcagtgagctggccatctttgatggcagttggcccacacattaggctgtaccctgcccatctgaggttactgcagaagccagatgtgttagtgtcagactatttcaacattcctattgtcgagacagagagagaaagaaagagagagagagagagagagagagtcttcaatgcaagacccagacatcatttccttaagccctgggcagggctgaacttgccagatgtatacagcagtggcttccatgagttttccgacacttctttcatcatcctttcattccttactatatactgtctttgttgtacatgccttttacatcccatccaccaccaaatactttctaagatttcttctttagatacgtattttgaagtgtttcctttttcttttccattaccagtcttcaatgatgcattctaagattaccatcgtggagagatcaaacaggagactgtcaccagactctcacattccagtctctttctctgtcctcccggaaaaatctttaaaccttatgctatttctatgttcaaaatgtcatatataatacctagcctatattaacatcctttaccaaatgtggcaaagactcctagtgtcttatccataattcttctcctcttattttttcatttaaaaagccctagttttgttcaggttagcaaggtacctggttaaaacaataacaacaacaaaaacattacatttgtaatacttccttgaaaatatggattgcctacccattacagtaagaagaaaacactggatgagctcctagaaaaatctatttaaatagggctaacttagctaggaaagctagactgtggacttgactgatattccagcaaccatcttgtaattatgagaagaatggaattcatgcactaaggagcagaaagatagaaggcacttgtctctgaggacttcatggagctgccatgacatctctgaattctagaattatttttgctagagaaataagtctaagccaaatataggcattttctgactaacctcaataatccatcatagaaaataagacatgatacatgaaaatgctaatgatgtctagttcccattattttaaatgagaaaaatcatgggtttaaaggtcaacgaaaaccatctgaccaatttcttgaaacaaaactaaaacacagtaaattgccaatatgcaaataacaattgtgttgatttgtaaaatactcaaaatatcactttctaatatacaaacaatcaatactgttgttaacaaacaattggaccttccacttgcagccaaaattgagtaaggagtaccagattcactgaaccaaccaaaacaaccaaaaaagtacacaaaaatatatgaaacaacagtttttaagacattagacatcatgtaaaaaaggacagtgattcctgagatctgagaaacaaatgaggtaaaccctaccattggcccagcttactaacttcaaataaattccaggctgaagtacagagaagaggaactgaggcagagccagaaaaattccctgagttgaggagatgtggctgaagatctggcaagaatcaatgacctcagcttcaaccttaagaaactggaaaaatacgagcattatcaaaagtaaacataagaaaaaaaataataaagttcagacaaaaaaatggactagaaaagagaaaaacaatagaaaaataatcataaaactattagttggtttttggagaaaatcaataaaattgataaaactcttgccaggttgatcaggaaaaagagctagagctagaggtggaggtagagagagacagaaagaaagagaagacaaattatcaacatcaggaatgagagaaatgatagcactatagattctatagataaagaacgttatgaactactttatgcaaataaatttgataaattagaataaatagacacattttttgaaaggaacaaactaccaaaactcacaaagaaatagataatttaaatagccatatatctattttaaatatgtagtaaaaactcttctcacaaaaaatcctcagaagtagatgccttcattggagagttctaccaaacatgtaagtaagaaataacaattcttcacaaactctttcacaaaatgggtgaccataaacaagtatacaagaaaatgctcaacctgattagtcattagggaaataaaaattagaaccacaatgagaagtatctcatactccatactatgctccatacatattagcatagcccaaattaaaagatagaccaggccaggcatgatggctcatgcctgtaatgccagcactttggaagtcctgagacgggaggatcacctgagcccagtagtttgagaccagcctgggcaacataatgagaaaccctgtctctacaaacaaaacaaaatgaaaaaacaaccattagccaggtgtggtggcacatgcctgtattcccagctatttgggaggctgaggtgggaagatcacttaaaatcagtagtctgaggctacagtgagctatgatcacactactgcactccagcccaggtgacagagtgagtgagacccacccccgccagccccctcctctctctctctctctctcctctctctctctctctctatacatatatataatatatgtatatgtatatatgtatatatacatatacatatatacacatatatatacacacacatatatattttatatatatatatatatatattacttctggtgggaatttaaaatggtacaaccacattggaaaacattttttgttgttgctgttatttgaatagctttaaaggtactagtagtttttggctacatggatgaattgtatagcagtgaaatctcagcttttagtgtacccatcaccccattggtgtacgttggactcaacaggtgatttttcatctctcgaccccccaccctccccacttctgagcctccaatgtccattacactattctgtatgcctttgcaaacccatagcttacctcccacttataagtgagaatatgcggtattttgttttccattcccgagttactttaattaggataatggcctctagctccacccaagttgctgcaaaatacatgattttattcttttttatagctgagtagtattccatggtgtgtgtgtgtgtgtgtatgtatatatatatatatcacattttctttagccactcatctgttgatgggcacttaggttgatttcatatctctgcaattgtgaaatgtgctatgataaacatatgtgtgtaggtgtctttttgatataatgacttattttcctttgcgtggatacccagtagtgggattgatgaattgaatggtagatctactttagttctttgagaaatttctattctgttttccatagaggttatactactaatttacattcctacaagcagtgtataaatactgccttttcaccacagctgcaccaatatctattgttttttgactttttaataatggccattctggctgggataaggtggtatctcattgtggttttaatttgcaatggaaaacatttttgatgggtttttaaaaaaagttaaatatacacctagccatatgacccagcattttacaataggtatttacccaagggaaaaataagagtatatgattatgcaaatacttgtataggtagatcataggagcttttttttttcataatagccagaaaccagatataacccagatgtccatcagctggtgagttaaataatcaattatgaagtatttatataatggaatactactcagcagtaaaatggaatgaactattgatatacagtgaatctcaaaataaatatgctgagtgacagaagctggacaaaaaagtgtatattagtatatatcgtatgattctatttacataacattctacaaaaggcaatttaatttatagtgatagataacagatcaacgcttttccaggtagggaggtttggagctgtgagggaaatgagggagttattctaaaggaacacaaggagactttcaaagtgatgaacatttttattgttttgattgtggttttggtttcatgtatgtcaaaattaccaaatagtatactttaaacagttgcaggttatcatatgccaactatatctcaatagagttgttttttagaaagcaattgttttattttcagtttctcaacttttcctagcatcagtagcatgatagctttacatcccctttgtcatctcttttcaaaatgtctgcttcacatattatgacattttaccaattgtatttggaatgtttcttgaaacttccctgacacattattttgttttaaaatgttacaaatgtttagatgttagaaattgtcttaatataatttttactatagaaatataaggcaaaaaatgatctacaaatgcaaggtataatacttacatttataacttgggttcagcagaaagcagagctgaggcttctggagctatttgcttgcactttattagggatacaattctggggagcaggagagaaacaaagagagtggagcagctaaaggagaacaaatacacaattgtgctgttgaacttactgttgctaagtgcagcagaatgctagatttgtgaaactcggcctccaagaagctatctctataaagtacattcaaggactctactgggggcaatatgtggacaaaaaggaaggatttatccactggttcctgtttcccactggccaaaggtttactccacaggatattaatttgtctatacttctggattatgtaggccagggtgagggcacagggcagtgaaccaaaaagagaggctttaggagcaggcaggaggcgatgacactctctgcttgggactgtgtaaagaaaagccctcattgagctgcctgccaccacaaaagctgaaaaaataaagaaagaaagaaagaaagaagaaaaaaagaaaaataaaaagaaaaaagggaaaaaagcgtgaagctaagaaagaggatctgaaatgatgcagcagagatatctgaaacatgtatgttctatagctattaagaacagcagtaagcctaaaacaaagttttttttctatgtcctaggtatcatatgcaacctatagctcatcctatttgacatatgtatcctactaatttgttttacgtgagtacactcttaatcatgcttgtggcactcatctctgaggtacactaaatttacttggatcacttttataaaccattgacatctgtgctccatcacacagcaatcaaaacagaacacctgagatgggctgagtatcactatttgtaaagacttccaagtgatcctaatgtgtagccagggtagagaatcattgaatcacttcagtctcccaggtgtccactgtatgttccatgtttttaccaattccaaatactattcacaccttcactacttaatagaatgctactttctttctctaagttctacccattattcagagttcattttaaatcttatctcacctacatatcttttcctaaccattttatccttcatggtttttcccttatttgactccatcatctgtattagcaaagcatcttctatatccaccttagcagtctgtagtaaaacccttttttatttctttcccaacttaattgctttcctcttaccttcaacttttggaatcctcaatgttaacacacacatgttctcaacacaaagatttcaggataagattcccctgaaaattgtgttagttctgtttattttgaacaagttcaatggggccaacagattttaagatggtccaataatctctgcttttgtaagtccatgtccttgtataatcctttccccttgaatgtaggtgaaatctgtgacttgcttctgaccaaaaaaatatggcaaaggtgataagatgtcattcccatgattatgtttcattatataaggctccatcttattaacagtctccttcaattactggttttgaagaagtttctatgaattctacagtcacaaagaatacaccctgggagaacttggaagtaaataattcctcacttaagcctctgatgagaacccggtctggctgatactttgattccagcctcgtgaaaccctaagcagaggaccaagttaagcagtgctctgactttggacttactaaaaccaggatattacatgtgtgctgctttaagccattaagtttgtagtaatttgggacatagcaataaaaaattaatacatactttggtactagaaatgggatgctttttatctgaagtggaattctgttgtaaaatacctaaaaatgtaagagtagctttagaattgggtgggtgcacactggaagaatttggagaacaacggagaaagtataaattgccttgagtggactgttagtggaaatctaaaattgaagcatgctcctggtaagggtgagagctcagaagaagtgaggaataagccattgaaaactggaggaaagagaaactcttgctaagtagaagaaaactcagaattgtctcctgcatttatatgtaaagcagaacgtgtaagtgatgaacctgtttatctagttaaggaaatttacaaaagaagtattgaaggtgctatctcgtttcttcttgttgcttacaataaaatgtgagaagagagaaataaatcaaaagaagaacaaaaatgaacaagaacttgatgattttgaaaatccagtctcttcaaatggcaaaaagttaatggctgaaattaagatggcttggtctagagaaaaatttgaccatatgactctacaacttttcactaaaagttcagaaaaatcaaaatatcagaatattcagccacacaaaggacgctttcaagagattaagggagtggctcacaaatcttaatctgtagggctttcgtgctctggtataatcccttccccttgaatgttggtggaatccgtgatttgcttctaaccagtagaatattggaaaggtgatagattaccactcctatgattgtgttctgttatataagactccattttgctagtagtctcattttcttcattgctggctttgaagaagaaagctttcatgaatcctacacatacaaggaaatgaattctgccaacctaagggagcttgaaagtagatccttcttcagtcaagcttctgatgagaactcagtcctgataaacatcttgattggagctttgagagacactaagcagaggcccccactaagtcgtgcccagactcctgacccacaagaactgtgagataataagcattaattaagttattaaagttgtggtaatttgttatgcagaactagaaaactaatacagtctgactatttattgctatattttagtcaccatttctagtcactaagcaagaggtaaattatgagattatagttgccttccacttttagacatttattttcatttctgtcttatccacaatctgcacatgtggacattgagagttgaagccaaatttcctgacccttagagcactggttcttaaattttagtgtgcatcaaaatcacctgaaaagcttgtgaagatacagattgctgggccccagccctagagtttttgattcagtagatctagagtggggcccaagaatctgcacatttagtaagttctcaggtgatgctactgctgctagtccaggaccaatactttgagaaccacttctatggaccatctttaccatagttctttctgtggcctccatgatattcatttctgcaatttactctgcctctcttctcatgatgattaatattgtaagctgctggaatttctaggttttggctggcagttgccatggcaacacacacagcgttgcccagtgcctgaggccctgagtgaggatggcaccagatgaatcactggaataagtgacttgcaaggggcacagacatttttccctgagttgtccatttccttctgtgacccttattcttggtcttttctttttttggtaatgtcttttttgagaccccctccagattcttctctatgtaatgtaataataacaaaaccttagattcatgtcattcttcacatttataaaacaagcaataccctttccagcacaaaatcaaattttatttgcataacaaccttgtgaggtgtgttgtataggtcttattattcccattgacaaatacttaatgtaaggctcaaaaacattcagaaataactgatatccaaagttacataaggtagagagtggcagagccaagtctggaggccagaactcctgatttctagctcagagcttgtatcacccagggccctagcaagaaacaaatttcacagtcaaaaggataactgaagagagattaacgaagggaacccatgagtgatggtgacataccccagcctagcaagtagcctggagggtcaataggatagagtggttagtaaaacctggaaagagatatagctacaggtgtagctgcaggaggacacccaacaaaaaagctgtggcctttagtggaggaatgcagtcactgccaacccaaagcctataaggaagggtgccagagcagtaaacaacacaacttctctccccaggttatgagggaggcttaagatgaagtagagacattttgacttaccactgtctgattaggtcattgcaggtttctgaacagggagcaatacatgaaaatgaggccctaggaaaactggactggcagcaccatgcagggctggttggagggagaagctggagctatggagatcaatcaaaaggatgctacagagcttagaacatttccatttctgtccacactgaagtgggtctgaacaaaacgggcaaaggcagacatgaatgttatggaagggtgttatgcccccatccctagggcatctttgtttgaaggaaatatcccactatacatgcatactcaatattgatcttaaagcctttcaggatttaactggggtatgactggtcttttggccttggtttgggttctggaaaagcagactcagagatagggattcaagtataagtagcttattaaggaggtgcagggaacaccagcagggaaataataagtgagggaggcaaaccaagaaaggggtattactaaatcagctatcacagtcagtgactgccacttaagaccaagagtaaattccaggaactagtgtaaaatgcatacctcagaatcattccacttgagcggtgaaggagttgaaacatttgtataccaactcctaagcatcattggttaaggcacgctcccgggaagcaataattcctgacacttccagcctgccacaaacaaaggcagaattaccttctgtggttctggaaacagcttcctgatgcagaaatgcagacactggcagttggaagtcattctgagcacaacgaactggacatgggtggagcattgacaatacctgccacattttcatttgcaggattgtgttcatcagcactacagtctctacccacttgatacagcacctaccctgccatgtccacatggaattcaacttgctcatgcacaaaatcaagccagcacaattgttttgaaagttatagcattgttggataaataccataatgggcagcggaatttgtagtaaaacacaggaggtaaattttggtaatttttaaaggtttcagaggagagaaaagacatattaccaaatggccaggggatcaaggtagctaacatatctgtttttggctaacaggtgatctgtccctgggattcaggtgtcaacccaaaagaaaaacacaataaggaaatgcaagtacccatgaaaaagaactcatcctgcattgcacagcatatctgtttatcgtcttgaactggctgcaaaagatacctaattgctcttacttcgctcaaaaataaaagcttcaaagtgctgtcattttccactgagtttcagaacagctgatcatctcatgcactcgctctgtacttagaccacactaagtttgcatctctcaattcagccaggacatctgtcctgctctgcatcagagccctcagcatgatcttgaatctacacagacacaaggcaaaaaaaaaaaaaaaaaaaaaaaaaaaagaggcagagagaagcattttctgtgccacactgtgctgaattatttactcccagctctgggattcagagagctagtgctttctcagccttgaattttattgcaatacaaagaaataaaataagtaaataaggagagagaggaagtaaatcccttggagacctactggcatatgaaatatcttttgaaatggagcttgatgctgaaataattgtgtcatttagagtgcaatactaatatgctcacaactatggctaaatgctggagcaaagaacaattttgcagcaataaatgtgtggccatttgtttaagcagaaaaaaaaatgaacctaaaatttgaatggatttatttaattaagcattggcaaatttagacattgactacaaaacaatgccttcaagcattatgtgcaaaacaataagtacaggtaatggaaattagggtatgtttatttcatctgagatcggaatgagaaaaaggaatacagtatggtcgggaggtatttgtatggccataaaagagagaaatccgcctcgtttcacgatatgtgtcacagacagggattgtgaacattctcaatgtattctaaaggggctgtaatcatgtaatcacataaatataaagtaactttatttttgtctcccactactcctttacatatttcagaaggaaatttcttcccagcctctaggcaaaatcctgccccaccgcccccaccccctccatttctttcctggggtgcttaagtattaaaaaattcctatggtctctttaagtccaaagtacattctctttttagtgattatcagtagctataatctccaggttcgtgtaatgctcaaaactttgaacattacttgctactctgataggaagcctggagaaggggaagggcaggagagacacggtcagcttttcctctggaggaaaagaaatagtgcttctttgtcttcctcctccagctgctcaccttgttcctcactcctcctgcaccagtgtgcagggagagagaaatatacagagaaagaaagcatgttgtaactggaatgcttatgaacaccatccatttagtggcctggttggcatacaattctgactcttcctcatggatgcagttgtgatgttttcggagatccttttccacaccaaatattggggacctctcacttccagatgtcttgcccttgattgatggactctctcctgtttcacctttgcactgttttcttagtctctagctgtccccttgggttcactgttagctcttttctctggagatcttttcacttgtccaagtgagccctcctggctagtccctaaattgattttatgctcgtttattctgtttctgtccctcgctgtctctggctctctctctctctctcctctctttttctctctttcttttacacacatacatacacacttgtccaattctgtttcacaggaaacacttaaacatttatgcattattttctccaataaatttcaggatgttggtcaatcccaatgcagccacccatcagagcagccagtctatccatttcagttatgacgtagacattaatccactgcgtctgcccctcaaatcttgggtaacaaatattaccttaaagcccctctcttttgacttgaggtaaaaagagaggcaccttccgaccttctaaacagagcttgctcaaatacattacatctaaaaaatctttctccaaaccccgaccctcaaccatttttgctcatgtgttgggtgagagtcataaaactcataaaattcataacattggtgtttggtcatttctttctggaaatcctataggaaagcctatctcacaagtcactttggtatctggtatctattagtgtctcagcagaaatttctattttaacatccaattatgaaataaaaagtgtgaggaggctaattttctctcagtcaacccttggaagtgcccacagacttagcaataaggaaatccttggctgctatttttaggtctgcagagggcttcagaaccatgttttactgaagggtagtgcgttaacactatttattagaaaaccaccatgtgcccccaagatagttataatgtgtaaaatgctattttccttttttttccccagaaaaagaactggaggtacagacaaataaagtgactggtctagagacattaatgagctgttagaacttgagaaacaactccattattgtatggtcagctaactggttaagtctgttaacagacatgtggcataatttaatctaataattttttctattcctcaggcctataggttgaggttgatctgaaagataggactatttgtgatccagaatcaaaagagtcaagaaaagtctgagaatttcatccttggagcagaaagtgaaagtgttctggagccaaaagtagtaacaaagatggagggcaagagatcattggattaaatcatattggcagaccaaatttcagaagaatcaacacaccagagacaagaagaacttgaagttaaagcaaagttcccttata

SEQ ID NO: 4493 - DNA, 446830 bp, human
tgcagaaaaatcatttgacaaaattctacacccattgatgataaagaactctgaccaaactagaaatagaaggaaagttcttcagccaaataaaggtgatgtatgaatgccctacagctaacatcatacttaatggtgtaaaactaaagctttcccctgaagattgggaacaagacaagtatgtcttctctcaccactcccattcaacatcatacttcaagtcttagtgcaataaggcaagagaaacaaataaaaagcattcaggttggaaaggcagaagtagaactgtctttattttcagacagcatgatccaggatgtagaaaattctgagatagtcacaaaaactaccactagagctaactaacaacttcagcaaggtcataggatacaagatcaatatacaaagattaattgcatttttatttactagtaatgaacaatccaaaaactgaaattaaggaaacaataccattcacaatagcatcaaaaataagaaaatatttagaaacaaacttaacgaaagaccaagacttttgtactgaaaactatgaaacaatgctgacagaaatttaagatttgaataaatggagatacacttcatgttgatggattgggagactccatgttattaagatggcatttcttctcaaactgacctataaattcaatgcaatcaccatcaaaattccatcttgctattttttttttttttttttttagaaattgacaagctgaaatttgtgtagaaatgcaagaaaatgcatgggacccaggatagccaaagtagccttgaaaaagaagaacaaagttggagcatttaaactttgtgatttcaaaacttactacaaagctagagtaattaagaaagtgtggtactggcataagaagagacatataaatcaaaggaatggtgctgggacaactggatatccacatgcaaaataatgaatttagacctctccctcatatcatacacaaaaatcatagacataaatgtaagagctaaaactataaagctattagaaaaaaacatagaagtaaatttttgtgacctcaggttagacaatttttttttagatatgacacaaaaattacaagtaatagaagaaaaaaatgataatctggacttcttaaaaattaaacctttgtgcttcaaacgacatcattaagaaaatgaaaagacaagcatttcaaattgtaatgtaataaaggacttttatctagaatatgtaaagtacttttgcaactatataataaaaaaaacccaattaaaaatgagcaacctacctgaataaacattttttcaaagaagttgtacaaatgctcaataagcacatgaaaaactgctcaacatataagccattagggaaatgcacatcaaaaccacaacgagatactacttcacacccaccagggtagatgtaaccaataaaaacagacaatatgaagttttggcaaggatgtggagaagttagagccttgaaccattggttgtggcaaggcaaaatagtgcagccactttggaacatgatttggcagttccttaaaaagttaaatatgaacttaccatacaacccagcaatttcactcctgtctgtgtatggaagagagtgaaaacatatgtttacacaaaggcttgcatgtcagtattcatggcagctttattcataatagtcaaaaagtagaaacaatccaaatgtccatcaatgggtaaatggataaacaaaatgtggtctatccatacaatagaatactattgggcaatgaaaaggaatgaggtaccaatactgttccactgtggctggacttcaaaaatattatgctaattgaaggaacttggatataaaaaaccacatattgtatgattccattgatatgaaatgtccagaataggcaaattcatagagatagaaaatagattagtggttgccaggggctgggagtagagtgaggtggggtggggaagggggagtgactactgattggcaaggtgtttctttctggggtgataaaaatgttctggaattagatagaggtgatggctgcagaactctaagtttactaaaaactattcaattgcacactgaagtaagtaaattttattatttaaattatatctcagtaaagctataaaaacgaaatttctaggaagggattaggatgacagataggaggcaggaccagcctgcagccccacttggacagatagatcagcgtgtggagactctcattttgaacttttgcttcaagagctaccacaggaacatacaaggaaagctgagagaatccacagaccctctgaaggaactggatcgccactgcaggctccctgagatgctgaaaaactgtgagtctgcttgctttctcaatggagaggctcgtggtctggggcaagttctcagccctggtcaccagctgcctggaaatagacttggtgctgttgaggggggcgggggcatggtgggagtaagactggtctttaggaatgggagaggggtgagactggtgactgccagcttttttctcacttctttggtgacctatataactcagcagaggcagccataatccccctgggaatataactccataggactgggaaccactcccccatcccccacagcagccacagcaagccctcctcaaggataggctgagctcagacacgcctatccctgcccctacctggtagtctttctctaccctccctggtagccaaagacaaaggtcataatctcttgggaggtctatggccttgcctaccacctgagaatcttaaatactaaaccaggtgtccctagggcaagcttgcatcctccctataggaccacagctgatgtgctcttgaaagtgccatctcctggctggaggccaaccaacacaaaaccaacgcactaaacaaaaacacaaccaaggaccctcacagagtccacttcacttccctgctgcctccactgaagcaggtgctggtatccacggctacaagatctgaagatggatcacattacgggattctttgcagacaccccccagtaccagcccagagtccagtagcgccactgggtggctagacccagaagagcaaaaataattactacagttcagctcttaggaagccccattcctaggggaaggggaagggggtgaacaccacatcaagggagcaccctgtgggacaaaagaatctgaacagcagcccttgaatcccagatcttccctctgacatagtctacccaaatgagaaggaaccagaaaaacgattctggtaatatgacaaacacggttctttaacacctccaaaagatcatcctagctcaacagcagtggatccaaaccaagatgaaatttctgaattgccagaaaaagaattcagaaggtcgattattaagctaatccagggggcaccagagaaaggtgaagtccaacttcaaaaaatgaaaaacatgatacaggatatgaaaggaaaattctgcagtgaaatagagagcataaatgaaaaacaatcacaacttctggaaatcaaggacatagttagagaaatacaaaatgcacaggaaagtctcaataatagaattgaacaagcagaagaaagaacttcagaccttaagacaaggcttttgaattaacctaatccatcaaaaataaagaaaaaaatttaagaaacgaacaaagcctccaataagtttgggactatgttaaacatctgaacctaagaataatcagtgttcctgaggaagaagagaaatctaaaagtttggaaaatatatttgaaggaataatcaaagaaaaccttcctggccttgctagagatctagacatccaaatacaagaagctcaaagaacaactgagaaattaatcgcaaaaagatcattgtctatacacatagtcatcagatcatctaaagtctttactttactttggtaaaggtacaaaggaaagaatattaagagctgtgaggcaaaagcatcaggtaacctaaaaaggaaaacctatcagattaacagcaggtttctcagcagaaaccctacaagctagagaggattggggtcctattttcagcctccttaaacaaaacaattatcagccaagaatttcatatccagtgaaactaagcttcataatgaaggacaaatacagtctcttccagacaaatgctgagagaattcaccactaccaagctagcactactagaactgctaaaaggaactctaaatcttgaaacaaatcctcaaaatacaccaaactagaatctccgtaatgtataaatctcacaggacctatataacaatgacacaatgaaaaagaaaaacaaggtatttagacaacaaatagcataatgaatagaatagtacctcacatgttaatactattaggttgctgcaaaagtaattgcagtttttgccaaaatggcagaaactgcaattgcttttgaagcaacctaatagactgtaaacggcccaaatgctccatttaaaagatacagaatggcagaatggaaaagaattcactaaccaactttctgctctcttcaggagactcacctaacacaaggactcacataaacttaaggtaaaggaatggaaaaatatattccatgcaaatggacacaaaaagcaagcaggagtagctttatatcagacaaaacaaactttaaagctacagcagttaaaaaagacaaagagggacattatataatgataaaaggactagtacaagaggaaaatatcacaattctaaacatatatgcacctaacactggagctcctaaatttataaaacagttactactagacctacgaaatgagatagacagcaacacaataatagtgggggactttaattctccactgacagcactaaacagttcatcaaaacaaagtcaacaaaaaataatggacttaacagatatttacagaacattttacccaacaactgcagaatatacattctattcattggcacagggaatattctccaagatagaccatgttataggccacaaaacaagtctcagcaaatttaggaaactcgaaattatatcaagtactcactcagaccatagtggaataaaactggaaatcaactccaaaaggaaccctcaaaaccatgcaaattcatggaaatcaaataacacactcctgaatgatcattgggtcaacaatgacatcaagatggaaataaaaattctttgaactgaatgataatagtgacacaacctacaccaaaacctctgggatacagcaaaagcggtgctaagaggaaagtttatagcattaaagcctacatcaaaaagtctgaaacagcacaaatagacaatctaaataaacaaagccaaatacttgtagccaactgatctttgacaatacaaacaaaaacataaagtgaggaaaggacttaacagatcaacaaatgatgctggggtaattggcaagccacatgtagaaaaatgaaactggattctcatttctcaccttatacaaaaattaactcaagatgaatcaaatacttaaatctgagacctgaaaccatacacatttagaaggtaacatcagaaaagcccttctagacattggcttaggcaaagacttcatgaccaagaacccaaaagcaaatgcaacaaaaacaaagataaatagatgggacttaattaaactaaaaagcttctgcacagcaaaagaaataatcagcagggttaacagacaacccacagtgtggaagaaaatcttcacaatctattcatctgaaaaaggactaatttccagaatctacagagaactcaaacaaattagaagaaaaaaacaagcaatcccatcaaaaataggctaaacacttgagtagacaattctcaaaagaagatacacaaatgtccaacaagcatattgatatggtttggctgtgtccccacccaaacctcatcttgaattgtagctcccataatccccatgtgtcatgggagggatctgtgggaggtaattgaatcatgggagcaggtttttcttatgatgatgaataagtctcatgagatctgatagatttataaagggcagttcccctgcacacgctctcttgcctgctgccatgtaagatgtgcctttgctcttccttcgccttccatcatgactgtgaggcctccccagccatgtggaactgtgagtccattaaaactttttctttattaattactcagtctcgggtatttcttcatagcagtatgaaaatggatcaatatacatatggaaaaatgttcaatagcactaattatcagggaaatgcaaatcaaagccacaatgtgataccactttactcctgcaagaatggtcataatcaaaaaatcaaaaaataatagatgttgggtgaaaagggaatacttttacactgtgggtgggaatgtaaactagtacaaccactatggaaaacaatgtggagattccttaatgagcaaaaagtagatctaccatttgatccagcaatcccactactaggtatctacccagaggaaaagaagtcatatgaaaaagatacttacgccacacttgtttatagcaggacaattcgcaattgcaaaaatatggaaccagtccaaatgcccatcaatcaacgcgtggataaagaaagtgtggtgtatatataccatggaatactactcagccataaaaaggaatgaaataattgcatttgcagcaacatggatggaattggagatgattattctaagtgaagtaactcaaaaatggaaaacaaaatatcatatgttctgaccaatatgtggtagctaagctatgaggatgcaaaggcataagaatgatacattggactttgaggactcaggggaaagggaaggagatggcgagggataaaagactacacgttgggtacagggtacactggttgggcgatgggtgcaccaaaatctcagaaatcaccactaaagaacttatttatgtaaccaaacaccacctattccctacaaacctatttaaataaaaaatacatttctaacaatgttttcattaccaatgtcatttctgtggcaagtgaactcagtttctccacagtagatcaaactttaaacattctttacttttgtgggatgttagtccttcgatgtttatgtgagcaaactaattaggcaatggatttttcattctttctttgttggttattttttatccattaatagctcaggaggaatcttgctcagggtcaactgaattacatttgctctgtggtggttaaaccctcagactgtgggatatgaggatcctgcttccatcacttagctgtgttaaatttggggcacaattacttaaactttctaattcttcctcttctttacagaggaggtaaaaatagaaatgacttcatgtttattgtgaggaattaaaatggactttttacagcacctgacacatagtaaatgctcaatcaaaataaatgcaatctactctatgggctgaatgctagacaccctggtataaaggaataaatcatttattaattacaagatttgcctcaagcttgtctaaggctgaactggaactaagatcttctggatagttttctgttttatttcagatttcagcatgtagagtggctgccctatctgttcctcctccccagtctctacctggtcttgattttgaatttcctcaactgcttgtatgcataaaagtctcaggatcagctgttatagtctaagtgcacccccgagtcactgtcctccaggtgggaaaagttccaaatcctcagggcctctgggtaaagctagagtggctttgaggatgatcttagacctagagtgtatatgcaacaggaagagattttgctttccattggtggtatccatcaaattttactttttggccagacatgatgggatttttcacagcttcaaaatcagacagaaactgtgcctaagatggaatttatagcctgggtataaaatgaaatggatatcaaagggggacaagtgccccttaaaataaaatcagagactagggagcaatggtcttagaagtgatgcctctgagagggattcataatagaatctaactcagagttaaatgagcagtttgtacagtaaaatatcgtgttctggctacatggattgtcatattaatttataaattaaaaacaagactccatgttgaaggcacacactgacatgttgaaggagaatttctaccactttggaaaagaattttttttttttttaaaaaagccctccacgaaaattttgacttgcctacattcttgctgtgtcttcattctcttttctgcacttctccccacctctccaccttcctttgctttggtgatttctacctggctccactgtgcaacaaggtgaagaatgaggggagacatgagtgaatgtggtgtagcctacacactgatttatctctgtccaaatctttccttgttcactttaagacacaaaaccaaacatttccttcccagtctcccaaggattgggtgggcctgatctaataaaggtcattagaagcagagaacctttcccagctgtagtaagagatgtgacaatagagcagagtcagagagcgagagaaagcagatgttgctggctttggaggtggagaaagaggctgtgagccagggtatgtaaatagcctctagaaactggaaaaggcaaggcaacacattctcccctgatgacactagaaggaagacagcccttccaacaccttgattttagcccagtgagatccatgtcagacttttgacctactatattagggttctccaaagaaacagaacaaataggatatatatagagagatatataagaggagatttattatgggaattggctcatatgattatggtggctgaggagtcccacaacctgccatctgcaagctggagacccaggaaagccagtggtgtaattcagtctgaggcagaaggctgagaatttgagggagggctggtataaatccctgagtctgaagacctgagacccaggagctccaatgtccaagggcaggagaagattgatgtctcagctcaaaggcagagtgagagaattcacctttctgccttttttgttttatgtgagctctcagtgaattggcttatgtccaccacatgggtgagtgtgaatcttcgttacccagtcctctgattccagtgccaatctcttccagaaacaccctcacagacactcccagaaataatgtctcaccaactacctggggatcccttagcccagtcaagttgacacataaaattaaccatcacccttacagaattgtaggataatacatttatgttgttttaagccactaaatttttggtaatttgttacagcaacaataaaaaaccaatataccttcccattcttttcctttcaccttcattctccccacaccattgtaagtagatccttcattaacagccctttgttgaaatcatttaaagtgaaacctgttctctgtccttacaaatgcatagtctcattttattcttccttccttccttctgccatttattctctatgcccatactcattcttcttttcagttaggcaccctttcaaatgtttaatacatgtccttgtatatgtaacccacccaaaagatacatgtgaatgtacaccttttaaacttaaactaccttctataataagtctaattttttcataggttttagtttttattcaacgctacatctttaagaatgatcagtatctctgtatatgagctggttccttacatctgattgctgtatccttgaatcctgagatctaggcatgaaaagatccaagtgaaccaaggccctggggcctgaaggatcctgagaagagagcaaagttcccacctcagaagatggggtgaaggcagacagcagggtagttgggagtggaatgagatagaaggtgaagagatgtgactggagagatgcccttagtaaccaaaaatttatgaaatgagtgtgaaaaagtgagttcattcataacaagtagcttacaagcattttcatttgatccagcctccctaaatttctctgctttttcttggcttaccttggatatttatctctgatcctagaaagcaaagcaaaacaaagcaaagcccagtctgtctcagcctggtcttaaatcttgctgctaaccaagaccttatttactattctgacacctaaatatttatctcctttgtgtgaacttacagtctcctgaatttggagctatatgtaggtttaactcatgcaaatgatttcttgtgtgacccatgagagtgtttctttccagataaatacatatgtattttttcttagtgaaaatagttttttcttgcttttattccagattataaagcaattcatgtttattatacaaaaacattattacaatacagacaagtaatatcatacaggaaagaatgaagatataaatattacttattctatcatctgattttaacattttgcatgtatattattatttcagcctttcttaataatattaaaccaataaatatttattatgcaatttaatgggctaagtgctggaatataataaaaagcgaaaatagacacaatttctgccctttggcccttgtaatttagcgagggagaattacatttaattatatgattatttaatgtctgcaatagttgcaatgcttttgctggtatatcagccagctattgacacagcaatgctccatagtaaattaccccaacacccagtggcatgtaacaataaacactttttcccatgctcataggtctgcaggtcagtttgggaaactctgctttaggttgtaggtctgtgaattggcagaggtggctctgttttagggtgcgagttaaattttggtcctctttatatgtgttcattctggtaccgagactggtgggaaaacagctacctagagcatgatcttctcatttagagagaacaagaaagcaaaccaaatcatgcaagtacatgttgaggtttttctctcattatgtttgctaacataccattggccacaacaagacacataaccaagccaaaagccaagggacagagaagaacattcttaccaccatgaggatgtggcaagggtatggctttctattacagaggcatgaagaattggaataaggaattcaactaatcatagtatgtacaaccagaagtgctatttatcaactgttttctcctcatggtcataaaatgtctgaaacattactaggcatcatatcatcttatgatattatctaaaagggaagagttgtgtcctatcctttccttcttagaaggccgattccccatctccttgttatttgacttctcattagcaagagttgcttcacatgcccattcctaatccaatcactgataggagaatagaactgacatgattggcctacactagaaaacattcattccccggggctggagaatggctcctgacacaagattgtagaaggtccagaatatacctttcagggccttgcagatcaagttaaagtttttattcttcatcctgagtgcaatggaaaaccactaaagagttttaagaaagaaagtgatataatcagaattgagtttaaaggaaggtcacactatctacagtgtggagacaaattgaggagttgcaagaatggatagagagggatgagttgagaatttattgtgtagttcagttgagagaagataatagcttagctggaatggtagtggtagatatgaaacagatgtgattaaatttgagaaatatttaggaggtaaagttgatagtatttagtgatgaattaggttcggggatggtgatgagtgaaggtatcaaggactatttttagattttaggactacatagctgaaccaatgttggtactattcattgtgacagggaatagaggaagaggttcagatttgagcaggaggacctcaaatacaaatgttgagcttgatatgcctctgaaatatttacagagagatattggatttatgtgtctgagataatatgtatgtatctgcacaaaaatggaaattgatgccaaatatgttaataagggagaaaataaaatggaaagagtgaatggtctaggaataagctttgaggaataccagcatttagtgggttaataggagaggacgagcctatgatatggtgaaggaagctgagaaagaccaatcattgaggtaaaagaaaaactcaaatgtagaaagaagacctgaagccaagagaacagagtgtttcattaaaaagagagtggtaatgtgaactgcagttagattggttagtaacattgagatcatagctcataagtaaatcagcaagtactgttttggtgaactaatgggtgcaaaagatgagaaaatggagttgtcgggtagaggaaacttttttaagagcttggctttgaaggggacagaatatgaagtgggaagtataactaagggagcattgggatgaatgggcttgatgctgatgagaagtatccaattgagaagaagctttatacacaaaagagagatggtataagaaagactaagactcctgagaaaacagagggtaacagaatctatacatgtatctttatgtatttatgtagttaaatatctcatccttatacaacagcatcccaaagagaaaatctagtggacaggtgtgagtgactaaaatgccttctatatccactgctctctttttatttgggtggagtctttttttttttggagacagggtcttactctgtcgctcaggctggagtgcagtggtgttatcacggctcactgcagtctcaacctcccaggctagggtgatcctcccacctcagcctcctgagtagctgggactacaggcatgtaccaccatgcccgactaattttttaaatttttgtagatatggggttttgccatgttgcccaggctggtctccaactcatggactcaagtgatctgcctgccttggcctcccaaaatgctgggactatggatgtgagccaccacacctagccaggatgaaattttaacccaaggccatcaacaaacttctatatctcattagccagaactgggtcacatgcttacccctgggtcaattactagcaatgggaaatgaaatgtccatgactgacttacagtcacccctcatttttcatgcttgggcctgggtacattgccaccaaaaaacactgaggcaaggaggactgtgaaataagttttggactggtggctccaagactgtctaccaccaagaatgtttgcctcagtagctattttgattggctcttgtatgtttgtgtaattataaaattaattgataatataaaaattcacataatattaaaagatataataaaaagtgaacataaaatagtgcataattccactaaccccaaaataagcaattgtgattaacattttggtatagagcctttcagaacttttatatgcttcaaaatgatttttcttgtctttctcaaaatcgggagcatactgtgtgtctgtgtgtgtgtgtgtgtgtgtgtgacatattctccttttttcacatgaaacatattttctgaaatgaaacactaaaatataaactagatcctggtaaattgtgtgtttctgttatgtttatggttgttccatacatggttctaggcgtatatgagcatgcatgcctgtttctttattccctgaacaatgttaggtatattaattttaaaaatctttgataatcttataaagtaaaagtaataaatcaatctaattaacttttttgtttaggtttaaaaagctttccatggatacatttgccattttaactttttattctttcattttgcttatatttcttattgatttgtgagaatctctttatgtattaaggacatgaattctttcacatatgtttcaggtgttttaatttttttagttcctgttttctcttttaaccttgttaataatctttggggtttgtgcaactttaaaatttttagataaattcatcaaatctttttcttatggtttctgaggcagtacaatgtagtatttaacatccaggtttttggagtcagaaataatagggcttgaatcctggctctttccatgattctattgcaatgatctttgagaaaatgactcaacttttcagacactttgtttcaccatctataaaatggagacaaaaatgcctccttcaaaggactgttatgcaaattatatacaaatcatgaatgaaaagagttcaattactggtgcattaatgctcaataattttagatattgttataagaataaatattaatatgattataaaatatctttatattaaaattttataaaatctgcaggtatttcttgtctttaaatgtaaatatgaaaatataaatcttaatttaaaacagaatgataataccaaaacagtttcacatggattaaaatttgaatttgaataacataaattcaaagactttattaaacaaatacagtccactaatttttttttaaagtacggtctctgtttaatggttaaaagttattttatgaagttatttatcctttattcaaccattctagctttttaaattttcagtgaatcaaatgaattatcaactatggaagaaattaaatagatatttttcatattcatgcttggtttgtaagtgttatttgaaagtcagagaatttaagatttcatgaaaccattaagtaaagaaaccatagcttccttttcagcgttttatccccccattttagttaatatccagaagggatggccatatttgggtagatgaccacaaacagattacttatgtagtcttggattttctgtacatttcatgggtgatgaagagctcaatatatacatatgtgtgtgtgtgtgtatatatatgtctctctctctatatatgtatatatgaagtgctgacttgtgatgataacaagaattattgctttgagaataccaaatgcgtaatgattccttccactagaagaagtggtgcttcataagaacccagacaggctgggagggttccagaatactgtgctcctcttcttagacaggcagtgtggtgtagagcttagaacaggactttgcagacttaccgcctggatttgaattccacttgtgttacttagtagctctgaggctgtaggcaaattatctaacttttctgtacctcaatttctttgtttgtacaatggggataacagtagtgcctaccttgaaagggtattgtgacaattcagtgacttaatggctttaaagcacttagaacagtatctgatataattaacagtcaataaatattattgtgatgatcttgtactcctctacccaacttctatcatagcactgtgacatttacagttaaactatagtgttcagtacaattatagaaatatcttgaatttgttggttgtccttatggagagaaaacccctggatctcttgaggtttcatgttccaatctgagtagaaaacccaggacagacatagaaggtaaggaaagtgaaaagcatttgacagtgcatcaagaaaccaataatagcacctccccttttagtgatgaaaggcaatttttatatactatactaaataaaatgtattgcaagcattcattagatagcatcaaaatcccttcattatatccactggctattgtgttattcaggtatctgttggcatattgcttggtataactgaataatgaggctttcattcaatttgcagatctgcagtacagtgtatttaggaattagctcaatgtttcatctgtgtctgttatgaaaaggacagataatagaaagattgccatgctgtctggtagcaaaaccatctcatgggattgctaaacgaggtgcaagctcatctggaaatccaagcaatcttcctttcctttcttaccttttcccctttacatgagaattccttccatttcatttgtgccagctttgatagagaggtgtaggaaattatgattaaatgtggcattgcaatttttaccctgaattttggttgttcagaattaaacagcagccctttaagccgaaaagtatctacagagccaaccctgacatcaagcactgacattgtttctgtattgaagatgctgtctttgtaacacagtgtggttgagatctaaaagatgaaacagaatgtgtataactcagtggcttaagtacattcacattattgtgcgaccatcactgccattcatctccagaacatttccttcttcccaaaaagagactttgtactaattaaataataattcctcgtttcctcctccctcagcccctggtaacctctaacctactttctatctctttgaatctgcctgttctaggtacctcatataagtagaatcatacaatatttgtctttttgtgtttgtgttttctagttgcattggcatgtaatatatttttctggaaacactggccactggagacttgacttgtgattgatttgagtgattgacagtattgtattgaaacacttagtcatatatgttgataaaaataggtactatatgtaaccagaatataggggtagagtttgagtttttcatgaataaattttcctttggatttttagttggaaattttgattagttccctttcactaaagtacaaggctatattttacttctaatgttaaaaataatcaccacatcattgtgtaaaagagagttgaaaagaagcataatttcccttgggagctagagagcctatccctgaaagttttgctttatccagagttccactgaaaacttcaggttgtctgatactgtgtctgtagatattacttgtctgtgtgttaaggggtgaagtaaatccaacattagtatccagttttcttgagacaagggagagaaaagaaagtgacatcatcttttggtgacatcatgcaaaagtcaatcttcattttgaattagctcttgaaaaagcttgccttaggttaaaagccttaggaaaaactatgagtaacactataaaaagcggattgagaaattcagaaccagaatatgatcttgctcaatgtgcaaatgtggtttgtttagaggatgcttttaggaagtgtatacgtgcctgtgtgcacacacacacatatgcacactcacacattgcactgaaatgcaatattgcagcttctgacatttgatacctcaattttgctggaatttccaagggcatagtttggagtaaataataatcatttactgcattaatcttgcattctcaaaaaatgccattttgtttcctcaggacaagagtgtcaactcaaatttactcaaaccaatttctcttcatgaaaatcctggtgggctgaactaatatttcattaaaaaatatgccaactaaaataaacctgttttcactgagggtgttatcattgaatgatgaccttctgcagactggagctggcctgcaggctcaatgtttggcatttatactctagtatatttcaggtttacttatattaataatcaaggtaacactagcttatgggctcttcagcatggaagggattttgagaacccatttgttgatctagaaatgaatccttttcacttcaattggattttttttttacatatgtgagacagatgacaatatgtatcctgttggacgatgcttgtggaaaaatagcaagaggaaataagttttaagtggaagaatttaagttggatacaaagaagtagttgctgaaagaacaagcaaaacacattagaaatagctatcagtgttggcttggtaaatctctctttccctctctcattttgtgggtgcatatttgtgggtgcaatttgttaatgcatatacacaatcataattttttctttttctttttctccttatttcaactagctcagttcttgctgttatagactaaaaagtactcaccatggtgagtagtggcctaacctgagtgattataacttggtccaacaattgggattggccttcagccttgttagacatagttctaaagcaaggctgtttatttaaagtaagcaaatcacgagatacagatttacaaatgaaatgcaagtgtgttacgttccagggggaaatattcctccctggtaagcagaatgatcctatcctccactcaaggtacctaccccccggaatcaaaaccaaatgcaataggaaatgttggttgtcatcctggcattcattccctctttttccattcctaactaaattgtgattttgtgtaggtgtcatctactcccacacataacccacatgcctcaggggaagctggtcgaccccagaccttgaagccccaattagtctaatctagtcatgtaagccagtctgttaagcagatagtctggcccaaatcaacttggtctaatgaaaaacaaaaataacttctctgagagtttttggaaatgcaactttcttgttgataagcacagctacaggaagtcagtctctcactgggtataaatgagtaaccattagcactagttgctataagggggtattctatagccatgaggggaatcagcctcaggatgaagctgacagtgttggtgttagaatgaagaaatggaagtaacctgtgtccttgatgattttcttgctcaactaaccctgaagtctatcctataggatgaagcactatgaggagatatagcaggcaagcagaggtctgagatcagttaactttagttttggccaacaatacgttttattattattgaagagaggttgagaccggttttcaattttatacagctcaaagaactgagttttttgagaactcagctcaaagcttgagttttctatcattgtcatgccagagtgaaacatttgtcgttctctaattaaataatgtacctgccacaactggaacattaaaggatctggcagaaaaatttcaggctattgactacttcttacatattccagtaaagtcttacaaaaatgagataagcttcgatgttcatctcagatgttgccattggaagacagtggggtttctttcagagagaactgtgggatgccagattggttgtctctcttgaactccctttactactagaatagtaaaccctgctaccatgtccaggaagaaatatatcatatatccgtagactgatgatcattggtggtatttttcattcttttttctgttttgttttttgaaacagagtctcactctgtcgcccaggctggagtgcagtggtgcgatctctgctcactgcaacctccacctcccggattcaagctattcttgtgcctcagcctcctgagtagccacggcttttttttttttttttttttaagtagagatggggtttcaccgtgttggccaggctggtcttgaactcctgacctcaagtgatccacccacctcagcctcccaaagtgctgggaatccaggcatgagccaccatgcctggccatttttaaaattattattttctaaaaggaaggttttattagagcttctgtgctttatcggccattgtgcattacatatgctcaagatgtatcatttaatttatagccatctattgcttgatcactaggaactatatcttgatctgatagagaggactcagtgtcaaccagggatgggcttgcagctaagtatagcagctgggaagacattgggttgcttccttttaggagtggccagaaaaggaagaggctttctatgttttatgtttctatgaagttttcaataaacttttaccaatatactccttttatctccttggccaaaatttggtcacaagtcaattcctagaccagtcattggcaaggaaaatatgggattacccttaaatcaatcattcttgtctagagttaaagctagcttgccaacttcctctaaatctgctcattggaagagagatagaatggatgttggagagtcagccacagcatgtacttcatggatttagtaatcagagagttgtttcataagcatagaataaggtggagggctgagactccgcatatgacaataaggagaaactgtactttttttccaagttcttaggggcagtcacacttgctaccatgtactaccatccatgggatggtagatccttaagacctagaggtctaatgttaactttctcacacttttgtctttgattaggcctctctagcacataacatagtgagactatgattatatgatatcagagattcttaaactggctatgttgaataaaagattttcaagaaattgatgagtcttaggagcaaaagcattgtatgtttctgataatttttgaaatatgtggcttacaccaaataagactcccaatgatttttttcccctccctgtatatgcaggctactcttcacatgaagactttgcccctccctgccccttgagtcaaagccagccttgtgacttatatggatcaatataatgtgacagaagtgatgttttggggtttccaaacgcgggccttgagagaactagcagctttgccttcttttgtctggaagtcagctaccatataagaagtatgactgctctgagatcaccatagtttgagaaactcagcctagccatttggcgaggtcacatggaggagcactgaggtgccatccatgtgagtgaagccatgctgggctttccagcctagccattagctgaatgtgaataaatgcagcctgaattcctgacccataaaatcatgataaagcatagagcattgtcttaagccactaagttttagggtagtttattatacagcaatagatgactgaaacagttaaacatatgtctttactgcagaacattttgaagcttttaatatacacataatctttaagtatatccaaagcatgaaagggtgattggcaattgggaaccctcttctcttgttacaagtataagtgtatgttctgcaggtcagaatatgagaaaccactccagagtgtagtagatggaggcttgatgctccatggccagcagaactgccaaggaaggagtttctgggtgctaggcataccaatggaggtgaccaaagtctaggttatagaaaatgttctcgccaggcaggtgaagcagagtgtataggaagattgaaagattggggcaagtgttatacgggaggaagagcaagtagtcagcctcagggaggtctagcacagtgtcattgctcatgagcagagcatggcctcagggataaggcactacgagaagacatagcaggcaatcagaggtctgagatcagagatctggaagcttgcacaccctagtcactgagatggaatttaagaacaggattccagctgataggaatcctgttcagaaaggggagacattgctgagaacgaggcaagatcccagacttagagtcttagggcaccaagtaggttataaaggcagggtcttacagtgttgcccagagatggctaaaaaacttagtcccattgctgctggaagccttcaactgtcagccctttttggggattgtctcagctgaagatagccatttccactgaagagagctgtcttgcgcaaaataatatctcctacccgaagatggtgcaatgctgaggtataaatgtctgacccctcaccccaacttgggacaactctgaaggcctatcccagctccagatctgcctgtggggtttgaatgaggccttcatcaggactgtatgttagtctcctcaggctgccataacaaaataccacagactaggtggcttaaacaacagaaatgtgttttcttacagtttgaagtttagaagtctaagattgaggtaatggcaggtttggtttctggtgaggcctgtcttcctggcttgagtagccactttgtcattgtgtggccactcctctgtattcttggggagagagggagagtctctggggtctgttcctcaacttataaggacaccaatcctgtcagattaaggccccaccctcatgacctcatttaacgttaattacttccttataggtcctatttccaaatacagccacattgagactatgacttcaacagatgaattttcgggtagacaattcagtccacagcacactggactcctagcattcccactcctctctctgcccactcctgcttccttggcagtttttccacaggtgtggatcctaagagcactccctaatagaattcctgcacacaaatctgtgcttcagagtctcagtcccagggaatccaacctgtgctggatttgaactgttcaaactgaggtacagattgaggactggctatgggaagtacaagcttttctaggaaagagatcccaggctcactgtctcttttatatttgtctttttatgttctgtacctgacttagggattggcaaatggcaggtgtttaatggttagttgaaagaactaacggatgaatcaataaacaggaacaatgcctgtttcctacacttgggatacaagtccagaactagcctggttccctagatcaaaccagattacttaacttcttgaatgaggacttcctaaatacactgtgaagctataggatcagatccagagcctgggatggggctgagtctgcagatggaggtcagctagatccatttttgaggactgtagctctgtgaagacacaaaggtcagtagctcccacagagtgccttgtaagattaacttccaatgcattaggattttaatatggccatttgtttaaattaatgtcttacaaaatgtctgtccttgatactatcccacttacactaacatcttagggttcaaggaggcagttaggccctaacacattgtcaagtatttgtttattctgttgatcatttaaaacaaatatttattgggcatctataatactcaggctctattccaggcactggtgattcaaaattagtgttcaacaaactccataaacttctttttatcatgttttaaatcttactgggagtgtagatggaaggaagcctcaaggtcacagctgcaaggtttaatacacaagctttgggattagcatgagtttaaatcttggctcggcaataaacctgggcaactgcctaacttttgtgagcctcgatttcctcatttgtaaaatgggaatagtaacactaacatttacttcatgagattgttgtaatgattatatgagataagcttagaaaagtgtctgatttatactttgtgtcccttagtaaattcatagaaaaatggtaacctctttcccaacagattaccaatttccttatcccacgcatataatccagttatgaatgataagagaagatatggttgtgtgagatgtgtaaagaaacaacatgtactgataactctggtaggttggagtattgtttccaactttttattcaccctgtaatagaatgatatgttcactgactttgctatatgactttgtggtatcccccatatgaataagcagagtgtacttctccacctcattgcttttaggacttggccatgtgatttgttttggtcaatggaatgttagcatgtacgggcattgtagtgggttgaataatatctccccaaaattcatgtcttcttggaacctgtgaatgtgaccttatttggaaataggatctttgcagatgtagtcaagttaagatgaggtcatactaaattaggtgggccctaaatccagtgactggtgacttacacacacacacacacacacacacacacacacacacacacacacacacacggtataaggccatgtgatgatggaggtagagattggagtgatgcagttaccagcccgggaatgccaaggattgctgggagtcaccagacactatgaagaggtaaggaaatatttttttcctcgagccttcagagggaacatgaccctgctgataccttagttttggatttctagcctccaaaactgtgagagaataaatttctgttgttttaagacacctggttcatggtatcttgttatggcagccatagcaaactaatacacacaagtacggagaatttaaatgagcttgtgtgtttgacttggtctcttgcatttctggcatttgcatgagaagaacatgctctgggtacatgctggttccagaatgaggagacttgtggagtatatgtgattccaacccacagttatgggcaaagtccagcaaatctcagatgatctcagcagaaccacagtcagcctgcaggctgtgaacaagaaataaatgcatgtggctatattgcattttgggcttgcttgttgcacaggattagtgtagcaatagctgagtaatatagtgatggattgggagtgagagacgaaggagaagaagcagtctgttagaactttaaaaagttccagatcaccttattcattgtcttcaggaatagatgcagcccaaatgtatagggggcagtggtgggagggagtaaggtttcatgctagagagtatttttctttttttcatgggaagatgggaagaaaatgaaacctactttggagtcacttatctatccagttttccagatatccatttggatgaacaggcaacaaaatgaaatacagtggaagtagaagggaaaaccagggaggcccctaagctgtttctgtcttgccaaaggagccaacaacccaaacaagaagaggttgtctttagaaatgacatatggttaggtaggttttgaaaaattaaaaatagcaaagggtttctagtgttcctagcttattatgggataaaaatgagaagcaatttgcaaagatgtgggcagtagcagaatgaatagtggaggctgattaggtacatttgcccagggcaactcattaaaaagcacccgagtacagtactgaaacccttgtaatttccactacctcccaccattaccactttatcagcttcagagagaaagtcagtttattattcaaaaagcccactcctgaaatatgtttgttcccaaagcccttttctttcttgtagaaacacactggagtcattcaattgcttttggatgggggtgaatggcaatacctctccttagccttaaggcaggaggttaaagattaactttgtgcctctatttctgttactttttttacctttgtcttccttctagtcaacaacataccattacagatgaggtaagacaccatgtgctcattctctgtgtgcatttaaaatgtggattcagcaagttcgcatcttctctttgttttgacaatggggaagggaaggctgctttgatctttgaaaattatggctataaataatgcctattcaaatattggctcaacagtgattgcgtttgagttgtttttagaatctttctaaagccctcttttctcctttggatgtgttagatgctgatcaaatttgaattcccacatcatatttatgtatctcaagtatatttgacaaacagatgctgtactgtatctcaggtaaatattttatgttttggtttttttcttatcataaaagtaatgcatgcttatcataaagttgcactgtataccaaaaaagtataaataagcaaaaaactgtaaaaaatccataagcttaccactcagaaatactgatagaatctgtatctatgtctgtatattttcataaatatatgtatatgcaaattttatatatgcctatacagtttctttataaatttggtatcatactggtcatacggttttggagttcctgtttttagcataagctattatcccatgtgctagattgtactcaatttggtgtgtctgttgtgtttgtggtaagatttattctttttccgatttacactttgcttagggatattttgtagcccagttcttttactctgtcttcatagtgcatggaaatggaaatgtgctctcccctatgcatgaatgaggatctttcatttgctactctttctggagagaatgataaatccagttctacagtttcagatttaactctaagactgatttgtatgtggccataagtttaagtgctaggtagtcaggcttccaaacatgtattaatcccatgtcatgtgcagaacacgatgttaattgttttagtgtttcttgtggatgtagaaatacatcagtcttcaagtgaccagcagctcatgaaataattggtgaggggagaatgggttccgatggagtctggcactgactggttcttggggaagtgaacagagtagactggctaaactctagggttcatccttggaacaagaaatgcaataatcacaggctcagaggcagagaaagtctttataagtgtaaagaatggcaaggaacttggcttggcaacagcagaggagccatgcaggggagaacagactggaggctgatttgtttgtaggacctggacgctgagcagacaagcctgaatttgacaacacagatgggaaggatcccgagtaggtttctcagcagggcagtgatataaagatgagggcattcaaagtagatgattttattgcccgtgtggatctgtagctctcattatctagtgtgatcattctaagagtgtgcctgctaggcttctgccccgtcagagtctggccatctaagttgtgtgcagcttgtgcagctagtatcacatcctgtcccactgggaaggtctgaggtgggccaattccagcccctctaaataattagttcccactgctgtctgtgcacagaactgaaaggagcaatttattggcattgtgggtaatgcccagacactgccaacagaaagtattaagctaactgatttgtagaagaggacaagggggattatttttcaaccataaacccaacttgagagggggtagttgtctactctttaaaattagcactaaggtttacctcacaaaatgcacgctcctgccctcatacattgctggcagggatgcaaaatggtacttgtgaaggagaatttggtaatttctaacaagattgcatatgcagttaccctttgagttatgaatgccacttctaagaatcaaccctaaagatataatggcaaaaaatatagaacgacacatgtgcagggttattcactataacacagtgtagcaaaaaattggaaacgtcaaattttatcaatgagacaaaaaaaaactaacacacatctacacaaagcaatactatgcaattatgaaaaggaatgaggaatagcactatacattgctgaggactggtttccagcgtatattatgtgaaaaagcaaggtaggaaaagcatatattataaactatcatttattctaagaaaggggggtatgaatgtatatattcatatgtgtatattactatatatacccatatgtgtatatgaatgtacatacagtataatatgtttatttgcttatagtaaaaaaggaaggataaactggaagctaaaaatgaaaagaaaaaaaaaggttaccaatagggaaggggaacaggaaataagaaaacatggtgaagggaaaggaatagagttggcacttctctgaatataccctgttttgtagatttgaatttggaaacaataaactatattatataattatattacaaaattaaaatttaaaaagcaatctctaaaaataaaaaaaagtaatgtaaaacagatgaaacaaactatgtagtaagtttttgacttaaccgtacagagaggaactgttccatatgatttcaattaaacacaataatttggctttacattcctagagtgattatgtgctaaggacagaaagaactgtaaaaatgtcttggtaatattaggttataattctgatgttgtgtgtgtagtgtaggaaaaggcaaatgagtatgctggtgttgttgggagctgggatttttggcgtgaataacaggtgatacagatataatacagatgagattaagtaaaaatcttatattcctggatttgaaatgaaagtgtcattataaactcacattatagctcatctttcgtaagtagattttctagctttgaacgctgaaaagacctaaaagcagtgaccatcccagtagcaatgcacatccctggtgtccaggttgtggtctttaagtaccattttccattaaaaggaacctgggctccttggaaaattagctgatatcagaactggggcagaaaatgtataagataagcctggaacaacttaagaaactaggaggcaaggaagctttcaaagactactgtgggtttcttaaaaggacacaagagccacttgaagggggacgatttgattatcaataagaataacaatcgcgatggattgaaacatttgtatatgcttaatctttccttatgcttattctgattaaaaaaataaaggtcactggtcacctcggatcttctttgtattagagaaccaatggatatcctgaaaactggaatataagtggaaaaaatctagcttttatctttgtttcctacataaaaagcacatcattataatcaattaattgatcagtggaagttccttattcttcttcttttacttttagttcaaagtactcatcatgaaagttccctcttaagtatattagctggtaaatgaaggaatgatagaattataacacttctatgttgcaacctctaataaaatattgatctggacaatgatagtgggtgactgctaacatcacagaaagagagaaaaccagctttcttggccttttaatggatactcacagcactacctattaaagattactggcaaaatagtgtaaccaaatatgatcaaggttttacttttaataaccaatttacaggaaatacagggacagaggaacatgttaaataatatcatgagatatgctatggtttgaaccttccctcccaaactcaggacgtttgaaatgtatttgtcattgtgatagggctaagagttgggacctttaagaggtgattaggtcatgagggctctgctctcatgaatagattaatgcctttattgtaggagtcagttaggtattatgagagtagactcctgatgatagataagtacagctcccattttctccctgtcttgtgtgcttgcttacccttctgccatgttatgatgtagcaagaaggccatcaccagatgtggctctttgatcttggacttcccaggttccagagctgtgagctaaatacacttgtctctcagtatccatgggggattggtctagggccccatacagataccaaaatcagaggatgctcaaattcttaatataacatggtatagtatttgcgtataacctacacatatgctctcatatactttaaatctctagtttacttataatacctaaaacaatgtaaaggttatgtaaatagatattatactgtattgttttttatctgtatttttattgttgtattgttattttattattttttcccaatatttttgatcagtggtttgtttgaatctacagatggagaaacggtggatacagatggccagctgtaaatctcttttctttctaaagtatctaatcggtcgtattccattatggcagcagaaaatggactaagacaagatacaatttccaaaatccagactgtacaaaacatgggaccatcaacctagtttatccaacaaaaaattgcaagaaaaaaaagatatgagtgaactaagacttaaaaaaaggaaaccaattgctacgtacagatcttatttggattctgatccaacacatcacagaaatgcagatatgagacacggaaatttgaatattgactaaattttaacaatactgaaaaattgttgttttacatgtgatattagtattattatttttggcagtaaatactgagatatttgcagattacacgttaggaaattatggatttgtttcaaaataagaaagtagcacgggctggggagggtagtaggtggggaatgtatgagacaagattggccatgagctactggttgaaactaggtgatgtgatgagtatatgtattaccatatcataataatcaggccaattctctcaaacaaatgaaggagtaaatatgagaaatagaatacagaggaaaaaagcaatatctttatttctttgaagtttactaatctgctttaaagttcttgagtaatatttaagtattctaaacttctattaggatttcaaaaatacaatttatttatttatttttgactcttttaaaatcatcatttagaaacaagaacttccatagcaaatttggattttaactcagcatttagtgatgaattatacaattctaaatatctgggcttgttagaaaagatgacattttccattgtaatgtttatgtatgagttatctctcgtacgggagtccactgcttatagtagcctaggcttttgataagctatagttgcttcaggctgtgtgctacatttcttggtaagtcttggtgggtgttagcacaaacactactcatttgtcatcttttactaagctaaaacttttctgtgcagttggaacacaagtcttctcttttatccctgaccttcctgggacctttatcgctatcagcagtcccttccttgactgccttactgtcatctcaaatggaatctaccaatattgtattcctcttatttcttctgaagtggttctctcttgacatagcctagcatctgataaccctagactcaagaaatattctttgtgtttgtctttctttggctatgactgcaggtcatctggggaactgtttacagtttcagatatcaccagtcactactgagaaggaagaaaagtaaaactatctttgaactctgtagaggtaaagattttcaaactctgaaagacaggaagggagggccttattgaaacctttaccttcattgtcacaagggtctctactcttcttatttcagggtggttactgaattgttttcaacacagtccaattcagagtataaatttatagtagatagtaagtatatgacttctttttataattttattaaatggatgtactcatccaattaccaaagcctacttgggagttagatagttttaaatttaaggtaataatttatgcaattaataaatctgtgtcaccctttaaacagagattaattgaattaattttgataacattattcttcatatttctcttcgtatgtgctagcacactaataatagatgttaataatgctttgtatttgtaaagaatcactgtattcaaaccatttacagtgatgtctcatctaataacataggcaaagtaattatttgaaaaattagaaaattttgatccaatgaggccagaagacttaccaagttaatgatagaacccagagagtcaaggaatgctctttctacatcccttcttcccaagccacatccccaaccagtggatgggcttgattcccacttcacttttcggaggaccagcttttggtttcttttttcttttggcttggaaaagaacccatttattatttcactgggctatagattgaatatttgtatgcccccaaaattcatgtgttgaaatcctaacctccatagtaatagaaagtggggtctttgggaggagattaggttatgagggcatagctctcatgaatgggactagtgcccctataaaagaggctctggagagatcccttgctccttctgccatgtgaggacacagtgagaagacggctgtctttgaactgggaatgagtcctcactggacacaaaatctgcaggcaccttgatcttggatatctcagccaccagaactgggagaaataaatttctgtttttcgtgagccacccaacctatggtattttgttatagcagccagaacagactaagatacaccatttttgtggttcaggagtctgagcattgcatagttgaatcctctacttagatctcacaagataacatcaaggtgtcagccagagctgtagtctcatctgatgcttaggaacctcttaaagctcattcagcttatagacagaattcagttcgttaaggctgtagaactcatgcaagcttttattttctttgaagccaggaggagactgtgcctctggtacttcatcctcttttaagaactcccctaagtaagtcaggctgacccaaaatattttctttttctattaactcaaaatcaactgattagtaacctaatgacaggagtgaaatctcacactcagggagagaaaattatatagggcatgtacaccaggaggtagaaatctcagccaactacaaactgtatacaaaaacctttaaaacatcattgtgagaaattataagaactaagtaaatggagatatatatgttcatgagttggaaggcccaatattggcaacgtattcttttgaaattgatttatatgtttaatacaatccaaattaaaatcctggcaggctttttttgtagatattgacaagctgattctaaaatccatatggaaatgtaaaggacctagaacagcaaagacaattttgagaaaggatcaaagttacaggactaacaccacttaatttcaaaacctataatgagggtacaatgatcaagtcaatgttgtattgaaataaagatagacaaatagatcaatgaagtagaacagagattaaagaaaaggacccacacatatatgagcaactgctttttttttttttttttttaccaggtctttaaaggggtttattaacattggtaatggctgcattaattcaggtggcaacttttatttatttattttatttatttatttatttattttattgatcattcttgggtgtttctcacagagggggatttggcagggtcataggacaatagtggagggaaggtcagcagataaacaagtgaacaaaggtctctggttttcctaggcagaggaccctgcagccttccgcagtgtttgtgtccctgggtacttgagattagggagtggcgatgactcttaacgagcatgctgccttcaagcatctgtttaacaaagcacatcttgcaccacccttaatccatttaaccctgagtggacacagcacatgtttcagagagcacagggttgggggtaaggtcacagatcaacaggatcccaaggcagaagaatttttcttagtaccgaacaaaatgaaaagtctcccatgtctacctctttctacacagacacggcaaccatccgatttctcaatcttttccccacctttcccccctttctattccacaaaaccgccattgtcatcatggcccgttctcaatgagctgttgggtacacctcccagatggggtggtggcctggcagaggggctcctcacttcccagtaggggcggccgggcagaggcacccctcacctcccggacggggcggctggccgggtggggggctgacccccccacctccctcccggatggggcggctggccagggcgggggctgactcccccacctccctcccagacggggcggctggcctggcgggggctgacccccacctccctcccagacggggtggctgccgggcggaggcgctcctcacttctcagacagggcagctgccgggcggaggggctcctcacttctcagacagggtggttgccaggcggagggtatcctcacttctcagacggggcggctgggcagagacactcctcacctcccagacggggtcgcggccgggcagaggcgctcctcacatcccagatggggcggcggggcagaggcgctccccacatctcagaggttgggaggccgggcagagacgctcctcacttcctagatgggatggcggccgggaagaggcgctcctcacttcctagatgggatggcagccgggcagagacgctcctcactttccagactgggcagccaggcagaggggctgctcacgtcccagacgatgggcggccaggcagagacgttcctcacttcccagacggggtggcggccgggcagagtctgcactcggcactttgggaggccaaggcaggcggctgggaggtggaggttgtagcgagccgagatcacgccactgcactccagcctgggcaccattgagcactgagtgaaccagactctgtctgcaatcccggcacctcgggaggccgaggctggcggatcactcgcggttaggagctggagaccagcccggccaacacagcgaaatcccgtctccaccaaaaaaatacgaaaaccagtcaggcgtggcggcgcgcgcctgcaatcgcaggcacttggcaggctgaggcaggagaatcaggcagggaggttgcagtgagctgagatggcagcagtacagtccagctttggctcggcatcagagggagactgtggaaagagagggagagggagactgtggggagagggagagggagagggagagggagagggagagggagactgcttttttaccttcatttattccttctttattattcctttatgtggacctgagtttctaacttatatcattttctttctttctgagcttttgaaaaacatttctggcaagagtctcattgatttttctctattgcttttctgttttcaatttcattgatttctgctcttaaatttgctacattcttcttgttttgaatttaattattttctttttcatgtttttaaggttgaaacttggatcattgatttgagacctatcttcttttctaatataagcatgtaatgccataatttccctttaaacactgcttcaactgcatgccacatatttttatatgtcataattttgtttctttcaattcaaagtgttttctatccataggttatttagatgtgtgtgatttattgggttattcatttctagttcaattccatttttgttatataacataatgtgtctgatttcacttgattttattttgttaagttttgtttcttgattaaggatatggtctatcttggtgaacattccacacatacttgtaaagaatatgtattttattgttgttgggtaaacaaattaggttatgttgaatgatagtgctgttcaggtctatatctgtactagtcagctcaggttgccagaacaaaatatcatagactgagtggcttaaacaatagaaatgtaggtttcaccattttggaggctgggaagtctaagatcaaggtgccagctcattctgttcttggtaaggactctcttcccggctttcagatgacccccttcttgctatgtttttcacatggcctttccttggtgctagggcttcaacatgtgaatcgtggggggacatattccatttatagcaaggtccttgttaatgttctaattgttctgtctaatcattgagagaagagtgttagagtctgactataattgtaggtttatttctcctttctgacctatcagttattgctccatgtattctgaagctgtgctagtagtgcttacatatttaggattgttattttttgtgaactggctgttttgtcattaggtaatgtttctttatatcattggtaatttacttgttctgaagttctctttgttcaacattaatataatccattcaactttcttttgattaaaatttatatggtatatcttttcctattgtactttttatatttttatgtagactctttccatttaatgttagtttattgtagacaacctcttgttgggtgttgtttctcatccaatatgacaatatctgctttataattgtgtttttagaccatttaatgtaatgtaattattgatatgtttgaatttaggtctactactttatatttgttttgtttgttccctttgctctttgttcttctgtttctctctctttctctgtctctttctttttcctgactacttttggattatttgaatttcatttatttgaattttaacttgtctatttttggctgtatctctttgcattaattttttgattgttctagagattgtactctctctctctctatatatatatatattttagagctaatagtatttcaccacttcaagtaaaatataaaagccttataaccatatacatcccctttatgcttccccctttatgtcatagttgttatatgtgttttatctacacacattgtattagtccattttcacactgctataaagagtactacctgagactgggtaatttataaaggaaagagatttaattgactcacagtttcacatggctggggaggcctcaggaaacttacaatcatggcagaaggtgaaggagaagcaagcatcttcttcacaaggtggcaggagagagagaagtgaagcacaggaaaaactgccacttttaaaacatcagatctcatgagagtcactatcatgaaaacagcatgggggaaaccacccccataatccaatcacctcccacgaagttcctcccttgacacatgggaattacaattcaaaatgagatttgggtggggacacagagccaaaccatatgacacattgaaatccccaccagacaattttataatttttgcctttacagtcatacatactttgaatatcttaacaaaaattgtatcagtattatataatgaccctgatatttataatttttgttgctttttctcatttctgatgttccagatttccctcatgtatcattttgctttgtgtctaaaaaatttcctttaatttattttagagcaggtctgctggtgaataattcttttagttttccttcatctgaacatgttttattttgccatcattttgaagaatacctttgttttgtatagaagcattgacatgcttttctttcagcacttaaaaatgttgttccattgtcttctggctccctggtttctgatgagaaatctgttctgatggcaacaattcaagtcattgtcctcctatatacaatgtatcactttctttttggatgctgtcaagattttttcccttactactggttttcagaagtttgatcatggtgtctccagtatggttttctttgggttgatgctgtctaaggcttgttgaacttcttgaatctctaaatgaatatattccaccttttttttttttttacactttcggtaattatttttcaatttttcttgtatgaatatttttattatcttctcctgggactcactgacacaaatgttagatattctgatattgtcccatgcctgcatctctgttcacttttgaaaatctttttctctttgttattcagatagataatttctactgactcatcttcaagttcgctatttctttcctttgttattttttttctgtcgttgagctgaacagtgaattttaaaatttaagacattgtatttttcgattctaaagtctccttttaaaatagtttccatatctactttgtgaacttctatctttctatttataacaagtgtatttacctcatggagcctagctataatagctctttcaaagtctttgataatttcagtatctgagtcatcttggtgttagtacatgttgattatatttttctgtgaaaattggtcatattttcctagctgtttgtatatgaaataattttggaaaatattctggacattttgaatatcatactgtgaaactgaatcattttaaactcatctgagaaatgtagatctctctctctctctctctccccctctttctctctgtctcctctgtgtgtgtgtgtgtgtgtgtgtgtgtgcattttagaccacaagttctgtctcatcctctgtcagcagtaattccaatgtctgttcagttttcaacatctttggtttgtttctttgagtctgtgccatacatgtgccactttggggtcagtctggaagttgagaagtagtttatgttatattttagttctgaaagcttttgctatgctgtttttgttctgccccatgcataaattactcatggattattctaggactcaggagtgagttatatcttagttcagttctcaaagtctttgctatgctgacttgggtctgtcccaggcatctacagctcaggtgtgaggtcagatcttatctgagatggtacacaatattcagaaatagtcttctcccttttgtctgggattcttcaacccttcacctaccaccccaccacacacaaaatatacacatcagcttgcagagacctcttttcttggtgatatggctagaaagatggatattttattgcctgtgcaactactgccacagctcctaactagtgtccatctttgggccatgagataaaagagaaaaaatatctgagaatcttatactcccatatgggtctcttcttcaagatttgattcctgtccccaatctgcctacttttgtctacttttgagtattcaggttgttactttttgtgtttcgtccagagtttttagttacaatccataagcacactccatcttggccagcactggaagtctctcttcacttcagttttaagaagagaacttaggcttcatgtttgctccacagtctcctatcatattctgggtaaaacacaagacttttaaagaaatcatagacctgtatccactaggaggcagcactaagaaacccagcatttctccaggtctctgcagcctcaagtacgtggatgaaatcttggcaccttgtggcttccaattcccacaaaaagaaacactaggaccctaagctcccctctgcactctgcctcattcccattctttccttaagggttgtaggtatgtggccagtgctgctgccatgtccacctgcttccagtgcttgctcagtcaacttgccgtggctgcatggatggaagagggcttctccctggcagtgtttacaattctttcaataggctcccaaagctgactctttcaatatcttcaaagactcttccagaaaagctggaataagtgcctccctgccggcccaagttaagttgaaaactgaagtcactggttgctgctcatcacatacttctggctctctaacttctcagcacttagtagggtcgtcttcttggcccttttgtggttgggtcaggtcacatgattaattttggtctataagttgagttggaagtgatgaatattacttccaggctggaacattaaattgtcagtgtgaaactttctagagttctctttccctttgtcaaaatgactgtaatgttccaggttgtagctcctctatcaggcaaggtctcagagtgaggaccacatagtgcagagccccctgtcaacctacaatggccatgaagtatgagtgagaaataacttttgttgttttaagctactgaagttttggggttatttgttggtgaaatattatctaacctacgctgactgatacagaagctatatgaagagtactacctagcattatagtaaaaattatttcttcttacctacttcaaataagggtctcagggcatagacaagttatcttgaggtggtcctagctaattgttagttttctgtccattcaagcactcctcttagaacttgaagctgtctctgtcttgctggaatttttgagtcttagtgtccaggacctgagtatcatttcttaaatttatgccctacatttattcctcaagaccaggtgatcttcatacaaacagaacaaatggtaacctgccaacaaaacccagaattcaagaggtgggctagagtttagactcctctctttcttccattctattacactaaagttgtttatttctttttccttcctttattccagtaatttctggcacttttaccttttaatattttttcctttattccccctttataacaccccaccctgaagacatctggttacttatcgctatacttttatatccttctttctcttagtggactacccttttccttatttagattaaatttggtgttctcacctcaaggcccttcaatatttttattaaagttgattctatctgtgacccttgtttaattcttgcatccctggcctaaagaagtaatgtactgaatctcctggaataagaaaatatagagataacgctacatggtcataacagcccatatacagcacttgttatgtaccaggcatttttctaacctcattaagatctattaactcattttctgctcacaaaagctccatacatacataagtattataatctctattttgcagatgaggtaactggcgcaacgattatttgacttgttcagggtcacacaggttataagtggcagagcgagaattagaaaccaggttgtttggcaccagagtccatgttttagtcactacgttttattgcttcactgtaatgcggaaggttttaaaccatgggttgataaactatggtcctcagaccgtatatgccttggcatacatttgtataaataaagttttattggaacacagacacttcgacttgtctaatattgttcgtggctgctttcatgctataagggaaagggtgagtagtggagacagagaccatatagcccacagagtctaaaatattattacctgacccattttaaagggtgaataggagtatttcagacaaaatgttcctgataaagggaatggcatgcaaaaaattatggggcatacaacctcagagtttttttgcacctgctctgtaaatgttttaagagaagagtctcatctcaccatggtgagaacaccatacacgctcaatacagagttgttgaaaacatttgtccagtttatccgcaatgttaagccactcataaatgtgtactgctgtacctattttttgtgttttccagcattattttttcttctaatatttaattttttaatttttgtgggtgatatggtttcgttctgtgtccctacccaaatctcatgttgaattgtaatccccaatgttggaggtggggcctggtgggaggtgattggatcatgtgggtggtttctcatgaatggtttaacatcgtcccctcccctttagtgctgttctcataatagagatctcacgagatctgattgtttaaaagtgtgtagcacctcccgcctcattctctcttgctctttctccaggcatatgaaatggtgctccccctttgccttctgctatgattgtaaatttcctgaggcctccccagaagccaacaagatgagccaattaaacctcttttctttataaattacacggtctcaggtctttatagcagtgcaagaacaaactaataaagtgggtatatagtaggtgtatgtatttatagagtacatgagatgttttgatacagccatgtgtagtgatattgattatgatcatatgagtcaggaacaaggaaggataatgagtagtccagtgaactgagtatattataaattcacattattatgattttaattatattacttttattcatctaagtatttgttgataggttgtatattttgtgttcaaatgtgttttataatagaaaataatcttagtgaatctgatgacatgtcaaaaaaatttgtccctgaatttgtggtggtggtgataaggggcttagaacacacatacatacacacactcactattaccagaccttgccccttcccaacaaacacacttacagacacattttaataattaatgttttatttaggcccatttcaaagatgaacattacaatgacaattatttaaaatataagtaggatccaataactctgacataatgtatttctgaggagagaactgaggaggatcatcagagggagtcacattgcttattcagtttgcacagttgtttattgtttgcagcagtagaaaggaatagttttatgtcttaataacttcacaaggttttgtttgacacttagtaaaacggggaactgttgcctgggagagttttttaatacagaaggaaacgattgcatgtactaaaatcttttgaaatttagtgtatgtgttagattcaagtttataggcaggaaagtgtttgatctctgttatagatcatttttttaatctgatgaataaaatagtgtttttgtttctacgtgtttttactgaatacctaagataaatgattaattatataaaatcttgttgtaataaaaattagtttccatattatgagtccatagttttaaaattattttctatgtataacatacttttttaaaaaagaatctttattttaggctcaggggtatgtgtgcaggtttgttatataggcaaactcatgtcatgggggtttgttgtgcagattatttcatcatcctggtactaagcctaggacccaatagttattttttctgattcctttcccttctctcaccttccacccttaagtagacccagcgtctgttgttctccctttgcgtccacgcagaacactattatttacacattaggatttttttgtttatataatatgttttagaaactataaaagtagcctacttgttgaaaaagtattttttaatattctaaagatctgctatgttctcttttcatgtttcagtaccattgaactgtttatcttaacagtgtcatctgataatctgagacttcttgaacaagcaacctcattttttttagaaagcataatacttcaaactatattttgcttgactgtacagggaatactcgacgacggtttcagtgggggcatctataagaaacgctatgatctttccctcagcaattaaattcttttttactaacggtagcttaattaattgaatatgctaagtttgtctaattttttaaacttttaagttcagggatacatgtacaggtctgttacaatagtaaacttatgtcacacggggttgttattcagattattttgttacccatgtattaagcctagtatgcatttgttattttcctgggtcctctctctccttccacccttcaccctcaggtaagcgccagtgtctgttgttcccctcaatatgtctatgtgttctcatcatttagctcccacttataagtgagaacatgtgttgtttgggtttctgtttctgtgttagtttgctaaggataatggcctccagctccatttgtgtttctgcaaaggatatgatctcattcttttttatggctgcttagtattccatggtgtatacataccacattttctttaatcaatcgaccattgatgagcagtgattccatgtctttggtatcataaatagtgctgcggtgaacatacgtgtgcatgtgtctttatgatagaaaaatttatattcctttgggtatatacagtcagtaataagattcctgggttgaatggtagttctgtttttagctatttcaggaatcaccacagtgctttccacaatggttgaactaatttacacttgcctgaaccgtgtataagcatttgtttttctcctaaatcttgccagcatttgctatttttttacttttcaataatacctattctgactggtgtgagatggtatctcattgtggttttgatttacatttctctaatgatcattgatactgagctttttcatatgcttgttggtacatgcatgtctttttttgaaaagtatctgttcatgtctttttcccgctttttaatggagttggttttttttcctgtaaatttgtttagcttccttaaagatgctggatattagcctctgtcagatacatagtttgcaaaattattcttgcattctatttagtctcttcaatctgtcgatagtttcttttgctgtgcagaagctgtttagtttaattaaattccatttgtcaattttcgcatttgttgcaattgcttttggtgtctttgtcatgaagtctttgcctatttctatatccagatggtattgcctaggttgtcttccagggtttttataggtttggattttacatttaggtctttaatccatctttagtttattttcgtacatggtataaggaaaaggaactggtccagtttcaattttctgcatatgcctagcaagttatcccagtaccatttattgaatagggaatcctttccccattgcttatttttgtcaggtgtgttgaagatcagatggttgtaggtgtgcggctttatttctgagctttgtattcagttctgttggtctatgtgtctgtttttgtaccagtaccaaagaaaaaggggagtatacttcataacttttttctctctttattgatacataatatttgtacatatttatggagtgcatgtgatagtttttttatatgtacagagtgtgtaatgatcaagtcagggcatttgggggtgtccatcaccttgagtatttatcatttctatgtgttgggaacatttcaagtcctcttttctagctattttgaaaaatataatacattgttgttaaatatagtcaccttaatatatatgtgtgtgtgtatatatatatatatatacatataattaaggtaacatggcattatcttggaataggcacatagaccaatgaaacaatattgaggctgggtgcagtggctcatgcctgtaattccaacactttgggaggctggggtggggagatggcttgagctcaggagttcaagaccagccttggaaagatagtaagaccgtgtctctacaaaaaaaaaaaaaaaaaaaaaagaagccaggcatggtagtccatgactgtagtcccagctactcaggaggctgaggtgaagtatcacttgagcccagaaagttgaagctgcaatgagccatgatcatgccactctactccagcatgggtgacagaatgacactcttttaaaaaaaaaaaaaagaagggaagaagacaaaaaacaaaactgagggtgcagaaatagctcacatatatatggtactcaatacgtgacagaggtacagatgtgtcactataggtcagtgggaatatattagttttgcaggaatcccatagaaagttaccacaaacttggtggcctaaaacaacagaaatgtatcccctcacaattctggagaccagaagtctgaactcaagctgttggcagtgccatgtttcctgtgaggactctagaaaagaatccttccttgcttctcccagtttctagtggctccccgtgttccttgacttgtggcagcagaatgataatctctgcttccgtcttcacatggcctttccccctgtgtgtctatatcttctcctcatcttatgaaagcacttgtcattgaatttagggcacatcttgttaatttaggattatcttatctccagatctttcacttagttgcatctgtaaaaaccttttttcagaatatgctcacattcataggtattgggtgttagaacttgaatgtatccttttcaacccactacaggggctaaagaagagagagtttaatacatgttgctgaggtaattggctattcatgtaggaaaaaattgcattcctaaatcaccccatatcaaaaccagacttccatgtggataaaaatgcaaaaagagaattttagtgggaaagcaaatatgtagaatattataatctgcgtagaattaaaaaaaaatccttgtttaaaaagaggccctgaaaacacaggcataatggaaaaaaattcataaattcaattacattgaaatttaatacttctatacatcaaaactaccataaataatgaaaacacaagttatattagaagaatatatttgcaatatgtatgtctaataatgaatatgtataaatcagtaagaaatggaaacaaagcaaagcaaaataataatttttaaaatgggcaaatgtgtaaacaggcagttcatagaagagcaaataaacctatgaaaagatacttcaattccttgctaatatgggaaatgtaatttcaatgaggaatgagattccgttttgcaaacatcaaacgtgtaaaaaactgaaaaacttgagattaccaacacttgatatagtatacattagtataacgactttggagagcaatttggctttgtctagtaaagtcgaaagtgtatatacctagaacctataaattctcctggagacatgtgcattgcagctctcagtcatcagtgagggaatgaataatttgtaataaattcatggaatgtaatattctgtgacagttgaaataaatgaactagctctatctgtgtcaacctgaataaatccttaaaataatgttaagataaaaagcaaatttcagaagagtagatacagtatgagagtgttaaacaccaaactctggagaattactcctttcgtggaggtggtggagggaagaaaacttaatggaaagagataaatataggacttaaaatttatttgctatgttttcattaggctggatcatgagtacatgagtatttattatactattctctagatttttggtatttcttaaaacttggaaaatctttcatcatttcaaaagcaaaatgtaagagatgattgattgagttattacagggaagatattgttctgatgatttcagtcctctcaaatttaaaataatgtgaattgtagctaaaattatagcacaatggaatttaaatacaaggaagaataagtgaagaaggaacatgggaaatctggaggcctgggactcaattttggttctatcagcaactagttctaggaccatggacaaatcccttaaactgtctgaacctttgtaaagttggattgaaaacagaccctgatcttgattgtaggtaaaatgtctatggtttgtaaaatttacaaaaaacatgaccgtgtgaactgacagataggagggctgctccagaggaggtagacaaaagctagacctttgttgattgaagttccaggatgctgtgattctttgatgttaaggctgtggagtgaggaagatttgaagttggataaatttggggctatctagtataattgaaagtgcacaaccccaccccagaacctagtatttcctctggagatgtgcaaaaatgttcacggcagcttcagaagacgatgaagaagaaataggaatgtggcaaagaatactctttagtgcagacatgaggatgatcaaagactccggtcttctccctagataaattgggaagtattttgtgtgtggtgtttcttatcttgccaatcatgttacacatcaaataatatttttactgacactttgcaaactgtataaaacaacacaatgttgtagaacaagcattaactgcagattcctttgaagaggagggctggctgactggctgaccctaaggatcctcaaagggtgacattcattatgatagaccagagcctgcctctcagtcagtggaaaattcttctaatcatcaaatgtgtaaaattgaagccaaggattcagatcttatctatgtctaatcaaaaatggaagtttcctccttgaaagagattttccctaaatctaacagataatcctaagaaacccacacatggcattattaataataagttgtaagttaaaacttttctaaactattaataacaaaattttttgaacagccattttaggaaacggaattatctttctattctctctgttaaaatgatactacaaaatcattatcaaatgaaaagacaaaagtgcatgcatcaaaaaatgtgagaaaacagtattatagaggtgggtcaagctttcaattagtgaaaacattatgttaatttttgtggattttgttttacctatgttattttccagatatttaaaatgtgtatttattgtgatttttctcattctaaattaatatttacttttatatgttaattttattcttattttcatgtatttttttctttccagtttttattttaggttcagggggtatcagtgcaggtttgtttcatgggtaaattgcatgttttggaggtttggtgtacagattatttcgtcactcaggtaataagcatagtacctgataggtagttttttgaccctcaccctcctccaaccctccaccctccagtaggccttggtgcccattgttccgttctttgtgtccatgtgtacttaatgtttagttcccacttataagtgagaacatgcatattcttttcccagaaagatctccctcggactgcataagcttcagataccacagaacctgtattttccccgagcttaagagatcatgaatcccaaataccaatttaccacgtacattatggatcctaacggtcagaaattgtgatacttgaaatccttatgaacaaccttttcaaagcctggtgtcagacttactaaattacagttactagttgaaaatgagcaaaaaaatgtgacaagaatccacatgacctggttaaaaatctatattgatagaggtaaatagaaatagtaattataaaaatggtaataatcatagataacctttgttgagcaccttctatgtgccaagctcagtattttatgccttttgtatcaattctcagttaatatttgcactaactttattaaagtagtttttatgcaaataagggcaagtgcccagacaacacacatgttaagacctgctagatcagtgatcatttggaaaatctcatggagattttaagcagtagcaggtgtaaagtacctctcttgctcattcattctagggtagtgcatggtgatctagcagagccagacattcaattccaggagaggcgcccttactcttggctctggggcttttaggctacatgattagtgtgagagctttgtaatgtgtcaacttggctaggctaaactacatttcccagaatccctttcttacatgtttctggttaagaagaccacaaaggagattctgaagagatttggagagctagggggaggcagctgccatttcatagcatacacacattgttgccaatctgctgacttacctccttggcatgacacatcagctgggttagggttatgtgtttagctctttgatgaaggaccctgcttcctccaagctatcctggtgtcattggcaacaagaacagatactgatttcagtcaacccttgtgggtttccaacttgtgatcctggagtcccaggctgcttgtgttcttcctttcctggttgctttccctgtgaacttcaagttctaacatcagacatgaagacagtctcacagagactgcttaactaattccggcaattgtgtaagccaattctctgtaatatctatagatataaatgtagatgtaaatatatagagatagatatatatctcctactggttctgcttctctgactgaacccgactgatacaattagagaagccttggcccctcccttgatatgataagggccctgatgtccatcatttgcagttccaggtgatgacatgatgaggtactgctaagattcatcaattcattattcatgattagagaaaaattagttctcttcctggcataatcaaggagctaggtgccaggccttaaaattgaatagggttgattattcttattactagactatagctggtttgcatgaagctttgctggaggctaattcctttactgagaggccaatttgcagggattcagtcttggacaagtatggcagatggtattttctaaagatagctataccaatatacagtgcatcccacatgctcttcctaacaatacaatgttgccactcctccattgagagatagggtctgtattccattcctttgaaccttggaaaatctttgtaattgccttcactaccagaatgcagcagaagtgatagtatgtgacctccaaggctatattataaaaggctatatggctttcatctctctctctctgtttctccctccctccctcctccctctttctcctctcctttcctccatccatggcacacagtcaccattatggaagatagcctaaactagcccatgcagggagaccacacagacacacccatgtggagaggagcaaaagtctccagttgttttccagccatcaactaccagacatgtgaccgagtgaggttttagaagttttgatcccctagttttttagtcttccagcagaggcctcagatactgtggagcagagtggaacacagataagctgtccccagaaaatcctgcccaaattgaagattcgtgagaagaataaagttggttttttttaccactaaattttggagtaacttgtttggtattagttactggaaaagacaagttaactgtgtgtaatagtgatctactgctgtgtaacaaattatttgaaaatttagtgacttaaaactataaacatttattacttcacagtttctgagaatcagtaattcaggaattgcttagcttggtagctctggctcaggatttcccatgaggtggtagatgagatgttgatcagggctatagtcatttgagggtttgactgagcaggaggatcaccttccaagatatctccctcccatggttattaagaagaagtcttagttccttgctggatgttgacaataggcttcagttgcttgccacatgggctcctcacagggctgtcttaatgtcttcatgatgtggtatttggcttcccctggagcagatgagagagagagagagagagaacaagaaggcaacaaaaattcttatcatgtcctagccttgcaaattgcccaccatcatttccatcacatgctgtttgttgaaatacagcccacactcaatgggaaggcaattacattccaccttttgaagtggggaatttcaaagaacttgttggtatactataaagccactacaccctgacctcagttgtagcttctatgcctccttcccccattttgtgaccattccatcctctttaaacaaaagagggctgtgaggctaattactgccatcattctaggaaacactggagaatagttcagaatggctgggtgactatccaggggtgcaggtcatgtttacctgaggcagttgggggaaggcaatttgtaagaaggatccaggaggcatgcattgtgtggtctgcaaagtaataaggctgacacctactattgctgtgtggagactgaggaaatgttaaacacgatttgcagaattgctcttgagtttcttccaatgggaacctgtgtcattcggaagaagaatgagctctcctgccttgttgctcagtcctggatcctaggatccattgttatatttttattgatgaggattaatgttttaacttggtggaatttgcaaaagactgggagatgccagtagcaaagtggtgatgttaggagacactggaatggccttgatttacttcaaagagtcatgaggatgacagttttcctggaatgcaaggtgggtggtaactactgatctctacccccttcctcctataattttttgtgatgttttaatactagttgaggtgcttcttcttctacttcagatgaagtattcatttcatttggttcatatccagggtgataatcttgatggaaacccagacactctgttactgccacatttaaataatttgttattagtagttatatcttgctttttaaaaattgaggtaaaattcacataaaataaaattaaccactttaaagtatacaatgaagtagcatttggtaaattcaaaatgttgtgcaaccacctctctcaagttccaaaacattttcatcactctaaaataaaacttgtatgcattaagcagtcacttttcattcctctcctactagactgtggcaaccactattgtgctttctgtctctatgaatttacctattctgaattttcaatggactattcttcagccataaaaattgaagtactgatacatgctacaatgctacatgtggatgcacctcagaaacttgctaagtgaatgaaagtcagacacaaaatgtctcattactgtacgattctatttgtttgagtttccttgtttctagtttgtttttatcaaaagagagtgctgcattttgtcaagttcttttgttttgcatcaattgacatgattgtgtgtgtggattttttctgtcattctattaatgtggtatattatattaattggttttcaatgttgcacaattcttacattcctgggataaataccacttgcttatggtgtataattcttttaatatgctgctggattcagtttgctcgtattttgttgagatatcgcatctaagttcataagggatattggtttgtagttgtctcatgatgactttgtctggctttggtattagaataattctggcatcacagattaaagtacaaagtattccctcctcttctattattttttggtaggctttgagaagagttgttgaaaattcttttttatatgagtggtagaatttacaggtaaagtcatctggtcttgagctttactttgttgggaggattttgattacttatttaatcactgattaattctcttataatcctttttaatatttctattggtcagttgtaatgtctccatttttatttctggtcttagtaatttgaatattctcttttttcttagtcaatctaaccaaagatttgtaaattttgttcattgttttaactgaccaacatttggcgtcattgattttctgtatttaaaaaaaattttagatctcatttaatttcatcctaatcttcattatttctttctttctgctggatttgggttggatttttctcttctctttctagttccttaaggtgtaaagtgaggttattgatttcttctttttaaatgtataagtttttacagctataaattcccttctaagcactgctttttctatatcccaaacattttagaatgttgtgctttcatttttatttgtctgaaagaatgtattttctaatttctcttgtaatttcttctttgatcaattgtttttttttttttttaatggagtctctctttgttgctcaggctagagtgcagtggcacgacctcagctcactgcaacctctgcctccttggttcaagtgattctcctgcctcagcctcccaagtagctgggattacaggagcttgccatcatgcccaactaacttttctatttttagtagagacggggttttgccatgttggccaggctggtctcagactcctgaccccaagtgatctgtcccccttggcttcccaaagtgcttggattacaagcattagccaccatgcctggcctttgatcaactgggttttaaagaatgttgtttaatttccagatatttgtgaattttctagttttccttctgttatttatttctagtttcatttcattgtagtagaagaaaatactttgtatgatttcaatcttttaaaattcattgagattgttttggcctaatgtatggtcttctgtggagaatgttccttgtatatttaagaaaaatgtatattctgccgttcttgagtagagtgttctccgtatgcctcctaggtcgtgttggtttccagtattctttaagttctctatttccttattgatctgctgttttgttgttcaatctattatagaaagtagggtgctaaagttcccaactactattgtagaattatttttgcttcacatattttgggtctctgttgttaagcaatatacgtttattattgtttattattgttgcatcttcttagtgagttgacccatttgtcagtatataatgtccttgtttgacttttgtaatagttttcttatttaaagtctattttgtttgatattagtatagctacttcatctcacttcttgttataatatgcatgtaatatttttcctatcctttcacttttaactttacgtttttgcatctaaaattagtatcttgtagataacatatagttgaatcgtgttttcaatctattctgctaatctctgccttttacttttaaaatttttattttgttttttacttttgtgactacatagtaggtgtttatatttatgaggtacatgagatgttttgatacaggcatgcattgttaaaaaatcacatcatggagaatggggtccccattccctcaagcatttatcctttgtgctgttaaaagaaaaactttggccgaattaatttaaaggagtttaggggtggggccaagatagccaactagaaatagcaccattcggaggatcccataaaacaacaacaacaacaaaaacaaaaacacaatataataagcatgtgaatccttcaccggcaaccaaggtatccaggatctttcatcacaactgactaggaagctggcatgacccatggagagaaggaagaacagtgtggtgtggtggcccacctgagagccacacagggcaggaaagccccctccccccagccaagggaggcggtgaatgagtgtgctacccagccagggaaaccatgcttttttcacagcactgtgcaacccacaaggattggaagatcccactcatgaacccatgccactagggcctagcgtcccaaccctggaacacgcagacgtgcaaactcttaacagcttctcagctgaaatctgcttaagcctactgaacttcctggtggagaagcaaccagcaccatggctgtggctgcctgctgtctaagccctttgagctccttggaggaggggcagcagccagcactgggactctaaactgcctaacacactaagctcccaaggcggggcaagggcagcacccatctccatagccccagagtgtgcttttcccctgctggagtcagggaggctggatggcttggtcccaagatttggcccctatagcccaacacactggctgtggcagtcagcttccagagtgcctcttcaggcttgactctgacccatcctttctcagtgggcggggcttccctgcaggaagtccagtaactctagccagaggctcaaggacagaacccaggtccccctgggcctgagcccctagggagaggggtggccacagtctctgtggacaagcagacttagcctttcctcctagtagttctgaggaatctgggcagcccagatgagtgggtttcccccaagcgaggcacatccctccaacaaggggcaaagtgcctggttaaatgggtcctgttccccatgccacccaactgggtgagaccctccaacaggggttgtcagacaccctgtacaggagtgatcctactggcatcaagttggtgcctttcaaggtcagaggtcccagaagaaggagcaggcacccatttttgctgttgtccagcctccttgagtgacatctccaggcgtgggagcgaatgaaatgaataaggcctgaagttaactcccagcaaactgcagcagccctacagaagagagacctgaccattgaaaaacaaacaaacaaacaagctggaagcaacatcatcatcatcaacagcaacaacaaagccccacaaaaaccccatccaagggtcagtagcctcaaagactgaaactagacaaactctcgaagatgagaaagaattaacaaaaaaatgctgtaaacccaaaaggccagagtgcctcttgccctctaactgatcacaacatctctccatcaagggcacagaagtggacggaggatcagatggacaaatttacagaagtaggcttcagaagatgggtaataaaaaactatgctgagctaaaggagcatgttctaacccaatgcaaagaagcaaagaaccttgataaaaggttagaggaattgctaactagaataaacagtttagagaggaacataaatgacctttatcgatattcaacatttttaaagaaaaaaattttcaacccagaatttcatatacagccaaactaagcttcataagtaaagaagaaatgaaattctttccagacaagcaaatgctaaggtattttgttacaaccaggcctggcctgcaagagttcctggaaaaagcactaaatatggaaaggaaaagccggtaccagccactgcaaaaacacaccaagatataaagaccaatgacactatgaagaaacttcatcaactggtatgcaaaataaccaaatagcagcataatgacaggatcaatacgtataacaatacaattcaaacataacagtactaaccttaaatgtaaatggactaaatgccccaattaaaagacacaggctggcaaattggataaagagtcaagacccatcagtatgctgtattcaggagacccatctcacgtgcaaagacacacataggctcaaaaataaaggaatgcaggaatatttaccaagcaaatgaaaagcaaaaaaaaaaaaaaaaaaaaaaaagcaggggttgcagtcctagtctctgacaaaacagactttaaaccaacaaagatgaaaaaaaaaatacaaagaaagacattacataatagcaaagggaacgattcaacaggaagtgctaactattctaaatatatatgcacccaatacaggagcacccggattcataaaacaagttcttagagacctacaaagagacttagacgcccaaacaataatagtggaagactttaacaacacactgtcagtattagatcaatgagacagaaaattaacaaggatattcaggacttgaactcagctctggatcaagtggacctagtagacatctacagaactctttaccccaaatcaacagaatatacattcttctgtatatgaataagtgccacatgacacttattttaaaatcgaccacataattaaaagtaaaacactcctcaacaagtgcaaaataagtgaaatcatagaaaacaatctctcaggcaacaatgcaatcaaattagaactcaggattaaaacactcactcaaaaccacacaattacatggaaactgaacaatctgttcctgaatgactcctgggtaaataatttaattaaggcagatatgaagaagttctttgaaaccaatgagaacaaagagacaacgtaccagaatctctgggacacagctaaagcactgttaagagggaaatttatagcactgaatgcccatatcagaaaacttgaaagatttcaaattgacaccctaacatcacaattaaaaaggatagagagccaagaataaactaatccagaatctagcagaagacaagaaataattaagatcagagcagaattgaaggagatagagacacaaaaaaaccctccaaaaaatcaactaacacaggagctgttttattttgaaaaaaattaacaaaatagactgctagctagactaacaaagaagaaaagagagaagaataaagtagacacaataaaaaatgacaaaggagatatcaccgttgaccccacagaaatacaaactaccaccagagaatgctatagacacctctatgcaaataaactaggaaatctagaagaaatggataaattcctggacatgtacaccctcccaagactaaacaaggaagacacagaattcctgaatagaccaataacaagctctgaaattgaggcagtaattaatagcccagcaaccaaaaaaaagcccagcaccagatgggctcacagctgaattctaccagaaatacaaagaggagctagtaccattccttctgaaactatttcaaacaattgaaaaggagagactcctccctaactcattttacgaagccagcatgatcctgataccaaaacctggcagagacacaacaaaaaaagaaaatttcaggccaatatccctgatgaatattgatgcaaaaatcgtcaatgaaatactggcaaactgaatccagcagcacatcaaaaaacttatttaccacgatcaagttggcttcatccctgggatgcaaggctggttcaacatatgcaaataaataaacgtaacctatcacataaacagaaccaatgaaaaaaccacatgattatcacaatagatgcagaggaggcctttgataaaattcaacatcccctcatgttaaaaactctcaataaactaggtatttatggaacatatctcaaaataataagagctatttatgacaaacccacagccaatgtcatattgaatgggcaaaagctggaagtattccctttgaaaaccggtacaagacaaggatgccctctttcaccactactattcaacatagtactggaagttctggccggggcaatcaggcaagagaaagaaataaaggatattcaaataggaagagaggaagtcaaattgtctctgtttgcagatgacataattttatatttagaaaaccccgtcatctcagcccgaaaactccttaaactgataagtaagttcagcaaattctcaggatacaaaatcaatgtgcaaaaatcacaagcattcctttatacaaacaacagagaagcagacagccaaatcatgaatgaactcccattcacaattgctacaaagagaataaaatacctaggaatatagccaactagggatatgaaggacctcttcaaggagaactacaaaccactgctcaaggaaataagagaggagacaaacaaatggaaaaacattccatgctcatggtaagaagaatcaatatcgtgaaaatggccatactgcccaaagtagtttatagattcaatgctatttccattaaactatcattgaaattcttcacagaagtaggaaaaggtattttaaatttcatatggaatcaatgaagaccctgtatagtgatgacaatcctaagcaaaaagaacaaagctggaggcatcactctaccagacttcaaactatactacaaggctacagtaaccaaaacagcatggtactggtaccaaaacagacatatagaccaatggagcagaacagagacctcagaaataacaccacacatctacaaccatctgatcttcaacaaatttgataaaaacaagcaattgggaaaggatctcccattcagtaaatgttgctgagaaaactggctagccataggcagaaaactgaaagtggactccttccttacaccttatgcaaaaattaactcaagatggattaaagacttaaatgtaaaacccaaaaccataaaaaccctagaagaaaacctaggcaataccatttaggatataggcattggcaaagacttcatgacaaaaacgccaaaagcaattgcaacaaaagccagaattgacaaatgggatctaattaaactaatgagcttctgtacaacaaaagaaactatcatcagagtgaacaggcaacctacagaatgggagaaaatttttgcagtctacccatctgacaaaggtctaatatcctgaatttataaggaacttaaacaaatttacaagataaaaaccaccccatcaaaaagtgggcaaagaatatgaacagacacttctcaaaagaagacacttatgtggaccgggagtggtggcacatgcctgcaatcccagcactttgggaggccaaggcaggtggatcacaaggttaggagttcgagaccagcctggacaatatgataaaaccccatctctactaaaaatacaaaaattagtcaggcatggtggcatgcgcctgtagtcccagctactcgggaggctgaggcagaagaatcgcttgaacccacgaggtggaggttgcagtgagccaagatcgcgccactacactccagcctgggtgacagagtaagactgcatctaaaaaaaaaaaaaaaaaaaaaaaaaagacattcatgtggccaataaacgtatgaaaaaaagctcaacatcacatcagagaaatgcaaatcaaaaccacaatgaaataccatcttaagccagtcagtatggcgattattaaaaagtcaggaaacaatagatgctgtggaggctgtggacaaataggaacacttttacactgttggtgagaatgtaaattagttcaaccattgtggaagacagtgtggtgattcctcaagaatctagaaccagaaataccatttgacccagcaatcccattactgagtatgtacccaaaggaatataaatcattctactataaagacacatgcacacataggtttattgcagcactatttacaatagcaaagacatggaaccaacccaaatgccaatcaatgatagactggataaagaaaatgtggtacatatacctcatggaatactatgcagccataaaaacgaattagatcatgtcctttgcagttgcaagccatcatcctcagcaaactaacacaggaacagaaaaccaaatactgcatgttctcacttataagtgggagttgaacaattagaacacgtggacacagagagggaaacaacacacaccagggcctgttgtggggtaggggggtgaggggagggaacttaggggacgtgtcaataggtgcagctaaccaccatggcacatgcatgcctatgtaacaaacctgcacgttctgggcatgtattccatttttttcagagaaaattaataaataaatgttctcatcacacacacagacacagacacacacacacacacacacacacacacaataaatttaaaggagtttaattgagcaatgaacaatttgggaatcagccagcccctagaatcacagaagattcagacagactccaggggtgacttgtggtcgtaacaaatttatagacaacaaaggtaaagtgttgtacagaaatggaagtgaggtacagaaacagctggattggttacaggttggtgtttgccttatttgaacacagtttgaacactcaccagtgtatgagtggttgaagtatggctgctgggattggccaagactcagctattgttataggtgcatactcccaaattaggttttcaatcttgtctacctattaagttatgttgcagttcatccacaaagactcaaatatagaagtacagagtccttctcaggccatatttagttctctttaatggtgttacaaacaatccaattatactcttttagttattttaaaatatacaattaagttgttattgactgtaatcaccctgctgtgctatcaaataataggtcttattcattctttcgaactattttttgtacccattaaccatcaccatgttcccttccagccccccattagccttcctagcctagggtaaccatccttctactctctgtgtccatgagttcaattgttttgatttttagatcccacaagtaagtgagaacttgtaatgtttgtctttctgtgcttggcttatttcacttaacataatgatctccagttctatccatgttgttgcaaatgacaggatgtcattctttttatggctgaatagtactccattgtgtatatgtaccacattcctttatcccattcatctgtcaatggacatttaggttgcttccaaatcttggctattatgaatagtgccgcaacaaacatgggagtacagatacatctttgatatactgatttcctttcttttggctatgtacccagcaatgggattgctacatcatatggtagctctgtttttagttttttgagaaacctccaaactgttctccatagtagttgtactatttatattcccatcaacagtgtatgagggttcccctttctccacgtcctcgatagcacttgttattgcctgccttttaattagagagtttaattcatttttatttaaagtaattactgataagaaatgacttactgctaatgtcttgatatttgttttctatttgactggtatattttgtgttactaatttcctctattattaccttgttttgtgttcaattgactttttgcagtgtgccatttgattactttttctttctctttctttcttttctttctttcttctttttcagaagcttttgttgttttcttgaggattaccattaacctcttacatgtgtgacaacccattttgaattaatatcatcttagtaccctcttaaggtttcatatagggaacatctgctaagggtgaacattctcagcttttgtttatctgtgaatgatttactttgtgtttcattttaaaaggagtgttttgttggatatagagttcttggttgacagtttttttttcactttaaatatgtcataccactgcattctggccttcttggattctgctgagaatgtagctgttaattttattgatgatcctttgtacatgatgagttgcttctctgttgctacttttaagattatttctgtcttttgaaagttcaattagagtatgtcttgatgtgattctctttttgtttattctatgtgtcaagcttcttggaagtgtagattaatgtgttattttttaaaatgggaagtttttcaccattatttcttcaaacattctttttgtacatttctcactttttattctggaaatctcattatgtatatgttggtaggtttgatggtgtcccataagcctcttaagctcagttaatttttcttaattatcttttctttctgatcctcagattggataattcaattgacctatcttcaagtttactgattatttcttctccctgctcaaatctgtagttgagatcctccagtgaatttttaattttacaaattatgtttttcagcttcagaatttctgtttgttactttttataatttttaatctctttagtaatattctctatttgttctgtacatcattttcttgatattttttagttctttgagcatgtttaagtcagttggtttaaagtatttgtctagcaattccaatgtatttgcttcctttggtacagttttggttaatttattcagtgaatgggctatactttcttgtttctttgcattttttcataatttttggttaaaaattggacattttcagtagtataatgtggtaactatggaaatcagattcttctccctccttaagggttgttttgttgtttgctgtgggttgtaagttcttttttgtttagtggctttctaaactatctgtaaagactatatttttttcttgtgtagtctctgatgtctctttgcctttagcttatgttatgatagagattttcttgaatggctggagtcaataaaggaagaagaatggaaaaaatattttagtcttttaaaattggctctattggggactgtattagtccattctcacattgctataaagaactacctgagactggtaatttatgaagaaaatagatttaattgacttacagttctgcagactgtacaagaagcatggctggaaggcctcaggaaacttataatcatggtgaaaggtgtagaggaagcaagcatgttttaccatggcagagcaggagagagagagggctaagggggaagtgccacatacttttaaaccaacagatctcatgagaactccctatcacaagaacagaaagggggaaatctgcccctatgatccagtcacctcccaccaggccccctctctctacattgagaattacaattcaacatgagatttgggtggggatacagagccaaaccagatcagggacattccttcaatgcttagccagtttctttataactctgccttagtcttcactctatatttgtgctgagcctaatgataagcctcaggtgaatacttagggtcttctcaggtcttttctgagtgggagccctcccctggggatgcatgaatttctaaattccccagctggtacattaaattaaagcattttcaatgctttaattcttcaaggaatatttctttccagtttttttttttctcccaggcttttagtgcacccattctttaccttgactgcagtcttttgccctaggcaacagtgttttgttaatttgccttttaatatttttcaagaatatcctctgtatactctcttttcttccctgagagagttctgacttagatgaagcaaaggcaagtaccttgtgtgagttctttaggcagttgccctatagatcaaaacaaaaaaaaaaaaccccacaattatttgagaacataacctactgtctctctctggaataaggtactaaggtcctacactgggaccagaggaactgtcttcaagactgttgtcaagtcagagatgggacagtgcaagggcaagtaaaaacactgaaaagttcttctaccattttaaaattgcctttttcttgactcagcatttacttggtttctacaaaactctgactattttccagaattcctacaaaggtgattctgagcatgtttgctcatttcttggtatttctgtggaggaacaggcctttggagctaactgctttgccatttttgctgacatcacctttccacaatttgttttggattcctctagtatttattaaggacttgctatacgtcaggcaccatgttaaatgttttatgtttatttaaccctcatactaattatatgagggcaatattattatccgcatctttttcacaaaagaagaaaaacagggaagaattgtccaaggaaatactacagataggaagagatacacatgagcttgaactcagatctgtatgatttctagccccaggctcttaatcgctaggataaaccaatatattaagaaaggcaggcataataaaaagtgttaggtgacctaattctagacacaattttatgctaagggattaactgtaatttgtttatataaaagacagtttttattttctatctctcattcatgctttgcatctgaatggtgtaagtgagtgtgaagggtctcaatagaagtaagagaaagaactatatccaagataatccatcaatatacaggatgaataaacaaatgttgattactgttcatgctagcgtgtaatgtttttattaaaagatttaagctaggaggatggccaaagtaaatagaaaaggagtgaagggaggatgtgtggatacttgatacatgattatcctattcttgtgtgttgcagttgttcctgattattttgatggaagactattagggaactgtaagagttgcggatttagactccctgagttcaaattctgactctactttttgccatctctatggccttgggcaaattcactaatctgtctatgcttcagtttcctcactatgagatatggggataataatggtacccacttaatcgtatgcttcagaatcagataagctagtaaagtgaacagcattaagaactgtgtctggcacagagtaaccattttaaaacattggctattagtattatgataaaactaaatagaaaaaaaacacatttttttctcaataagattttaatggtcacacttcattatcacctccctttgttcacttacttatccttgtggacccttatggggcacatggcactttagaagcatctcttgttttgcatttgaccttgttagggtaactgtaactcaaaaaagacaaaagaaaattgaatggctttcctatcatgcttcttcctgacaacttcttcaattctccttcatttcaaagaggatgaaaatgtacagacaggcatttttttaataactgaaattgtacaaacatccctcatacttgtactgaaagttccattttcatttagcattttatttccttctgtgtaattttaagtttacaaaatctcagataacattaatctcaacaaaattttgttaatggtgttacttctggtactccaatatgatgaagctaaaatatgaatagatggaagtctttttatgaatttttatttgaaagtgtcttggggagcctatggacatgaggatttatattgtttttccactgtgatacatatgaaggatgatgttgatgagattaaaacagccctgtggactcatctaaaaattccttgtgtgtactaacagatggtaatcttcatatttcctcaagaagtcatttaggaatgccagcaaataagtgtgacattattatttttaaacagattttatattttagagcagttttaggttcacagcaaagttgagcagaaagtccagatatttaccatatatttacacataatatctttccccattatcaatatcccccaccaaggtggcacatttattgcaattgatgaacctaggttgatatatcattatcactctaagttcatggtttacattagggttccctctcagtgttgtacattctatgggtctgaaaaatgaataatgacatatgtccatcattatagtattatacatggtagttttattgccctaaaagtcctctgtgctctgccaaagtggcattattttaacaaataaatttgacctttttcctagtctcactataaaaagcaaatccttcaaacatgctgaaactttataattagtgatgatactgataagaaacctaagaagtgactctgcatcataatgggccccaagatcaagaaccagctaacttgccaaagtgcttcactttacaaaagaagagagtggtgatcagttgcccaaagtcacacagtggtgagcaactccagggacacttgactctgggcttagttattcagtccacagacacttattgagcttcttctgtgtttaaggcctcttgcccaacaaaatggtgaacaagactccacctacttcaaggattgggagaatagagagtggaatgggaacaactggtgagtaaagcatcaattatgtaacagtattaaggtgaaatacagaagttggtagaagcacagatcagggcaatcaaactggaatttgtagtaggtttgaggaaggctgcccagaagaggggatatctaaggtagacttgaagaatgaatgggagtcaagtcatatttggccaattgataattgacattaaggtaagactatgtccaaaattggcatcatagaagaaaaaatagccctttaacaatcctcctcttgtaaccttagccagagttagaacctttactgggtaatgataaataataatactcattggtttattgttgttaatttgtaagcatatctgtattagaacgtcatgtgattctttcagtgattccatgagtaaggaagagcaggtataatcaatatctcaaagaatgacctaaaataaatttggaagtaaataaagtgaaattacagtggatgtgacccttttgattttttctttgagatatgaaatagcctttgtttgctcaaacacatactgaccatcttgtggagtaaagtttggttcattagagaagtgaaaaatgccatatcagtcatgttagttgatgttcttcccatgaccagtttgtattctgattgaactacctcacccacagcctgtgaccctacatccacaggatgagcctatctttcctttggttgaaactaattgactaggattggatactttgatcgtgattctataaagcagggctatacagataagatttaattattggccccaactttttacccttctgtttgttagtctgtttgtgttgctataaaggaatacgtgaggctagatcatttataaagaaaggatgtttatttggcttatggttctgcagactgtacaggaagtgtggcaccagtatctgcttctgacggggacttcaggaagcttccagtcatgggagcatctgcttctggtgagggcttcatgaagcttcagggtaggggaatagctatcacatggtgagagtggagaaaaaagaaagagaaaggagatgcctggctctttttaataatcagatctcttggaaactaatggagtgagaactcactcattactgtgagaacaagaccaagccatttatgatggatccacccctgaccaaaatacctcccaccagactccacctccaacattggagatcaagtttcaacagagatttggagggaacaaatatccaaattatatcaccttcccttgcacccatattcttatggtctcattatgggcagaaagtactttctcactcaggactttggacttgctgcatgacttgtgctggctaatggcacgcaggtggaagtgccagccattctgagcctatgctttaagaggctttctgtgttccttctcatccacttgtgcctctgtcatctcacgataaaaacttctcttgaatagcttctgcccctgtagcctgagtcttagaataaactcatgtggagcagagctgccaagctaagtcaattaagtttagctgacaccagctgactcacagatccatcagaatcaatggttcatatcttgcccttgatgtttgcaactaacttgatggaagagcagtagatgttgtcctcttgacctgaaacctaaggtagactttgtggcttggactgccattttgggctacagatgagtatgtagaggaggtcagttttcagagaaagacaggaagtgaaatatacaagtgacagagacaatcatcttggcttctagctgttctctagatttagcttccacaaggcagggagctataagggtaggtagtggtctttggactgggtgacattctcaatctatgagaggactggctattgttggactgtcttgcaaaaactgggataccatgtggtttcttgaaattaggcagaattactagcagtaagactgaggaacaatgttaaagtatggtttctgcaaggttgtcttgaagctgagtcaccttaaaacaaggatagtttagatttttctcttggagagcaagatcagtccaaaagtctaggaagtggctgcacctacaggggatcaagtttccagagatgaataaaggagatgcaagaggcagctgttattttgtctgtacagttttctttcttgggtttacttaaaaatgttcctgtgagaaatatactgccttgcctaacttctcttttcagcttaaattataccatccccagccacactcagaagcggtcagtcttaataccatgtcactctgcctttcctctctcctcatcacaaagtaaattgaaccaagggagtacttctgcctgacccaaaggaaaccagtccatgtggcttctgtggggctcaacctggttacaggggtgtaaagatttggcaaacagactagctcatctgcttggctacagtgattggttcagtcttaatttagggccccagccaggacaatcatagtcctctctagggtttttcttccagaaggttgaggagagactattatttttactctgatggttgagctggcagcatttaagggaagagctgatagtggctattttgatgctatcagatgagaacctaaggattaattctggcagatgcaagaagtatggtgaagaagcaggaaggtgggagggaagaagggagagacagaggaaagagaatgagagggcactgaaaatagtgcctgaactcctggtatgcagccctgctaaagctaactctatcccctggttttgacaggtgctagtccaataaatgcccgcttctctttttcttaaactggtttgagttaggtttctatcacctctaacagacagtcttgaagaatccagaaggaccactggggtagagaggaggcagcccattgtggggactaggtcttctttattggcacagagctcagctccttaaaatacaagagagaaagcctgcatagattcctctgaaagcagaaagtaaattgtaaaatcatgaaggaaaccaaagcaaaacatatcaggcctaattcaatttacgttattaggtaaaggtttttataagacttttaagacttgctgtaatttcataatgtcagtggtaggtactgctcaaagtaaactgcatggattcaaatcccaccttcagtatttactaactgtgaatattaacctctctgaatagtagcctcatctctaaaatagggataaaagtagtgcctatctcatgcagttgttgcaagaaataaatgacttaatttatgcaaagcttttagaagagtgttcaagaaacacacaataagtgaaactgttattatgagctgtttttatttctcacatttgttaccttgatttgtaagagcgatggtgtatttgtgtaggctcaagaaggtgggatgatgaacaacacaggtgaacaaatccctaaggtttctgggaaagaggaagcaggtaaactataagtgaaccagaactcataaatatccctgggtgttcattctggcttaaggtatttgggaatcaggtatctataatgtacaggtaaagacattgaggactagagactgatgtgctccaggcccatcagaagttacaggcagagctgagacttgagcccagatcttgtgatcttaattgggccccctttccaggtcaccatagtgtgagcaatgtgaaggcagggactgtatttgttatcctgagggtttgaagaaatttaaatggaatgaataaatgaatgaatgaatgaatgaatccggtccaaaatgactcttctggtcactaatggtatttaacaaattactgcaacgttggtggcttaaaacaataaccattttattatgcccatggatttggggtgaggaattcatgaagagcccaagtaggcaattttcatttggtttctcatgcagttacagtcaaatgacgtcttgattcatttggatgttcaagattgcttagtcatgttactggcagttggataacggttgtttgctgtgagctcaactgaggcatctgaagcatctatacacggcctgttcatgttggacttcttacaggatggctcaggactccgagcaaaagtgttgcagtggcgaagtggaagctacctttccttttctgacctacccttagaagtcacataacattacttctactgtattctgttgggtacaagtgaattgcaagcttgcaagcagagaggacatagattgcaccactgaataggtagggtgtcaaagaatttagggccataaaaatgaaacttccacaatgaccttcattatatttgtaagttatatccatgtaaatagactctgcaagggtgagacttgatgctggtcctgtcccaggttacctgatattcctcagaacatgagtcacggaggtgccacctgttttgcttactggccatggctacacaccctctttctgctgctgcttatttgtatctcaagccaccagtaggatattattcttgcctctgtgtgacatgattcttactctttgcaccatgcccatatccattctcctgtttctctctttccctggaagtcaggctacaccctttgcagcagctcttcctgagtgaggctgtcacgagcccattttcccatcagaaaccactctgagagttccacttagctcagggcaatgcacaccactttggtgtcactcctgatttcactgcctacagttcaaaggttctctagattaagtccctttggtttagaaaaatatccttgctaaagtctctttaatggaggatgaactggtgaggtgtaggagtgatccgtgctactaacaaaaatgagacaaagtcctgaaaatgtttgcgcttttcctgcagaaacccttcctaggggacataagggtcaccaaacaatggtttctgaagatgatgctgctgattctgaatctagtaatttttccaggaaccacctagaaataaaacataaccctgaaacttttactgtagtaaaaattttaaagcaaatcaaaacacaaggaatacaatatgcagatcaatgcaatgaatctctatattgctatatttaatattttcatttttgaaggggtttggttcactgccaaaataatctgaaacgctagaatcccattagtcattaagaactaattaggtgggaagttgtcaatttgtaagctaatttggggcatataagagaaaaataaactgaattattttaagggaccacaagcatctctcacacttctaagtataattatgccacaaccagcatagataatgctgcccaaaatggaactttaagataagactaaacacaaccttttaagccctaaggaaaatatttatgaacagtctaaaagaataataatgctaatttataaggtaaattgggaaatgagagtcaaaggaatattatgttcaaactatatgttatggttagagtgtccctgaagcttagaagaaaaaaaaaaaatcatgaaattagaaagctagtcctaaggaattgaaaaatgcagtaattatcttggttgtggttaagggtacaggtaattcattttaagtaacaaacaaacaaactgtattttacttcctgaaatctcacagaaaagcaatttcagtaagatgaaaaacaccaaattgaaaaaatggttgatttggctttcttcgtcacctcacggaccaaatcaaagagactgtagaactaattgccccaattgtgaaaaaatgaactagccaagagaaatgagtcctcccgaagcaaattcagaaacaaactaaaattggtgtatatttttcttaattctttttcatttgagaacaaagaacctatattgctcagattaaaaaaaaaaaacagagcaaattcaggggtcatagagtcctgccaaagcaaattcagaaactaaaattggtgtatatttttcttaattctatttcatttgaaaacaaagaacctatattgctcagattaaaaaaaaagaagcagagagaattcaggagtcataactgaactgaaggtttgatagaatcagggtgggtcattgaagatggtatacctgggataagatacttggaagtctgtgttgggtgtgtccttttgtctctgacagaacaacatgcagtatgcttcatggtgggaaggcctgtagctttcctaactcttgctggctgccttgtgttagcaaataattaagagtcattactataagatgtgacactgttattaagaatttcagaagttagagacttcccataaatgtcaaagggagaaaaacttaccattgggtagtgacaattctggtcctttttggaagatataatatgttcaagaggttatagatgctgcttcacatgaacttaaattgatccatttgccagttgaggcacgtgttaaaagaggccatgcaaaaggttggctgtggaggatcaggcctatactgcttgttcaacgctgtggggctgacccctgaagattccccttgcctgctcctgctccctctctgacagcccgagtggaggggctgagctgtgtggtatggtaattctgggctccttgggacctcttaagaacctaaagcaagttaaagagagcctccccagaacccgtgtccttttagggaccaagcagagtatgtcccatggcattttgagtgttttgtttttgcctctaatttattttaagaatctgtttacacaggaagttctcttaaataactgacatccagctaacaagaatacttgcttatagaaatggcagctagctcatcttgttctacttgttttaggctctctttctccagtaaaatatcttgaagcttatttttggagaatttgaagtttaattttggagtatttgtgggctcacaggtaaaggaaggaaggaagctggaaaagaggttatattctaaggcaggaatgagtagtacttctctcctaccatctttctctcctgctgctcatttttactttttttgtccaactttgaagttgacaggtaaacatttggggagcacagatagtattgatttcgaactcaaacttctctggactctagttatatagctctaactcctataccatacctctatttggacagatcaaaggcacctcaaatgccacacttccaatgcaaaaatcatagtttatttctcccccaacagccactcttactgctcttcctactgaactttcatacagcaaccaaagtcagcctttaaatatgtaaattgctgatttctttgagcagtgttttctaattctgattgtagagatcttttagctccctagttagctgtattcctaggtattttattctttttgtggcaattgtgaatgggattgcattcctgatttgactttcggcttgactgttgttggtgtttaggaatgctagtgatttttgtacattgattttctatccttagactttgctaaagttgtttatcagctgaaggagtttttgggacaagactatggggttttctagatatagcgtcatgtcatctgcaaacagggataatttgacttcctctcttccgatctgaatgttctttctttctttatcttgcctgattgctctggccaggacttccaatactatgttgaataggagtggtgtgagagggcatccttatcttgtgctgattttcaaagggaatgcttccaactttttctcattcagtatgatgttggctgtgggtttgtcacaggtggctctcattatgttgaggtatattcgttcagtacctagtttattgacagtttttaacatgacggttgttgcattttattgaaagccttttctgcaaataccgttcgacccggcaattccttactgggcatatacccagaggaatataaatcattctttcataatgacacaggcacatatatgtttattgcagcactattcacaatagcaaagacatggaatcagcctaaatgcccatcaatggtacaatgaataaagaaaatgtggtacatatataccatggaatactatgtagccataaaaaaaacaagatcctgtcctttacaggaatatggatggagctggaggccattatccttagcaaactaacacagtgacagaaaaccaaataccggacgttctcacttataagtgagggctaaatgatgagagcacatggacatattgaggggaacaacacacactgcagcctacctgagggtggaggttaggaggagggagggaaccaggaaaaatgattgatgcgtactaggcttaatacctgggtgatgaaataatctgtacaacaaagccccatgacacaagtgtacctatgtaacaaacctgcacattaccccaaacttaaaataaaagttcaaaaataaaatcaaaagagggaaaaatatatgtaaatcagagcatgtccttggtctgcctaaaacccttggatggctttcaatggctctaagaataaagatccaaatctattttaaaaagtctcttggccgggtgtggtggctcatgcctataatcatcccagcactttgagaggccgaggtgggtggatcacttgaggtcaggagtttgagaccagcctggccaacatggtgaaaccccatctctactaaatatacaaaaattagccagctgtgaatctgtctgatcctgggtttttttttggttgataggtgtattagtcagggttctctagagggacagaactaatggaatatatagatattatatatagatatatattatatattttatataatatatatataggtccagacagattcacagctgaattctaccagatgtacgaagaagagctggtaccattcctactgaaactattccaacaaattgaaaaggagggactgcttcctaactcattctatgatgccagcatcatcctgatacaaaaacctggcagagacacaacagaaaagaaagcttcaggccaatatccttcaggctaatatccttgatgaacatcgatgcaaaagtcctcaacaaaatactgggaaactgaatccagccgaacatcaaaaagcttatacaccatgaacaagtaggcttcacccccaggatgcaaggatggttcaacgtacacaaatcaataaatatgattcatcacagaagcggaactaaagacaaagccctatgattatctcaatagatgcagaaaaggctttcaataaaattcaacattccttcatgttaaaaactctcaataaactaggcattaaaggaacatacctcaaaataataaaagctacatatgacaaacccacagccaatatcatactgaatggccaaaagctggaagcattctctttgaaacctggcacaagacaacgatgttttctctcaccgctcctattcgacatatagtattgaaatttctggccagggcaatcaggaaaaaagaaataaaggacattcaaataggaagagaggaagttaaactatttttgtttgcagacaacataatactatatctagaaaaccccattgtatcagcctaaaagcttttaaatctgaaaaacaacttcagcaaagtctcagaatacaaaactattgtacaaaatctgctagcatacctatacaccaacaacagtcaagcagatagccaaatcgggaatgcattcccattcacaattgccataaaaagaataaaatacctaggaatacagctaacaagggaggtgaaagatctctacatggtgaaccactgctcaaagaaatcagagatgacacaaagaaatggacaaacattttatactcatggatagaaagaatcaatgtctgtaaaatgaccatactgcccaaagcaatttatagattcaatgctgttttcattaaactaccattgatattcttcacagaactagagaaaataattttataattcatatggaaccaaaaaagagcctgaataaccaaggcaatcctaagcaaaaagaacaaagctggaggcatcacactatccgacttcaaactatcctacatgactacagtaaccaaagcagtatggtactggtacaaaagcagacaaatagaccaatggagcagaatacaaagcccaggaataagaccacacacctacaaccatctgatcttcaacacacctgacaaaaataagcaatggggaaaggaatccctattcaataaatgatgctgggataactggctagccatatgcagaaaattgaaactagaccctttccttacaccatgtacaaaaataaacttaaatgtaaaacacaaaactataaaaaccctggaagacaacctaggcaataccatctggatatagaaacgggcaaaaatttcaagtcaaagacgtcaaaagcagctgcaacaaaagcaaagacctatagacagaaataccaaaaagcaaaaattgacaaatgggatccaattaaacagcttctgcacagcaaaagaaactatcaacagattgaacagactacatagaatgggataaaatttttgcaaactatgcatctgacaaaggcctaatatccagtatctataggaaacttaaacaaatttacaagaaaaaaacaaacagccccattgaagagtgggcaaagaacatgaacagacacttttcaaaagaagacatagatgtggccaacaagcatatgaaaagaaactcaacatcactgatcattagatacatgcaaatcaaaaccacagtgagataccatctcacaccaatcagaatggctattaataaaaagtcaaaagataacaaatgttggcaaaattgtggagaaaaaggaatgcttatacactgttagtggagtgtaaagtagttcaaccattgtggaaaacagtgtggtgattcctcaaagacctatagacagaaataccattcaacccagcaattccattactggatatatacccaaagttatgtaagtctttctgttataaggacacatgcacattattcacagcagcaaagacatagaatcaacctaaatgccatcaatggtagactggataaagaaaatgtgtatatatacaccatggaatactatgcagctgtaaacaataatgagctcatgtcctttgcagggatatggatagagctgatgaccattatccttagaaatctaacgccagagcagaaaaccaaatactgcatgttctcacttataagtgagctaaacgatgagaactcatggacacatagaggggaacaatgcacactggggcctctcagagcgtggaaggtgggaggagggagaggatcaggaaaaataactaatggacaccaggcttaatacctgggtaatgaaataatctgtataacaaacccccatgatacacatttacctaagtaaaaaacttgcatatcctgcacacctctgaacttaaaagtttaaaaaaagattgttacttatgagtttaatgccatacatacagtaagcactaagcaaaacactcaatatcgaacacttagttccttgtagttggcaaagcattttctcatgcactaactcattgatcctcataataatcctgtaaggtaaatattattaactccaactttacaagttaggaagtagattttcatattgttaatgggctaaaggatggtgtggaattgggggttgatatgtggaaaccccaataggaagcaatgagaggctggcaaactgaactagctgcagagtatggcctcaacaagaaacctgagcaggttgatctcaggggctgacaggaagatcaagtttgggctttagccaatattcagaatcaagggagagactgctccagcagatagatcacaatgaagaaggacactgagctattctgtaatattcagcagagaatcccaggcaggaactcagtgccatggactggttcaacacaggaaacagagaaatgtccattggtgctgtcaattctagttaccacccatgggaatgctgaggttcctgttatgtatcctgcctttgtcccattgactggcctgtgtgtgggtactttcagtagtagggacagggataatgagagcaagaggcattaggcaggggtgaacctgggggagcaattctttgtctttttacttcataacctatgcaatttctactgtacctcactggctgccatggataagagaagaaaattaaggagaggcaaagagacaaaagtcaaatgaccaattggtgtgtggaaagatgggtatattaactagaattaacggtaacttgtgaagaaagaaagaaagatgagtgtaatcaataatggcttcacagtgcaaatgagtttttaacttattctcaaaggaaacagatcatgtagcctgacatttgctgtgacccttaatacagttaaatgacaacattaattgtcctgaagcccagttatatattttatcatcttctccaaggaaatcagtttggtctactttcttccaatcttctcctcgtagtatctattcttaattccaaagactgagtgaaggaaatgatcctgccttccatttctcatggatataagaactgtttagagctgcgtttttcagtatggtagccattagttacatttggctattgagtgcttgaaatctggatactcttaattgagatgtgcactaaatgtaaaatttgcactgggtttgaagacttgaggtgaaaaaaatgtaaaatctcattaataagttttatgttgatggcattttgagataactattttggatatattggattaaataaaaatattaaaattaatcccaccttttttcttaatttttaaaatgtggctacaataaaatttaaaatcacatatgtgattcacattatatttctattggacagtgcttttttagagagaagtgccagattcctaaaggattgctccctttcagactttgccaaatgattctctcccctctaggccagttttaacaagtcaaataatacagatttcataattggaaggaaggctgcaagtcatttggaaattacgtgatgaagctgcaatgggatcataactcctgcatgacaatttgcttttctgagcctttcttattccaaatggaaaagtcactgctctgttctctcttctagctaatttacatcttattttctttctgtcagaagtgtcatttcctgtgattgatgaaaccatctttgctaagtgcaaaaacaaggccaccacgttattaaaactggattcactacaaatattttcatcctgtggattgggaagaattcatatagttgcttggaaacccttttaaaaattgcaatgtttagttactttcagaaatttgaagtcaggattacaggagcaaaaaatatcactacctttacaaatatgaaaaaaaggagacattatctggcagaatgattttcctttaatcctaaatcatagctatacattgcctctgaattggccatttttttgattcaagggttttagggccatcttaatgttgggcttctgtacagttaattagattgacaatgcaatggattttattcacttagaaaataattgatttggtctttagagatgattttttgcaattctgcagtcttcgttttatgaacacagctgagtctgtaacagcaatgtcggaactttataatgattacttcaaaataaggaagacatgttaaacaaaaggaaacagaccctttctctttaagaggcaactgggacaaattgcacagttgtatttactcccatgatgcctttttcctgttttgctttagtttctttgtcttttaattttattttgtataatcttacattacataaaatacgtattttatatatttattaaaatatctgcaactcagacttgtttactgttgttttttgtattatcattttaagttacagatagtaaaatttacttttaaattgtaacaaatgtataaatttttgtaaccatcactaacaggatatagaacaattctggcactctccagaattcccacttgctacctctttgcaattagacattctccctacccttgatccttggcaaccactgatctcttctctgtccctaaaaattttgctcttaaagaatgccatatgaatggaatcatatagtatgtaactttttgagactggtttcttttacttagcatgatgggtttgagattgattcatgttattgcatctgttattttgatttttgactaccatagtatgtttatgcattcagttattgagggacatttgggttgtttctgtatttttctgactgaaaataatgctgatgtaaatgttcatatccaggtttttacatgaaaataagtttcatatctctagggtgaatacctagtaataggattgctgggtcatgtggtaagtgtatatttatatttttaagtcgatgtttaaatttataaaaaaattatgccaatgttttccagaatggttgtaccattttgcatcaccaccagcaatatatgagtttcagttgttctgcagcctcactggcactaggtattgttggtagtttttttaaagccattttaatagggatgtaatggtatctcatggtggttttaatttgcatacccttaatgacttatgaagttgagcatcttttcatgtgattatttgccattatatattttctttgatgaaatatctattcaaatattttgtccagttttaaatattacattattttattattatagagctttacataagtcttttgttggatatgtaactttcaactatttctcccagtctgtggtttgtcttttcactttacagtgtccttcaaagagcaaaacttttaaatttaaaagatgtacacttcaatttcttcttttatggattgtgcttttggtgttatgtctaagaaatctttacctaacctaaggtcacagagagttttcctatattttcttctaggagtttagaaaattgacccatttttgtttttggtatacaatgtgaggtataggtcaaggtttatttttttcatatggatgtccagtggttccagcatcatttgttgaagactgtcctttctctattaaattgcctttacatctttgtcaaaaaatcaattgaacatgtttacatggctctgttttggaactcaccattttttccattcgtctatatatctatccttaagccaatactgccctgccttgatttctataggtttaaagtatatcttaatattggggagtgtgtccttcagctttgtttttcttcttcaaaaatgctttggttatttcactttccataaaatgtttagaatcagcttgtcaatatgtacaaaaaattttggaattttcattgggattgcttaaaatatatacatcgagttgcggtgatttgacattttaactatattgagtctgcgaatagcatgatcatgatatatctttccatttatttacatctttgaattctttcattagtaatttgtagttttcacatacagattctataccatttaaatatatttatacttaagtatttcatatatttcaatgctattgtaaatggtgtttttctttaaattttaaattccaactgttcattattgatatatggaaaatttttaatgtcaactttttatcctgcgaccttgctatacttgcttattacttccaggagtttttttttctttttgtataggctttgggattttatacatagataatcatgtcacatgcaaaaatatttttgtttcttccttttaatctatacacatttatttcttattcttgtcttattgtgctacctaggactcccagtacatgtagaataggagtgatgagagaggatgtttttgccttgttcccaaccttggaagaaggcacccatacttaagtccagtcttaagcataatggaagctatggatttgttgtagatgttctttatcaagttgagaaattttccctgttttcagttttccaagagttttaatcacacgtgttagatttgtcaaatgctttttctgcatctattgatatgattatgtgatttccttctttagcctgctgatgtgatcgatgttgattaattttcaaatgttgaaccagccttgcataactggaaaaaatctcacttggttgtggtatataaatttttaaatacattgttggattcagtttgctaatattttcttgtggagttttgtgtctatgttcatgagagatactggtctgtagctcttttttcttgtgatgtctttatttgattttggtattagcgtaatgctggacttatagaatgtattaggaagtattctctctgcttctagttttctagaagagattgtagagaactggtatcatttcttccctaaatatttggtagattttaccagtggaactatctgagcctggtgttttcttttagaagattcttaattgttgatcccatttctttaataggattgttgttgaataatatatatttcttcttgtgtgagttttgatagtttatctttcaaggagttggtccatttcatctaagttatcaagtatgtgggcaaagagttgtcatagtactcctttattgtgcttttaagttccatgtgaaatcagtaataatggctcagctttcctttctgatatttgtaatctatgtctttgctctttccccctaaccttggttaaactggctagaggcttatcaatttcattgaccttcttaaagaaccagcttttggttttgttgattttctctattaatttcctgtttttaatttcatcgatttctgttctaatttttattattatttttttctatttgctttagtcctacgtggttgttcattttttttattttttattttgtaaatttattttactttaggttccaggatacatatgcagaacgtgcaggtttgttacctaggtatatgtgtgtcatggtggtttgccgcacctattgatctgtcctctaagttccctcactctccctcccctctcccttcaccccacaacaggtcctggtgtgtgttgttcccctcgctgtgtccacgtgttctcattgttcaactcccacttatgagtgagaatgtgcagtgtttttggttttctgtttctgtgttaatttgctgaggatgatggcttctagcttcatccatgtccctgcaaaggacacgatctaattcctttttatgactgtgtagtattccatggtgtatatgtaccacattttcttttctttttctttttttttttttttttttttttttttgagacggagtctcactctgtcgcccaggctggagtgcagtggcgcgatctcgcagcattgcaagctccgcctcccgggttcacgccattcacctgcctcagcctcccgagtagctgggactacaggcacccgccactacgcctggctaattttttttgtattttgagtagagacggggtttcaccgtgttagccaggatggtctcaatctcctgacctcgtgatccgcccaccttggcctcccaatgtgctgggattacaggcatgagccaccgtgcctggccaccacattttctttatccagtctatccttgatgggcatttgagttggttccatgactttgctattgaaaatagtgttgtaataaacatatgtgcgcatgtgtctttatagtagaatgatttatagtcctttgggtatatacccagtaataggattgctgggtcaaatggtatttctggttctagatccttgaggaattgccatgctgtcttccacaatggttgatctaatttacattcccaccaacagtgtaaaagtgttcctatttctccacagcttcaccagcagctgtcgtttctttactttttaataatcgccattctgactggtgtgaaatgatgtctcattgtggttttgatttgcatttctctagtgatcagtgatgttgagctttttaaaatatgggtttttttttgccacgcaaatatattctttcaagaagtgtctgttcatatcttttttattattattatactttaaattctgggatacatgtgcagaacgtgcaggtttgtaacataggtatacatgtgccttgctgatttgctgcacccatcaacccatcatctacattaggtatttctcctaatgctatccctctagccccccaccccctgacaggctccggtttgtgatgttcccctcactgtgtccacgtgttctcattgttcaactcccacttatgagtgagaatatgtggtgtttggttttccgttcctgtgttagtttgctgagaatgatggtttccagcttcatccatgtccctgcaaaggacatgaattcatccttttttatggctgcatagtattccatggtgtatatgtgccacattttctttatccagtctatcactgttgggcatttgggttggttccaagtctttgctattgtgaatagtgctgcaataaagatacgtgtacatgtgtctttatagtagaatgatttacaatcctttgggtatatacccagtaatgggattgctgggtcaagtgatatttctagttctagatccttgaggaatcgccacactgtcttccacaatggttgaactaatttacacttccaccaacagtgtaaaagtgctcctatttctccacatcctctccaccatcggttgtttcctgactttttaatgatcaccattctaattggcatgagatggtgtctcattgtggctttgatttgcatttctctaatgaccagtgatgatgagctttttttcatatctttgctggccacataaatatcttcttttgagaagtgtctgttcatatccttcatccatttttgatggggctgtttgttttttttcttgtaaatttgtttaagttccttgtaattctggatatcagccctttgtcagatggatagattgcaaagcttttctcccattatgtaggttgcctgttcactgtgatgatagtttcttttgctgtgcagaagctctttagtttaattagatcccatttgtcaattttggcttttgttgccattgcttttggtgttttagtcatgaagttttttgcccatgtctgtgtcctaaatggtattgcctaggttttcttctatggtttttatggttttaggtcttacatttaagtctttaatccatcttgagttaatttttgtatcaggtgtaaggaacgggtctagtttcagttttctgcatatggctagccagttttcccaacactatttactaaatagggaaccctttccccattgcttgtttttgtcaggtttgtcaaagatcagatggttgtagatgtgtggtgttatttctgaggcctctgttctttccattggtctatatatctgttttggtaccagtaccatgctgttttggttactgtagccatatagtatagtttgaagtcaggtagcatgatgcctttagctttgttctttttgcttaggatcgtcttggctatgtgggctcttttttggttccatgtgaaatttaaagtagttttttctaattatgcaaagaaagtaaatggtagcttggtggggatagtgttgaatctataaattactttgggcagtatagccacttttgcgatattgattcttcttatccatgagcatggaatgtttttccatttgtttgtttcctcgcttatttccttgagcagtggtttgtagttctccttgaagaggtccttcacaccccttgtaagttggatttctaggtattttattatctttgtagcaattatgaatgggagtttactcacgatttggctctgtttgtctattattggtgtataggaatgcttgtgatttttgcacatggatttcatatcccgagactttgctgaagttgcttatcagcttaaggagattttgggctgagatgatggggttttctaaatatgcaatcaagtcatctgcaaacagagacaattttacttccactcttcctatttgaataccctttatttctttctcttgactgattgccctggccagaactttcaattctatattgaataggagtggtgagagaggacatccttgtcttgtaccggtttttaaagggaatgcttccagcttttgcccattcagtatgatattggctatgggtttgtcataaatagctcttattattttgagataacgttctatcaataactagttattgagagtttttagcataaagttgtgttgaattttatcaaaggacttttctgcatctattgggataatcatgtggtttttgtgattggttctgtttatgtgatggagtacgtttattgatttccatatgttgcaccagccttgcatcccagggatgaagccaacttgatcatggtgtgtaagctttttgatgtgctgctggattcagtttgccagtgttttattgagggttttcacatcaatgttcatcaggaatattggcctgtaattttcttttcttgtgtctatgccaggttttgctatcaggatgatgctggcctcattaaatgagttagggaggagtccttctttttctgtcgtttggaatagtttcagaaggaatggtaccatctcctctttctacctgtggtagaattcagctgtgaatccatctggtgctgggctgtttttggttggtaggctgttaactactgcctcaatttcagaacttgttattggcctattcagggattcgatttcttcctggtttagtcttgtgagcgtgtatgtgtccaggaattaatcaatttcttttagattttctagtttatttgcataaaggtgtttattgtattctctgatggtaatttgtatttttaagggatcagtggtgatatcccctttatcattttttattatgtctatttgattcttctctctttttttctttattagtctttctttctcttgactgattgccctgggcagaacttctgatactacgttgaataggagtggtgagagagggcatctttgtcttgtgccaggtttctaagggaatgcttccagcttttgcccattcagtatgatattggctgtgggtttgtcataaatggctcttattattttgagatgcattccatcaatacctagtttattgagagtttttagcatgaaggggtattgaatttgtcaaaggccttttctgcatctattgtgataatcatggggtttttgtcattggttctgtttatgtgatggattacgtttatttatttgcatatgttgaaccagccttgcatcccagggatgatcgtcatggataaactatttgatgtgctactggattagatttgctagtattttattaaggatttttacaccaatgttcatcagggatattggcctaaaattttcaattttttgttatgtctccaccaggttttggtatcaggatgatactggcctcataaagtgagttaaggaggagtttctctttttctattgcttggaacagttttagaaaaaacggtaccagctcctctttgtacctctggtagaattcagctgtgaatccctctggtcctaagctttttttggttggtagcctattaattactgcctcaatttcagaacttgttattgttctattcagggattcgagttcttcctggtttattcttgggagggtgtatgtgtccaggaatttatccatttcttccagattttctagtttatttgcatagaggtgtttacagtattctctgatggtagtacgcattactttgggatcagtagttatctcccctttatcatttttttattgtgtctatttccttcttctctcttttcttctttattagtctagctagtggtctatctattttgttgatcttttcaaaaaagccaactcctggattcactgattttttgaagggtttttcgtgtctctatctccttcagttctgctctgatcttagttatttcttgtcttctgctagcttctgaatttgtttgctcttgcttctctagttcttttaattgtgatattagaatgttgattttaaatatttccttctttctcctgtgggcatttagtgctgtaaatttccctctaaacagtgctttagctgtgtcccagagattctggtacattgtgtctttgttctcattggttttgaataaattgtttatttctgccttaattttgttatttacccagtagtcacttaggagcaggttgttcagtttccacgtagttgtgtggttttgagtgagtttctaaatcctgagttctaatttgattgcaccgtggtctgagagagtgttttttatgatttctgttcttttgcatttgctgaggagtgttttacttccaattttgtgggtgattttagaataagtgtgatgtggtgctgagaaggatgtatattctgtttatttgaggtggagagttctgtagatgtctattaggtccccttggtccagagctgagttcaagtcctgcatatccttttttaattttctgtctcgttgatctgtctaatattgacagtggggtattaaagtctcccactattattgtgtgggagtctaagtctctctgtaggtctctaagaacttgctttatgaatctgggtgctcctgtattgggtgcgtatatatttaggatagttagctcttcttgttgcattgatccctttaccattatgtaactgccttctttgtcttttttgatctttgttggtttaaagtctgttttatcagagactaggattgcaacccctgctttttttttttttttttgctttccattttcttggtaaatattcctccgtccctttaatttgagcctacgtgtgtctttgcacgtgagacgggtctcctgaatacagcacactgatgggtcttgactctttatctaatttgccagtctgtgtcttttaattggggcttttgtcccatttatatttaaggttaatattgttatatgtgaaattgatcctgtcattatgttgctagttggttagtttgcccattagttgatgcaatttcttcatagtgtcgctggtctttgcattttggtttggttttgcaatggctggtactgatttttccttaccatatttagtgcttccttcaggagctcttgtaaggcaagccaggtgagaaaatctctcagcatttgcttgtctgtaaaggattttttttcacctttgcttatgaaacttagtttggctggatatgaaattctgggttgaaaattcttttcttcaagtatgttgaatattggcccccgctctcttctggtttgtagggtttctgcagagatctgctgttagtctgatgggcttccctttgtgggtaacccgcctttctctctggctgcccttaacattttttccttcatttcaactttggtgaatctgacaattatgtgtcttgaggttgctcttcttaaggagtatctttgtggtgttctctgcattttctgaattttaacgttggcctgtcttgctaggttggggaagttctcctggataatatcttgaagagtgttttccaacttgattccattctccccatcactttcaggtacaccaatcaaatgtaggtttggtcttttcacatagtcccatatttcttggaggctttgttctttccttttcattcttttttctctattcttgtcttcatgctttatttcattaagttgatctttaatctctgatatccttttttctgcttaattgattcgacgattgttacttgtgtatgcttcccgaagttctcatactgtgtttttcagctccattaggtcatttatgcttttctctaaactggttattctagttagcaactcctctaaccatttttcaaggttcttagcttccttgcattgagctagaacatgctcctttagctcggaggagtttgttattacccaccttctgaagcctacttctgtcaatttgtcaaactcattctctgtccagttttgttctcttgctggtgaggagttgtgatcctttggaggagaagaggctttctggtttttggaattttcggcttttttgtgctgatttttcctcatcttcatggatttatctacctttggtctttgatgttggtgaccttcagttgggttttctgtgtggacatcctttttgttgatgttgatgctatttctttctgtttgttagtgttccttctaacaggcaggcccctctgctgcaggtctgctgaagtttgctgcaggtccactccagaccctgtttgcctgggtatcaccagcggaggctgcagaacagcgaagattgctgcctgttccttcttctggaagcttcagcccagaggggtactctccagatgccagccagagctctcctgtatgaggtgtctgtcaaaccctgctgggaggtatctcccagtcaggatacacgggggtcagggacccacttgaggaggcagtctgtcccttaggagagcttcagtgctgtgcttggagatctgctgctctcttcagagccagcaggcaggaacttttaagtctgctgaagctgcccccacagctgccccttcccccaggtgctctatcccagggagatgggggttttatctataagcccctgactgtggctgctgcctttctttcagagatgccctgcccagagaggaggaatccagagaggcagcctggctacagtggctttgctgagctgcagtgggctccacccagttcaaactccaggtggttttgtttacactgtgaggggaaaactgcctactcaaacctcagtaatggcaaatgcccctccccccaccatgctcgagtgtcccaggttgacttcagactgctgtgctggcagcgagaatttcaatgcaggggatcttagcttgctgggctccatgggggtgggatctgctgagctagaccacttggctccctggtttcagccccctttccaggggagtgaacggttctgtctggctggcattccaggcaccactggggtatgaaaaaaaactcctgcagctagctcggtgtctgcccaaatggccacctagttttgtacttgaaacccagggccctgattatgtaggcaccagagggaatctcctggtctgcaggttgcaaagaccatgggaaaagtgtagtatctgtgctggaatgcatcgttcccaatggcacagtccttcacagcttcccttagctaggggagggagtttcctgaccccttgaaattcccaggtgaggtgatgccccaccctgcttcagctcaccctccatgcgctgcacccactgtctaaccagtcccagtgagatgagccacatacctcagttggaaatgcacaaatcacctgccttctgcattgatctcagtgggagctgcagactggaactgttcctattcaaccatcttgccagccacccccgtcaagatatgtttctctgttcatatcttttgcaaactttttgattgtgttgtttgtttttttcttctaaatttaagttccttgtaaattctggatattaggcatttgtcaggtgggtagattgcaaaactgtatagccaagacaatcctaagcaaaaagagcaaagctggaggcatcatgctacctaacttcaagctatactacaagactacagtaactgaaacagcatgatactggtaccaaaacagacatatagaccaatggaacagaacagagacctcagaaataacaccatacatctacagcaatctgatcttcaacaaacctgaaaaaaacaagcaatggagaaagtatctcctattcaatagattatgctgggaaaactggctagccatatgcagaaaattgaaattagaccccttccttacaccttataataaaattaactcaagatggattaaagacttaaatttaaaaccccaaaccataaaaaccctagaagaatacctaggcaataccattcaggacataagcatgggcaaaaacttcatgacaaaaatgccaaaagcaattgcaacaaaacaaaagttgacaaatggaatctaattaaactaaagagcttctgcacagcaaaagaaactataatcagagtgaacaagctgtttattctttagtttgctgaggtggattcttaggttacttactttacatctttattctatatacatacacacatactatatatacttatatatacatatatatagtaactttttcctctacacactgtttttgctgtatcctacaaattttgataagttgtatttttatttttatttagttccacatgcagatcctgaatgtattttgttagaattgtacataaatatttcattggggggctactatgaatagtattattcttaaattttggattcctattgtttattgtggatgtatagaatttgtatctgtgcccttgccaaagtcacttattagttctatgtgcttttcttagattacttgggattttctacataagtcatctgggtatattaatagctttatttatcccttcctaatctatataccattcatttcttttcttgattcattgtacttgctagtacttccaatacgatactgaataggagtggtgagagtggtcctccttgccttgatcccaatcatagggagaaagcatgcaggttttcaccattaagtatgatgtcagctgtaaggtttttgtagatgccttttatcatattgagaaagttttcttctatttcttgtttgctgagagtttttatcttgaatgaatgttgaaattgtcaagtgattttctgcatcttttgatataaccatgcatttttttctcctttagactgttaatacaatgaattacattgattgattttccaatgtttatccattcttgcattcctggagagaaaccccacttggtgatgatgtattgttcttgtaatatattgctgggttaaattgctaagtgttttttttttttttttttgaagatttttgcacctatgttcatgagggatattggtctataattgtcttttcttgtatggtcattgctggttgtggtatcagagtaatggtggctcaagtcagttgtgacatgtcccctcctcttcttagatgcttaatagaattctacagtgaaatcacctgggccaggagttttatttttcagaataattttgattatgaaattaatttctttagtagatataagattattgaggttatttattttatcttgtgtacattttggtaggttatatctttcaagcaattggtccattttatctaacttgtcatatttgtgtgcatagaattgtttttaatattccttcgttgccctttaatgtctcagtctatagtcatatctcctctttcattcttgttatccattgtaagtgccttctctcttttacttgatcatcaagctagaggtttattaattttattgcatttttttcatagaatcagcttttagtttaattgattttctctgttgttttgttgttctcaatgttattaatttatttttctttattatttccttttgtctttgctttagttttagtgtcttctttttctggtttcttaagatggaagcttaagttattgattaagcttacttcttttctagtataagcatgtaatgctattaatttttttctaagtgccttttggggcacatttcacatattttgatatttatttctatttttattcagttcaaaatactttctaatttctcttcagagtgcctctttgcgccatggattaaatggtagtgtgtagtttaatttccaaatctggagattttccaaaaatccttggttatcaatttttagtttaattatattatagtcagagaatatattttagataattcaattcttctaagtttaacaaatttgttctatggcccaggatatggtctgttttggtgaatatttccatgtgctcttgaaaaaaatgtgtattctgtagttgttgggtagaatgttatataaagatcaactagaactactagttcatcaaccaactactttgttgatgatgttgctcaggtttctatagccttgctgcttttctatttgttttatcagttacttcaagagacaacttgaaatgcataaaaataattatggatttgtttatttctccttttaattctgtccatctatgctttacttattttgaagctctgttgtcaattgcatacacatttaaaattgtcatgtcttcttgaggaactgacctttttatcatcatgtggtgtccctttttgtctgtggttattttccttttcctgaagtttactttgtctgatattaaatacacacaccagcttttttcttctcgttagtgtttgcatgttatatctttttctcataatttcatttttaacccatgtatatcattatgtcttgagtaaaattcctgtagacagcatacagttggttactgtgtacgtgtgtgtgtgtgtgtttaaaaatccaatctaattatcactcccttttaattgttttgtttaaactattttcatttaatgtaattactgatatggttgcattttggtgcagcattttatcattaatttctgttctctgtattttattaccttggttttctttttttgtgtttttttgagttacttacttttgagaatcctattttaatttctctattgcatttttgactatatccctttgaattgttgttttcagtgactgttgtaggaaatgcgatatacacatcaaactttatacaatctagttagcatcaatatcttaccatttcacataaaaataaggaataagtatacatatataatcattttactcttcttccttttacaaaattttcatatgtattccatttacttattgaaaatcccatcatacagcattatgctttttgctttcaacaaaaatatattgttacacaaaattatgggacaaaaaaagtctattttatttagggagacatttactatttttgttgctctttgatcattattgatgttctagatttcctttagttattatttcctttccacttgaatttctttatatttctttaaaattgatttattagcaatgaattatcttatttttccttcatcagagaacatcttcatttttccttcattcctgaatgataatctcattggttatagaattctgggttgacaggcaggtcttttctttcagcactttaaaactgttgtttcactgtcttctggtctccatcattcctgatgaaaaatcagcacacatttggatctttgtcctctaaatgtaatatattgtttttctttgcctgctttcaagactctatttttgattttcagtagttttaaaataatatgtacaggcatgatttctttgagtttatccttttggggattcaccaagcttcttagatttgtagattttgtttttcctggaatttgggaagtgtttagtcaaatatttttctgcacatacatttttctcctgtcttgctggaactttgatgagatgaatgttgtatcttttgctattgttccacaggctcttaagctctgttttatttttttaaactgttgaatctctatatttcagattgcatagtttctattgaccaaattcactaattcattcatctgtcatccccattcttctattgatcccttccagtttttatgtatattacagtttattttcattgttgtatcttttagttttatgattttcatttagttcatttttagaccttctatttctcagaagagaaccgatatctttacatttattccaaaattgtcgacacttacttcatgtagcacaatcataataactgctctaaaatcttgcctgataattgcagcatttagtcacctcgaggttagcatcacttgattgccttttcctttgacaatttcttaggtttttatgattctttatacattgaataatctttgattgcatttgggcatattcaatactatgttatgagactctgagtcctgtaaaatattatagagaattttttttattttgttttagctggcagtcaaacctgttgcatctagactgcaagtcctaagccaacttctgtaagctatagttccgatgtcagtttagttaaaaaagccattgcagtgatcttctggtttgtactctttcgtacattcttggtgccaatttgggatctgggcagtgatctatggtgtagttgagttcataaagcctttgctgtgttcattacatctggtttcacacatgagcagcttgggactgagcccaggactttagagatttaaaaatccccttttccagcttcatcatctctgtagttctctctaattcccagaggcccttttcctggtggtctagctagaaacccagagagcttcagctttcccacatttttatgtacttcttgtgactgggcctaatttgggacaaagtagtgggagcaaagagcttgtggggctgctactgctgcctctactgacaacatttttgcccagtgtagtacagggagagtaaaaaggggcttctccacttcacagtggtaacctctgtcataccagtgaaggatggcgtgacttttctttgctggcactcaaaatggcttggggccacctccgtcttgtttggagcagtggactcctgttttgttgctcatgcttgagagtgaaaaggggtttgttccacactggccctcactcctgcttctctggctagagagagtgaacttctcttgaatcttactttatctgcgcctgttagtagttttgatttttgcctgccacagagtttaagccaggatatagaagacagggggagaaacaaaccaacaggcaatttattgctgatttgtcctttgagtacggaattctgtattcagactacctggtcttattttcctttcagagtcttctgagagttgctttatgtattttgtgcagaattcttagttgtaatcagtcgaggaggtaggatggagttatttactccattttaactgaaactggaactcatctgctttgcttttacaagtacattgtatttataatatgaaaatatatatctggttgggagtatttttaaaaatgcagattctcaggtcctatccttagacaaaataaatcaaaatattctgggagtggagactaataacctatattttatggaatatccccatatgggattctgatggaacagtcaggtttggcacctactttttctcatttgcagatgagaaaatggagacctaggttgtattctgttctcattcagtttattctttattgcccatgtttttttatttcaccctgtgagtcatgttttgtgctaattgggaatattttcccactgtatcaagggccaggcttattagtgcaactgtaagtgtttatgtatttatttatttatttttattttatttatttttttttgagatggcgtctctctctgtcacccaggctggagtgcaatggtgtgatctcagctcactgcaacctctgcctcccaggttcaagtgattctcctgcctcagcctcctgagtagctgggactgcaggtgcctgccaccacgcccagttaatttttatatttttaatagagacagggtttaaccatgtggccaggatggtctcgatctcttgatcttgtggtctgcctgcctcggcctcccaaagtgctgggattacaggcgtgagccaccgtgccatgctaactgtaggtgtttaaaccacaaggcagtagaagaggagaaatgggtaaaattggctacatgtgatagttggatttggtttcttccaaacattttccattgtgaaagcttcatagccaatcagaagagaaaaatcattttacagaaattcatggaattaaaaacttcttacaaattatccaattgacatataaggaatagacccgaatcccagacagggagagaactagaaaagaaattttcaggttttggctgaggacataagaggacaatggggaggaagagctgataaatatctaaatgttagaatagaggcaaaaataggactggatgagctacctgtgaaattagttacaaaatgagtgaatatcataattaataagtaaagctatatcaatcttgtttaatttaatgggactctgtacttgtttgttccctaatatatatcatcttgtatactaaggatggctttgtagattgtatgccacacaactccataaggcaccctatgcatatattagaatgcctggagttgaatacaactgtatgtgctactctttcttgtatctccaagattttttttgttgttgtttgtttttttttttactaaacagtaaagtggtaccttttctagatgactgtgtactatgattgaaaggcagtagaagaggatgagtggagaaaagcaaagtggaggggcgttagtgtaaatcaattgtaggatgtatggggttctagaaatagtgagaacttacaacctgaactcattaaattctctactaccacagtcaatttcttcccccttcagcacccctctgcaaccatcccacagaacagacttctaaaggaaacatttggccagaggacaaggcccagcaaacgtacactctttttactattattccagtataacttctggtgagccaaattgagtgacatggaagacccttttgtctagagctaaacctcttctttctgaccatcctgtgctaacacccaagccttagtccttcaaatcttacactgcaggaaaaaatagactcatagcatgaaagctagaaggtaaattggaaattggaggtgcaggggaatggtgtgaaaaatcttttataaggcttgtttttcaaaatacaatcctctataagcattagggccacctgttttctttttgccaaaagaggcttattcctgagcttcaccaccagagagtttctgattccataagtgtggatttgggatcaggaatctgtattcacaggcttttcaggttatttgtagaaactttaaagtttgagaggaaggaggacggtatcataatattggaggaaaattgaccttatttacccaccttaccttgattataacatggacccctgattattcattgaactgagtaaacctagaaaactaagaataacttagtattatgtatataaaggtagtcaggtgtactatcttagtaatacaatacttgtccaattcttactgaacaattggctcagaaaagacaaattattttggtaattatagataagttaccttacagtttatgtttgcatttgtgtttcttttttcttctagaactttattgaagaaaaatgaatgtaaacagtttgtttcttcttattcattcttttctttttagagttttgcttattttaaatatcttttcctttttatttttacacatttatggggtaggtatgcaattttgttacatgcatagactgcatagtggtcaggtcagggcttttagggtatctgtcatcttaataacatacattgttgtgcccattaaccaatttttcatcatcctcccctctcccactccctcactcttctgtgtcttcattatctatcattccactctctatgtccatgtgaccacataaaataattttctgtagtttttctaatatgtagcatacaaatagatggagttatcaagtggaaaagacagtggagaaaggaaatttgtaatattggcaggactgagtcacatggggcttcaggatttacttagatttcacatataaattagaagactattttattacttctagttagcatgaagtgtcttcatacatcacattgctacttagcactgcaaatttgttttttttttttgttgtttgtctgtttttgagacagcgttttactgttgtcgcccaggctggagtgcagtggtgtgatctcggctcactgcaacctccacctcctgggttcaagtgattctcctgcctcagcctgccaagtagctgggattatgggcatgcaccaccatgcctggctaatttttttttatatttttagtagtcggggtttcagcatgttgaccaggttggtcttgaactcctgacctgaggtgatccgcctgccttggcctcccaaagttctgggcaaagttgtattttcaagggacattttctatcataaaaatgatctaaaagaagatttcggttttgtcaagaaaaacatttgcaagtcacttgtgagaacctagaaaattaatgtatgtattataaaatagtcttttacttaccgtttgtctgagaaattccacttctagatatttacccccaaaaatgaaaatgcatgttcacaaaataaaattacaagaacaatcataacagccttaattataatactgcaaaacttgaaacaacttaaatggctaactttaagagaatagataaataaattgtggtatattcatagaatgaaatattagaaagaaaaaaaggaagaaaccactcatggatgaatctcacaaaccttattctgagtgaaagatcccagacacaaaagaccatatgctctgcaattctatttatgaagtcctagaattggcaaaactaatctatggcatggaaaaaattcagaacaatgattgtgtctgggttgggagtataaatcgattggaaatgtacattagggaactttctgagatgatgagagtattgaaaatctggatagggaatatgggttatatgggcacattatatttctcatatggtatttgtcaaaattacacagttaagatttttgccttctgatatatataaattttacctctataaagaatgttatagaaataataattgagttaggaatagaggaaaatgtaagaaacaagaatgacagaatgttgtagttgttgcagctggatgatagatatgttggctttgttatactggtctgtttactttgcataggcaggacattttccataataaaacgtttaaaaggttgcacgcggtggcttgggcctgtaatcccagcgctttgggaggctgaggcgggtggatcacgaggtcaggagattgacaccatcctggccaacatggtgaaaccctgtctctactaaaaatacaaaaactagctgggcgtggtggcacatgcctgtaatcccagctactcaggaggctgaggcaggagaattgcttgaaccggggagtgggaagttgccgtgagctggaggttgcggtgagccgagattgcgccactgcactccagcctggcgacagagcgagactcaaaaaaaaaaaaaaaaaaaagtttaaaaactcggctggacatctctgattctgatcagatttttttggtctacatgattttttgttgttgatctactcaaaattgtgatgtttcagtattaatataaggaaataaaaaatagaataccattaatccataaactctgaaataatttgtgcctgcagtttacaaactccatccatgctagacttacattctagccttcaggttttattagttgaatgcttttataaaagttattttaggaatcaaataaatgaatactgtacttgaaagagtctgaggtcattgttaaagtttccatgaggagttgaagtggtaattcttgttcttaataatagccatactctttaatatctgtcttagtttgtttgggctactataacaaaatatcatagactggtgtcttctaaacaacagaaatttattgctcacgttgcggaggtggggaaattcaagatcaaggcaccagcagattctgcatctagtgaggacctgcttcctggttcatagatggcaccttcttgctgtgtgtgtccttatgtggtggaggggggatggcagttctctggcgtctcttttataagggcactaatcccatttatgaggactcttccttcatgacctaatcacctcccaaaggctccatctcctaacatcatcacaatggtgattaggttccaacacatgaatttgaagggacacaaacattcagaccataataatatctgtgctttgcaactactcatggttttttttttttttttttttttttagacagagtctcactctgtcacccaggctggagtgcagtggcgtgatctcgtctcactgctgcaacctctgcctcccggattcaagcaattctcctgcctcagcctcccgagtagctgggactacaggtgcgtgccaccatgcccagataatttttgtattttttttaatagagacatggtttcaccatgttggccaggctggtcttgaactcctgacctcgtgaaccacctgccttggcttcccaaagtgctgggattacaggcgtgagccaccgcacccagcccactcatggttatggtgatcactcagaaagagatcattatggccatcagtttgcttcagagtagaatgtcttcaggttcagcatagtatgtgcacatagcagacaactgaagatttgttgactgagtagctagtagacaagaggaatacgcagacactgtgaccaccaataatcttgatttcccttttgccttgtaagaggatgttctcagttaaactggacagcctatatccccacaaccatccatgccatgggctgtggtacttcaatggccatttgtttagtacagatgtatttgtgatacaaagtatttgtgaacatttcccagttgtgtgaattatttaacctttttttagctccttttcctcatttgtaaaatgagattaatactagtacttacttcattggagtcttataaaattaaatgaatcaatatgtataacacacttacaacagcacttgagacatagtaccatgagagtgcttattagaattatcatcattattattactattattatttaccatgattgatactgatctttgttgtttttttcaagcgagagctcttattatctaagttaagccccatgtttcctttaagtgtccaggcaacgtagtatcttctggctgtgtagagctggctttagcaatttcttggtacgaaatcaccacttattcctgtaattctattctcttttggatcttgataaccctacaataccactgctatggccttagccactaaaaagtggctttgctgggcctgctaagaattataaccttcagaggggaatctacaaaaacgtggggactttgaggaacatggaccactccattcacttgaggggcacttaaactccataaaatttaccaaagaccacactgaaaatcttgcatagcacaactgccaagagtcttagctggagagggactcactcttatgtcaacaaggctgtataaaaatatgtggctcttttatacccataaatcatgactttagaggcagagagactcggatacccacaaatcgtgactttagaggcagagagactcagatggtatgaggcgtcttccagaataaaggggtttatttatgctgttcaaatttaggataaagttagcgttaggtaacttcctggttatttgtgatgtgggtctctaactgagaatttctgcagtctctctagatgccacagtagcatcacttaaattagaggccgcagcctctggatgcttgtcacaaaatttgcctgtggtgatcacattcatgatcagagatttgtttatttccacaaaaaatgcagcctggaacctacccagcagctaaacccagactagccttgtcatccctatgaaggttggaattatctacctggatggggttgtccacatttacagggcagggttcccagaccctaagtatgatttccaagagtttcttctggctttctttgctgtaagggcccccaagtatgggcaattcttttgcttgcaaatgagaatccaaacatcctgtgttttttctgcttctcaaaatcttctacccattaagcaagctgcgttttgaattataacatcatttatattttagttcacgtgatatttatgattgtatcttctctgttcatggtctgtttccctttcttcctctctgtccaattcacagtaattatagaaatgagttaaaatatttttacagggaagtcagattaaaaaccagcaaaagtaaatacaataaaagggaaactaggtggccttaggcaggtacctttgattaattttacaaagttgttatgcatgaattgcttatatgcagtgtaagcaagaatataagtttatgagctattaacattttcttatgaaagtaggaaactgactggctattctatgattcctgaggttcctctgggggaaaaaaaagcaaaaaaccttactcttcatgtcaataattgtttctactctagaccttactgaaagctgcctgttatgtataccacatgctctttcttgtctgacctgtcctaggttcagttttctttattgggttctcaattgttcaacacttatgaaatggacatatctcagctggtagcaaagagagtgagaaacatttagagaggggcaaataattgacaaacatgaagatactgagcccttccttccatgttgccaccaaccgttagcaagttggcttgccagaaaattaagagtaagctttgcagacagtttctgactcgcctgtaatgccagcactttgggagtccaaggcaagcagatcccttgagcccaggagttcaaggccagcctggacaacatagtgaaaccccgtctttactaaaaatataaaaattggctgggtgtggtggtgtgtgcctgttgtcccagctactcgggaggctgaggcaggagaatcgcttgaacctgggaggtggaagttgtggcgagtcaagatctcaccactgcactccagcctgggtaacagagtgagactctgccaaaaaaaaaaaaaaaaaaaaaaagtctgtaaaactcataaacctcgggtgagactttcataaagataaaaggagtaagacagaaattggtaatatcaggaatcaaaactgggagtcacatcactagagaccctcatgccaataaactgaaaatttagaggaagtggacaaacagtaaaatacttaaaatattgaaaaacttaaaacactgaaacctgagagaagatgtaaaaacatgatctgaactgtatatatgaaataaatgcaatcagtaattaaataattttgacactgtgtttctgtatgttacacacaaaccaattatttggacttggtgcatgtagtcttagctactcactgagtagctgagacacgagaattgcttgaacctcggaggtggcggttgcagtgagctgagatcacctcactgcattccagcatgggcgacagaatgagactgtcaaaaaaaaaaaaaaaaaaaaaaaaaaaaaaaaaaaaaaaaagagagagagagagaaagagaaaaaagaaagttcctgactcatcacctgttgtgttgcaggtgatttgtacttttgaataaatgacagaaatgcccggagcccctttccttggcaggcagtgattgatctagagaagcacatataagtccttagtgaattttaagggttaacaagatagtaatgccaagagtgtcggtccctttccctattgtattacttaataaaggacagatgtctctccaaggaccttactggcgattagagaatgcatttgcccttagtattatttcaataactgttaaacctcaatggacttcattgtttgtgtttgtagttgtaactcacatgatatactctataaacctggtacaaatatggacatactttttgtatgtaggttgagtatctcttatccaaaatgcttgggttgagaagtattttggattttttacgtttttgaatatttgtatatacacaatgagatatcttagggatgggatccaagtctaaatatgaaattcatttatgtttcatgcacaccttatatgcatagcctgaaggtaatttattacttaaaataattttgtgtattaaagaaagtttttttttttttttgagatggagtctcactctgccacccaggctggagtgcaatggcatgaactcagctcaccgcaacctccacctcccgggttcaagcgactctcctgcctcagcctcctgagtagctgggattacaggcgtgtgccaccatgcctggctaattgttggtatttttagtagagtcggggtttcaccgtgttggccaggctggtctcgagctcctgtcctcaggtgatctgcttgcatcgctaaagaaagttttgactgtgactcatcacatgaggtgaggtcgaattttgcacttatggtgtcatgctgtcactttaaaagctttgcattttggagcatttcagattttggatatttggattagggatgttcaacctgtatttccatttaactgctcaagactggattcctttgaagtagtttctcgctctctcccaagaccctccctttatcctcccctccccacatatagtcttggaatgcaagggcttatggtctcagtggcagtcaacctggctttcatagtcaagtggagagagagctgggcctgatcggtgcactacggcccacgcttctgaaatccataaggtgttgttattgaacactcatcctgcatggtccagcgtcaatgcttgtcgactgatgtagtgagactttggtgaccagattctggaaaatgatgccatgatcttttctgggcagaccaagccattatcacaatgtggaatcaaccagtatgccctatgatggtcatttgctcttcacacacatttataatcctgtccccccaccacccccaaggtttaaattggcccctagagtgtcaggacaggtttagctatccatcacctaatgaaacctgcactgtgattccacttcattccctgggattcacaccctggaagttgagcatcttttactattagacattcaaaacacaatacaatgtgtatgatgatacccattttctctggcatctgagatcctggacaactccttagggcactactttcagggacaccaaagtgggttttcacttttttcctgctagagacagggaaaaaaacctgtacaaatatactatagtatatagtataattcaatatatatgggttaaaaaggcttttgtggtccaacatggtgacctacctagtgcatctaatattatatttacagatacgtgcacctggtccaaataattggcttatgtgtaacatatggaaacttagtgtattcgtttgttggggctgccataataaattaccacactcttggtggcttaaagcaacagaaatttatcctcccacagttctggaggccagaagtccacagtcagttttattgacttaaaatcaagatatcagaaagggcacatgcctctccctctggaggccctaggggtgaatccattccttgcctcttccaacttctggtggctgtgggcatgccttagcttgtgtcagcatccctccagtctctgcctctatggtcacatggccttcttctcttccatgcatgtgaaatctccactgggcttcctcttacagggatatttatgaataatacaggataatttccccatctcaagatctataaaccatcacatctgcaaagcctttgccatataaggtaatctcacatgttccagggattaggatgtggacatacattttggaagcattatgtagcctatcacatatagctaatttaaatttaagattgactatgtaatacatcccactcatcttttccttattcatagaaactcatgacactaagaaatacttaccatgtacacattgactgactggacaatgaaagtgaagaatgaaatggcattattcaacaaaaagatattagtaactctgcaatatgcttctgagacagataagcttgatcagttacaaccatttgtaaacactgaaaggaattgcatgagtatcttggtatctctgggaataatttggtgattaaaaaaatccagcaaaacaataaatcaatagaaaaacttacagggtgtttagaaaaagaaacattgctatatattgattacccactttctccctggtttaaattcaagcactgcagaatatgttgaataagcacatttagcatactcagtttataaaagtgtcttttgtcagtttgatgcaaactacattgggggaaataaaaaataaaatccagaattaatgttccaaactgcaattgctgaaagcggggagggatagtgaaaaaccccaaatagaaatgacacttaaaaataaatccttgagtgactgccagcctgtttgatatctatttcctaaagcatagagcatttgttgtctcacatctgaaatagatggttttgttttgctagagcttacacatatgtacatttgtttattctctgaaggtgattcttcatcataaggtattggaaacagattcttcagggaaaacatctgctcagctataatgctagcatctgccaagttaggtgtgctgagaaaaaaagaacttgatcttagtggttcagggacctcaaatttacaagttgacaaaatatcaaacacagacaagttgcatctttcctccattactcctgcccatagtctggaactatatccagaatcctagcctagccgtggccatgccagacacagaacacaaaagtgagacagcattaatcctagggtcagttctaggggcagaggccattgggtctactaagcaaagggccctgacaccaaagcagaccttggccttgctttacagtttccttagatctttccctgttgctctaggctggcttgatgtttatggatctgaggtcttggatgtggcacataacgtagtcattaggagcgtgaatgctggagccagattgccatggttcagactcttggctctgccgctaactgtgtgaacttgggaaagttacttaacctctctgagctcctatttcttaatttgtaaaatagggacaattatttcagaattggatataaatggacaagatgtgtaaaggtgccactacaacctgaaaatatgtactcttagaactgtttagaatgaataacaaaatagttcatactgacctagttaaacctggggagtaactaaccctttgataaaaatcccccatgggaaaatgccctgtgccttcaaagaattgtaatctacatatatccttactttaatccaactctctttactccaatagaatctactggcctccctcacctttaatttgtgctccctgccataaaagtggtgagcaagttgagtactttctggaatttgcagaagatttacaaatcccgagcttatgaagcttcagaactcactccattcccattccacaaatgttgtcttagtgtttgcgtggggcaagacatttgttactgagtagaattttggtactaacaaaagcaactattggttgtaaaatctgttctctattctgtttctcttgatcaaccattatctaactctgcattatgcattgaactctgtgctaacaacttctttgcttcttattctccattgttcttgtgtccactgtaatgtagatccagattgttgtcattcctggaggccacaatgaggtgccaatttagaaacttagaaaaacttagagaaaattaaaataagatttctgtttgagagttaaactttaaaggttatatgtaatagatcagaagtaaggaagagttgtgtaaagaggcagcatggctcttgggccagcaaggctggacggcaaccagacctgttatggtaacatatctgaggaacaaaacagccttgatagtggtgccaaagcgagtcctacacagtcaggacccttctaagtacagtagagaagaaatctgggccaagctggctggcaggtataacatccttggcaagactctcactgtgctgagtgaggaagctcaggctacatcagctaaggaatatttctcacctaaattctttctttgaatccatagtcatcaagacctcttgtctccatacaaagggggaatatactgatctgctactttgagccttctattacacttgacatttgaatttctgatggtaaatggatgagtcaccatatttttgggtgtactattttggttccatgagcttgatgagtatgaggacaatcctcagggtgccttggtctgctacctaagtcacaggccttttttgatgatgctatcgcccactgctttttaattttgacaaaaaaataacctcttgcctagattgcaacatcactttccaaatgaattttccattttcctgcctcttcaagtctatcctgtacctaaccacaaatgcttctttcccataatttgaatttcatcatgacacctactcaggaaactactatgattgattgctctcccaaataacttgaagaggcatgtagaagatcctcaccaaagaatgttttatcccgtcctaactgccaaactaccagaaattttattatcagagctttattccttttagtttaaggcccagaattttggaccattctgtttccgttatcttctggcctccattgtttttgatgagaagtcagatatcattcttatttgtgttcctttgtatatgaatatgctttctctcctttggctacttttaagattttctctttatctctagttttcagcagttagactatgatgtgccagtgtttggcttcctttgtgtttacattgattggggggtcaccaagcctcctgaatatctaagttgtttttctttattaaatgtggaaaaattttactcaatttgtcttcaaatagtttttatgcactattgactctcttctctccatctgggactccaattacatttgtgttagtctgcttgataccatcctgcaggtcactgtggctcactttattgttttttcaaattatttttcaccctgtgtttcagtttgggtaattttattgtcctgtcttcaattttactgattcttcttctgttggttccaatctgatattaaagccattctgtgaatttttaatttttgattttttttagtgctagaatttttatttggctcttttttttttcaacagtttaagaatctctcctgaaaatgatttgtgttagtgcgttttcatgctgctgacaaagacatatatccaagactgggaagaaaaagaggtttacttggacttatagttccacatggctggggaggcctcagaatcacaacgggagatgaaaggtacttcttacatggcagcagcaagagaaaatgagaaagaacaaaagtggaaacccctgataaacccatcagatcttgtgagacttattcactatcacgagaacagcacaagaaagaccggcccccatgattcagttacctccccctgggcccctcccacaacacgtaggaattctgggagacacaattcaagttgagatttggatgcggacacagccaaaccatatcgtgattgttctaccatttatccatttttcccctgtaaatttttaacatatttattatagtaacttaaaaatattggttaattctaacatatggatcacctgtgcattttttatattaatgaatttttttacacatttctggttttttcatttgtatatctagtaatattttattgtacacttaatgtacattatagagattctggattctagtttccgcttctgaagagtgttgagtttgtattggtaggcagttaagttactggtggaacatcttgacattttggatacttggttttaggcttcactaagtcagatctattttagttttgccttttgtccttggataaatcccttcaccctggcacgtgatggaattataatggaaagtcctaggtgtttaccaagcccttccaatttgagagtactcaaactccaaactctttctcctctgcagggggcagttggtaaaattgatattcagtgcttcatctttccagctgtcttcctatgtattacaattcagaagtcagtcatggatttgaggaatgtttgaatgcaaattttgtagcttctctctttgaaactccttctttctgggatttcctcctcctcaattctcagtttctctgtcaggtccaaagtttgtcctctgaatcttcaggtcaagaaaactcaagcttttttgttttagccttatcttggagatttgtgagaaatgagggaggtcctaagaaaaaacatataaatatgaatctcagccagtgtgattcccctgttacacaggccaaatttcctctactttcttcctgcccagtgcctccaaacagttcttttatgtttttcagagtttatggttgctatcatcagaagggctagttcaatactagttataccactattactaggggtcctgagcctcctctttgacattataaatcaagcttgtccaacctgcagcccagaacaggtttgaatccagccaaatacaaacttgtaaactttctgaaaagattatgagattgtttcgccatttttttttttagttcttcggtatcattaatgttcatgtattttatgtgtggcccaagataattcttccaatgtggcccagggaagccaaaagattgcacacccctgtaatgtaaactatccctagagtggttaatgcattgtgttagtctgttttcactctgctataaagaacttccctgagactgggtaacttataaaggaaagagatttaattggctcacagttccacatggcagggaaggcctcaggaaacttacaatcatggcagaaggggaagcaggtgcctttttcacaaggtggcaggagacagaaagtgtgtgaaggaagaactgtcaaacacttataaaatcatcagaactcatgagaactcactcactcataagagcagcatgggagaagccacctcccaccagctccctcccttgacatgtgggcattatagggattacaatttgggatgagatttggtggggacgcagagccaaactatataatgcataaaacttattgcctattaatacatttttttaagagagaagctggggttctttttgatttctagaccctgaccacctgtccccagtgaccagctgtttgctgcctgccgcatctgcctacccacagtggttattttggcacaaaaggaacttgcgggagtgatgtttacaaagtggtatgaattatagtgactgaccaaccaccatgaggttaactgaatgagcactgaaaatatatactatgctaatggaactctatgggaggccagagaatgtaaaaatttggaacaaatgctttggtgtcagatgttttgggtttgattttgaaacaatttgcttaacttctctgtccccattcttttatctgtaaaatgaggttattatcttacatggtcattgtgagaattaaacaaacagatatatatatagctaagtacaatacctgttatatagtaagttttcattaaatctttataatagtccaccttatctggggggatacattccaagacccccagtggatgcctaaaaccatggatagtaccaaacctgtacagttggctctctgtatctacaggttccacgatctcagattcaagcaaccttggatcaaaaattttgggaaagcaataaaaaataacaatatagcaataaaaataataaaattaaaacagagtataagtactgtttacctagcatttatattgcatgagatactataagtaatctagagatgatttaaagtatatgagaggacgtacatagattatatgcaaatatgatgttattttgtataagggacttgagcatccatggattttggtatctttgcagggatcctggaaccaataccctgaagatactgacagagaactgtatatactttattttttcttacacatacatacctttggtaaactttataacttaggcacagtaagagattaacagcaatagctaataatagaacaattaagtaaaataaggattacttgaacacaagcactgtgataccgtgacagtcaatctgataaccaagacagctgctgagtgactaacaggtgagtagtgtatacagagtggataggctggacaaagggatgattcttgtcccaggagagacagtgggagatttcatcgtgctactcagaacagcccacaatttaaaacatgaattgtttattttctgggattttccacttaatatttttcttccacagttgaccatagttaactgaaactgtgaaaaacaaaacagcagataagaggaactacagtattaaaaattttttaaagtcaagaaaatcttttctataaccacactgttcagagagggctaaagtagcacgttcacaatgttgtcactgaaaccgtcactctttctccgtgtgtaatcagcagacctctgcagcagaattatctgaggctgctttttagtaaatctgatttcctggctcccacctcaaaactactaaactaaaattgacaagagtggggcctaagaatatgaatttttaataagctctccaataactcctatgtcactaagttctgaaaaatactggataattcagaggcaaagagaaatttcttgagggaggagtggaaagactaagactttgaactcccatctcaccttccagaagtctagatttcattgcctttctggcattgatgcccataagcttattactttagatggagactgaaaagttttagtcattcttaagtgtctggctggagggtgatcggcagaatgattaaaccaaaagaggttataattcatccttcaaatctgtggttaaaggcattctgctgcataacttttcacctgtgaaatactccaaagcttttaaaatcatcttttactaaggggaaattccagcttcctagcaaaatagatggcacttttatccctcatttctcttgctttttcaacaaatatgttaaaaaacaattacatttcagagtgcaattttcattccctttttattgtggaatcgtggcagggttttataatctgcttaaaacacctggacttaacacaacatagggcaattataagggtcttcaatatagtgtgattatggtttttaagatctgaggttatttttgaaagaaaacagaagttcctgtgtttagtaagcaaatagaaaaaccaagatagtgtcaaccgaggtcaaagggaaaagaggaaaggatcaagactcactaggatgatcttaatatctagtatattgcctgtcagtcaattggcactcagtagagatttattgcatgagttgaatgaatgaatgaatggacattatgtgctttatatttggaattgatagagtcccacttttgagcgggtaaatgagtatgttctgtcctatgggagccctcgtttcacagtttctccttcatttaaccaaatgttctgggatggaaaaacctgctgattgcgaagttgcagaataacgtccaggctgagatagtgtcctggatggtctatcagtgggcccctgcctgtggctccctctgtaagcatgctcttctccaccccatcctttaccccacaactcacttctcagattttccagttttcttagcctactcatctatattgcttcccagagtgctactcgactctggatgcttctctactgacccctcaaagggatgcttttgaaaatcataccagataagtgaatgaggagtagaagctataaccatgaaatgaaccactttgatctggaaaaataaatccaacacagcaaaaactgacaggcacctgctcatgaacagcagtagcagtgctgtggatctgcttgctagctgtttcatctgctgagggaattgttttaattttgcaggctgtggcagacctggggaaacatactataatatgcaaagcacagaccccgattaatatttcacccattgcatgtggcttgatggcgttcctgacttgttgcaatcataagtgtgaaactctgggggtttcagttaaattatttcataacatgtagcctaatatttttgtgccctaacctcaccttctattaaaataattttagggtattgcttgtatacagtgacactatacatattatataaactgtgttttatttacaaaaggttttttaaaagtgtaaagacatcccatacctgtttgttgtggttattgcttttaaagatcaatttatgtttgataaataaccaataagcccacagttctgtataaggaaagtattcacactatgaaatcacataaaggaaagggaaacaaggtcagcagttaatgcaacacacatataagctgaaggctgatcttgagtgaatggtttgtactggtaggtgaagggtgagagggtgcagaaatgactgtgattgttatgaattactagattgtagtaaacactattgaggtccttctcatacctcccacccatactgcctgtagtggatagaatagtggcctcccaaaagatatgtccatgtcctaacccctagaatgcatgaatgtgaccttgtttgacaagagtctttgcagatgtaattaagtgaaggatcttgagatgagatcatcctgaatttagggtggaccctaaatccgatgataagtatccttagaagagaaggggagaagatacagagacatgaaagagaaggcgatgtgaagacagaagaagaaattagaaggatgtaatcacaagccaaggaacctcaaaaatgccttgagccaccagacgctttaagaagcaagaaagaattctcccctagagcctccaaagggatcatggccctgatgataccttaatttcagacttctggcctccagagctgtgagagaataaattgttgttgcatttaagccacacagtttgcggtaatttgttgtggcagccccaggagactaaggcaccacctcagcgtatgcaggctggcctgacttccagctgccagaaactgcatttctttaccccaggcttcctctggctgccaagacctactctgcccacttattgaacaagctaggctgattgtgctgagaaattagtgtccctgcctcagcagctctcatgttaaggactgacagggggaggcagtgtataccgacattaacccccttgccccttgggtggggtaactgcagcactcatcctgtgctgactcctgggatttagctccagctcttcacagtgttcactaactggacaaactctgtactggcttcccagtacagagtcttgtctttcacagtttcaattgcccactcccatactagtttttgctggaataatctgccaaataaactatttgtatttcaatacttgtctcaggattgattggcttgaagggggaacccaaactataacataaatataaaaggacattacagatcatcctgatagcttagaggaagtacccaactcagtgatgtgaggccttgggcattttcctgggctgttttatgagagttgtctgattcgaccttataccaacagaaatctgctgtaattaaaagtgatctctctagttatatatttatccacaatctcttttagaaaaggatttaaggtagcattagaattatgatatttaatatatcatgtcacattcttttattctctccacttcaaaaacattgtgatgatttgataacaagtaaaaatatcaattttccagatattctatttcaactttcccattatttgttttcatttagtatgttctccccttttttatttcccatagacatgttctctgctttcatttaaacaagcaaaccataaatcttcaagtgaaggaaaatgtgaatattttctcttatgatagtttttattgaatgtaaagcctggtctcatattaaaaagcgctgtaaggaatgcttgcttgtttgatgtttgttttaaatggttgaataaatcttctccaagttttgacaaaaagttttgaagccactgacttccttattctttttatctcttttcaaaacactgaggagatggtctgaaggtgaagtaaagcaggtttacaaacaaagggaaaaaagctttacagtattttaaaaatcaaaccttttgaatgtaggtaagctctggtgcagccaacatgttttaatcacagaattatctggaaataactgaacagccaattctctgtagaaagtgttatatttgaccttttaaaaaatgtactgcccatgctgatgacttttttccttaagaaaatgtaggaaattatgacaaataaataggctgtttcaagtttcttgagaaagagggcatctggctgtgggaaagattgctaaagtcaagaataagaaatgacgattttgctccttgcaaaagtagcagacttcctttaaatatttttttaaatttatttttaatttttgtgggtacatagtagttgtttgtatttatgggatacatgagatgttttgatacaggcatgcaatgtgaaataagaacatcatggagaatggagtatctatcccctcaagcatttatcctttgtgttataaataatccaactatactcttttagttattttaaaatgtacaattaagttattactgactatagtcactctgtgatgctagtaaatagtaggtcttattcattctttctctttttttgtaccattaaccatccctgcctcccccaccaatccccccactacccttcccagcctctggtaaccatccttctactctctatgtccatgagttcaattgttttaatttttagatcccacaaataagtgagaacatgcgatgtttgtctttctgtgcctggcttatttcacttaacataatgatctctagttccatccatgttgttgcaaatgacaggatctcattcttttttatggctgaatagttctccattgtgtataagtaccacattttctttatccattcatcggttgagggacacttaggttgcttccaaatcttagctattgtgaacagtgctgcaacaaacatgggagtgcagatatctcttcaatacacagatttcctttctttcgagtatatatgcagcagtgggattactggatcatatggtagctctgtttttacttttgagaaacctccaaactgttctccatagttgtgctactaatttacattcccaccaacagtgtacaaggattccctttcctccacatccttgccagcatttgttattgcctgtctctttgatataagccattttaactgggatgagaagacatctcactatagttttgatttacatttctctgatgatcagtaatgttgagcaccttttaatatgtctgtttaccatttgcgtgtcttctttttagaaatatctattccaatcttttgctcatttttttaatctaattactagagttttttccctatagagttgtttgagctccttatatattctggttattaatctcttgccaaatgggtggtttgcatatattttctcccattctgtgggttgtctcttcactttgtttattgtttcctctttattgttactcatttcttaacaaaatacttttgggtttatgcattcaatcaagaaatctttgtttgaagtttcttagatcttcagaatgaagtagataattcttcttgcttccatgtattaatttattatcataaacaacattcactggaaaaatatgagcaaactttacattaatataactagatagtgtattaactttaatctttaataaaaatttacagagtgggacagacagaaaagtgataacgtttgaattgaaagcttatccctgttttttcatagcaggaaacaatgtattttttatcaaaaggaagccatttgctgacatgtggatttgtatgtgattttaaacattgttgaaaagtgcaaagtctggaggacaaatatcacataagaaagaaattaaactgagatattttgtattgaagtacaaaatccaggaattaaggaactgatggatccaaggacgaaggctatgttaagattccattattgtgccagtttttgagggaggaaaaaaatcccatcatctagattttatcataaatgctggtgcaaataagttttccgttgaggttatgaattggatttaaagtagcacaaagtactttattaataactttcagacattttattactttaagtagcaatcggtccagacatcacacaaataaaaaggaaagctgcagcatttctttgctgcagaagcaactgttgcacgtaattttttttcatttctagactaatctactgtcagcatgcctctctcaatgacttcaccatgatttttaatgggttttggatggcttctttttacctttgtgacacagtttcaggtgtaaggatataacacttcttcccaattatgcttaggaatggcgaggacttatggtcaatggtaattgaataattcatagactacattgcaatgcattatatgatattcttacactgatctgcctactcgttgcttatgctcagtagaatcctgacagttgtctgccttttctgaatggttactgggcactgctggggtgtgtgtgagaggcagtgtcaaggtgacatggtagggtggtaagagaaagccagaaattcagaaagctttaggggtctcagcaaagtgggttatcagaccctggctgtaggttttaggatataaggtctcatctggctatctagctcagcagtcataacagtgggatatttactattcttcactctgggttaccttaccaggaactgtgtgctaatcaggaccctctcctactcagactctaagctcaagactcctaggcatcattccttgttcaccagcacaggggggatctgtgacaaatctcttctgatagtgtatccttctcacatagtggtttagtttcaaagttttcgtaaagaaatttaaaaagagagatagttcaagctttgcctacaaaagagatggaaccaccagtctgtgtgaggtggatgctgcaggaacagaactggcaagtcaagatttcccacagggctgggttgttgttgaagtcatgtgtgaggcaaaagcttcttatcagcactcaacacaaaatcttgcagttcatattaagagcatgtgagctgagagtcactgtcgtccatgtctgaatgggacattttcagagattctgtcaccgtttaccacttttcggggctgtccacgaagaaggaaaacactgaacagaagagttaaacactcatgtacgtgaagtaggctttagcagcttgcagtgaaaaccatccgtccttgtcttcatcaccagcctgcagaaaagagtggcaggatggagacagcaatgttctgctgtcaccagctttgcttctctgctatctgccatggctgagcctcgcaaacattacagcagagttctagacacagttcgtgcacttagaatggctgctggggaagtgttggttacaataagaaaaaaaaaaagcaggatggagatttttatcagggcttctctagtcaagcaaatgtgtttgtaaagagtgattggttttagaggctgtgtgagacaccatcatttaaggtatttccagacacaaactagatgatagcttacataagtcaaatacacatgaatctttttcctgctacagatttaagccttttgacactaaagacatcaatacttgtgtttggtgagagatattctgtctacaggatgagtgatttatggcaactctataatcccacaaagcccaagcaatgtcttctgtattccttgtggaactgggcccccaatatagattataaagagcagaaattatatcaatttgtcagactgtacccattgcagctttctatgacaaggctccaaattatatttatccctggggtcaactgagatgaactctttttaacttcattaaagactgtataattcaatgtataattttcaaaaagttagaagcatgactctcgtatgcacatagtatgagcacatgctcaaaatttattaactcattaatgaagaaatctgtaacatggtaaaactggttgaaaaagtattttgagggcctgagtatttatagacattaaaaaaagaatattaaaataaattgctattagatacaatcctgacttatatcctacaggacaataaaaatccataagctttgaaaatttttttcaactgtatagaaattttttgcatcattactggaaaagatctgcaagtcaacatgtaacttcacagaatctgagccaataattaacagtaaatagcaaagtcaaacaaaggtacattcctgtagataattagacaattcttggtgagctagttgtaatatgacattgaaaggacattatttctaagttttagacgtttttaacaccttgtgttccatttagtaatatgagcctaggtttcattttctcctgccccagtttgatttaaggcccccagactctacaaaatattcactttcctctctgccaacaggaatttcagggacttactaggaggggaacagatcacctttttgtctgactgcagctctatttggtgggtgccttgcctgccactctgcccctctgaccatcacagtctctaagtctctattgttgctcagctgctcatggagtgtctgcagcctccataggtcattacctttggtgtactagagccctcagccctgctgtagagtgaatggtagtattttttttttttttagcaactacacacagtagtaggtttattgcaaccaatactgatgttggctgagcaccaccacctctttttgccccaatgggtaaatgaccaccaagggtgggagtcagtctgggctctccgaggagcctgtgggccgcctggcagggggacagggacatgaatgaacatgcttgcaaaatgattctggagtcacagaatatcatccagtttggtagttttgaaatcttttaaacaagcacttttttttttcctaaagcaacctcacagagactcccgatgtccaaagtgcacagggcaggcagggctggtcaggtggaggccttagctttcattcactggagcaaggactgatgtctaaagctcagcaagcagcctacacagtcggcggggacctgtggctccctccccagatggggcactctgcctctattaaagcagcccacgtccccgtctacttgtcaggcagctgtgccacggcgctgaggtcaagcaaggccccagggcctttgcagaaggctgctgcctggtgccacctccccagctcgttccctgacagctgggcgtggatagctgtgtagcccccgcccttctctgtggatggcccactgcccatctggacacccttcctatgccagctgatcccctaagccctaggcttccatcatatcactgaccaaagcatagggcagtttgagtgggggtcagaggcctggggggtctctggctggaaggacttggtagtcttttctaaggtgggtctacactgtgctgataaatgtttaacaattggttctacaaaaaaaagaccctgaatgatttgtaacatttgccagtttccgtggtgtaaatacttccaccatggtcaatttcaagctgccaacatgatgtttaccagctagcaaaaattcctgaaaatgtaacaatcaattctggcaaggcaatgtaagctagcttctgcgcaccactggctggagagcaaggtgggatgcctcccactactgggatgggagaagagatgaacactattctagaatctcacagcagtgctcctgaggctgttccaagggttttcgtaaaaaaacaaaaaacaaaaacctctcagcatttttccttacagcttccaggttttgctcagtaacccagtaggaaagcttcagtcattgtagggaaagaggcagttccagtgggatccacagcaatcctgttgctggtttgcctagactggcgactgcttgattcatggctgagtcttgagaagcacatggaaagccataataacaaaaatgcttagagctgattcaccaaaattttgagaaacaaagcctcaggagctctactgtggggtccttgagcagttggattttattttaacttgtttggaactgttataaactatacaagtttaagtgtgtacaatccaaatacaaagaaatatactcagtattctgccttagataaaggtgagaatcacatatctgggagaaggcttagaggctacctatttgcgagagggctgggacactaccacacatttatgtcttgctgttatattcaatatccaaactcttgccaattccgaatagccaatagatttttttcctccattgatacagctaaaattgaccaacctaagaattgtctgtcaaccttcatctttcctgaggaattgctcattcaggatcctgtttcaccacatcacctagagcattttatttcctaggacctcttcattatcctttacatacttcttgagtgttgtgaccacagctctacatagtgtctcaggtgtgcccacattgcgtttggtacaaagaaataatttctgatttattttacatacatcttcagaggccttcaagtattttgctggtttcttttgtctgtagagctgtgccaaatcaatgtcgtcaggaattcaaccagatatctgcatgctttggagatttcccattcatttcacctctcacatggacagggacctaaccaatgtccgtactagcccatttggggcctttgtccaaaacagaaagatgctcttttctataagtgaaagtagccctgcatcagggcacaacacttgttgagcagaacatgagctggacttcagtattgattcctatggcatctgactgcattcaccttcccacccggagcaatgctgatcgtccatccctatgccttgtctattgactctaaactagaccttagcctctacaagagtccctgaaaacagaaatatattcagatactctcctgagagatgctacaagggcatttattcccatttatttcattgggaaatgaagtaggctgagcattagccccatgtggctgagatacccatctatgtccccatcccagacctctaaaataattttaatgaaaactacatgacctctagaatgtttttaagctgacatgtgaaatgtttcatctaaaacttaaatagctgaaagtacgtaatttgtggtatattataaacattgatattgaaaaatataactcttacatcacccttttgaataaatctaagggaatctaaatatcatagtgatttgataccagctatcaccattaaaaaatacatgaacaagctcttctgtaacagacagaaattttaaatccttgatttatctcattgtactcctttttcattctgcttcccttgcagaatttaattctaacctaatgtatttttatgtatgaaagaattttattcatcattgtattatacttctctacaacaaaatatatatatataaattgacattattattatttacatttcctgtgactataaggctccaagtgcttaaaatgtcttctggattgagttactgttacaaaaattagctattccaagctgattacaatagtataaatatattacaaattttgataatcattaagcataaaaagtaaaattttattgaaaatacatttcttaataaaaaatggggatctttaaaaatatttcatgtatctgtggatgaatatttttattgctaaaataaaacagagcttagtataattttattcctatttttaaaaaagatgtgagccataaataagaagatgaaaggaagaggtttgctttatcggctttactcagttgtttaaactccttgcaagttacataccaaaaaatcacagggaaatctccttccaaatgtaatcttaaatgatctatcagctgacaactcaataatctgataaaagctggaaccacttaagttgcaaaagttttgtgaccccgtcttgagagtcttttgctttctcaacaccaattccacttattttgaattgtacctttgtttggcgtttggagattttcacaccccagggtaatgcactagcgtaagattcaggaaagtaggaaagaagaaagagagatactcctttattctataaagcagggagaagcaaccatgaaaggggaggcgggagagggagataacttgcatcacaggcatgttcccaagcagatcacatttggaaaaattgaggacttgaacattgttctccttaaaatccagctgtgtccacatagctcatggaatgtcttcatgtgtccccaagataagtaccagtttgaagaccattgtacctgctacttacggttgccagatttaggaaatgaaagtacagaatactcagttaaatctgacttcaaataaacaatggatgcttaattagtataagtatgtcccatggactatgacatgcaatatttaggacatacatatactaaaaacgtatttattgtttatctgaaattcaaatctaactgcgtgtccagcgttttatttggcagtgttaactaaccttatagtgcaacttaatgtcatagctcttggaaggtggtttcttccctgcagatgactaaactcctcaaaggtaagtttgtgtctaactcatctttgtagtttttgttttctcagcaaatagaaaactagtaatcatcaaagaatatgtgttgactgaacaaatgaatagatggcatataataggcgctccataagtgtttattgaaaggagaggaacaacctgatcttggcctctggacaatggatttctggactgccctttcaataacatttagtgtcttctatgtgaataattaactgttcctgactctgctactcacccagcctcctgcttctacatcttttgttacataaattctcatcctcagatatgtacttgtttgattcaacatacctatgcatagcagtcatttcatgcagttttcatgcccctgcatatggaggaatcttccaatggcttcccaacttaccttggataaatacaaatgctttttaatgctttacaaggctatctctctggctcagctctccccatccctagttctgctcaagccacattgattctcacctcagggttttgcacttgctgttccttatgcctgaaatgtttcctcaagatctttgcatgtcttacttacttcattcaggtctctgctcaaatgaagctttctcaagaagattttttttccaccctaaatgttatagttcccttcctccaaaacagcagggggctttgaggcaaagtctgtccctcactttcacctttcaaatctcatctaattaaaggagacttgatcatacctaagagtctagccacaaggaagtctgggaaatgtagtttttagctatctagttgccaacttcagcaaagtgcaggagagggagggtggaatgaaagtcatatccaccacaactatgtggctactacatataatgtttaaaagaatatttatacgtgaaaaagtttataaaacaataagaaaatatactatagttgttttaaaaattagcataatgccccccccaacccacacacacacatatgaactagattatataccaaagttagtgatgtttttgagtagtggctgtaatatgttgacagaataaattcttgaataggatggtgatggagataggattcaaacatgtgatgggattggcttggaacagaagaaaggctatcttctcctgtgaagtaggaaaggaaaagatagagacaagtgttcaaagacaagacataggtggggcaggggcagtgagatggttcttaattgttggtctccatttttgctgtgaaatggaggcaaggccatttctgggagtgaaaggggaagttgtaggattgggggtgatgaattaatggtgaaagttcctgactacagatatggggaatggtaggacaactggccaggctgacacagttgtttgtggtgggcaattagggcccagatggtgtaaaacaaaaaacaaaaaacaaaaaacaaaaaacaaaactagcttgtgctaccgaggtcatttctccagcaggatttaatagccacagacaccaattgtgacttgtcatggtcttcagcccacctaacattttctgagtgaggtaaagttctctatcgacaatcattaatttcaacgacatcagaaatgattaggcattcattaaacagtcatttttattagagaggcaacactactgtaatcaataagatcttgggttctcaaatacaactgcctaggtacaaatccaggctgcattatttattagagttacgtgacttctctatgcctcagttttcttatctgtatactggaggcaagaatagtatttatttcatagggttgctctgaaatttaaatgataatacaaagtgtttagaacaatgtctggcacatagtaatcttttgatatatcttatttgccattgttattatctgtgttaatatggaaaaggaaaagtctgggggtgaaaaagtgtgatttaattttagtacctatttctacccccacctgacctcatctcagtcctgcttgttataccaacatggttgagaagtaggggcctttagttaatcaaatattcttatttgtagatcatggccatatatcgattggcaattgccaaagcagcacaatacaataaaataggcagaacatggacatttttaatgcatataatctactctttgatggcttaggaggatttaaatacctgttacagattggtttccccaccgagcagatcgcgagttacaaattaagacacaggatgtttatgagggagaggtcttgagatcaacaccagtgaaatgaaggagaaggaagcaggagtgaacaggtgatacagcctgtactgatacctcagcttatcttatgaggagctctaagccttggatggcccctgagagttgtcatgaattggagcaaggttgtccagcccttatatctgtgcattgatcaaacatttgatgcaggttacccctggaaggaagcttgaccttgggtgaggtattttattttatcagaggcaattcccaaaaagggctgacagctgagggccaccttctactagcactcccaacagctgagaaaattgtccttccttccttctgaaagggcttctgggtgccatatcaaagtgtacaccacctgattctttgagtgtcattgtttgagttactcatatacgatagacttatgggtttgttaaaacattgtcttgaccaattaaataccaggtaaaagagattctgcagtttgacttcttatggcaacagaactcaagtggtctatttattgcctgtgaaatgatgtcatccttctactatggaagagttctgagaacatacgtgtttgcataagtgtgtgtgtttgtgcgtatgtatatgtgtcctccaatacaaaataaaggcacttttctctttatctctcttcctgtaaaccatatctccactttcccagccttgctttatctgtctcttctattcagtgtttttaatactacattttctcgtaacagaagggaatgtgagccaaagccacagggaattgaccttcttgtgttgttttctacagatgctaaggattagctaaaacaggcacttttgaggggaaggattacccaaaagacacagtaggttctagggcaaagaggtcagtattctggcagaggtggtagtcatagcagctggtatcaaatggcaatgatggcttgaggacagtggggtaaacactggtcactaggcttctgtttgggaatcatgagggagaggcctgctttgtacctgtccacagtatttcactattcccagtgtcatctggggctgtggattaaacatggagctggtgaaagcttataccttgcttcaccttcatattaacttgctccatctgggacttaagtttttcaagctattgaaaagcatttctctcaccaggactgcttgttggcaagggcctgaggaggaaggcaagacactgttattgttcctaccactgtttcagtcttgatggcagtgtaggtagctattctttggtggcatttatggtaacatttaataacatttatggtaaagtaaaacaaagaaaatcccagagaccttatctgtaattaatgggaaatggtggcagtaagtggtgttcaaatgaaaggttcattgtttcacccaaaccagaccccactagggaattctttctttctttctttctttctttcttttttttttttttttttttttggacataggttttgagaattgagaactggatggtagaatgcatgaccttttaacagacgggaaaaaatgctagttgtagtggagtggatgtgataatacaggatgcagtcagccagataacaaatacttattgaatgcctactagcgccatgcagtgcactgaggagagcaagagagcttgcagttagtagtagaaaccatccgtgtcctgctcctggacgttgcttatcctacatcaatgcacacaggcccctcgtacaattgtcggcactctcattctgtgacaaaggggttggggaggaagagcagggatggagaggggactttgcattccactggggcttgggagctttttctggctgtcagagcccagttgcctgtaccctggaaatgctgggaaattgacattccttcggggcagccctcaaccatgactgacaggagttggtatataaatatctcacctttatcatcctgtgtgctggctctggaaatccatgctgtattaagttccactggcccacagtaatagctatcttgataatgaatcttgataactggcttccttctctgttcctatctcacttccccacacccctatggaggtcccatatacatgacttgcactccaatcctgaaggcatcttgaggtcttctgaggaacccaagctaagatccagtctataggggaaggcagacatactgactagtgtgaagagggcaacaaggtgaagtacaatttgtttccagttacaatcttcctgcttaattttctgtgtgacattcagggtcctttgttatgaagaagaagagacataggggaagaagtacttattttgttatatacagtgtggggaaaaagtttcattgttttattgaaaatggagaaatatgactatgaatccagccatgagcatgatgcctctgttatctgtaatgggaaaattaaagatgcttctgatttgtattaactgtaataaatgggccaggtgtggggcagagggctctgctgggcagcaaagagaggcaaaatgtgatttacaatatccaaggccttaataatggtttcagtaaccttaaataccagtttgataacttgataaataaagctctttgttagattataaaaataaaagcaaaaagatcaaaagtaatagaattggggctgaaaaaattattttccaggcagctactgaccattacaaaattccttctttctgtttatagtgacgggccacccaacctccaagttatttattacagtgtaacagctgcattctatgtgtatgggtgcattacctaaaatcccttatgctttccttcaataatgattttattagcatcagtgattgtgtctgtattgagtagtttatagcatatagtgagccatgctgttcatctgtagccaaagctcaaaaagtgttagtaaagcagtgtaaaggaaagctatttcgctttgggctcactggctcaaaccattgttccctctgttaacctgttatttacctagtatggaaacagggtgctgctgagcagaaatgagcagtgggaacacttctttcccctcagaaaacaggggaaagaagtgctaatagcatccggggtaaactgcactaaaaatcttgctctaggctggtcgcggtggctcatgcctgtaatcccagcactttgagaggctgaggctggtggaacatttggggccaggacaagaccagcctggccaacatggtgaaatcccgtctgtactaaaaatacaaaaaaaatttacagagtgtggtggtgtacatctgtaatcccagctactcgggaggctgaagcaagagaatcacttgaactctggaggcagagattgcagtgagttgagatcgtgcctgggcgatagtgagtgagactgcctcaaacaaaataaaacaaataaaaaaaagtcttgctctacaggggcataagggggcatagttgccagtcaattcagtccctgtgtactggcctttcattgtcttgcctctcggctagaagacagtgttgtcccaaggttctcccaggcagggaggaagctcaggaagaaagactgggtttgagcctctgaccaaatgcttgccaatgtgcaggaaatagattctgtccgctccacatgaaggatctcttctgtcatgttcccttttatccaaatatgtggaatgtgtggagaaacacattaagtatccaacaccaatagcacattagtgtagcttagttcatcatgttccctttagagaagaacctttctccttctgggtaacagtataaagtaatggtggtggtggtgtttcctgcagggagaataatagacattttgatgcgacagattctgtgtaatggagaaccttggctaacagagcttgctgatttcacagaaaataatttgatttctgaaatcattatttaaggagcacatgtctttttttaatgaggactccacctgctgtacagggaggagtaaaggaaagatgccaggaaatgaaagcctggtgaaggaaattagagatgactaagtattcttaagaagccgcatctaacactaggcataaaggctggcattggagaggggccagcctgagaacaggagctgactgtactccttgtcaactccagtgggcagaacctagtggagaggaagctgaaaaagggcagttgaggggataaaagtggatagaaaggaggctattagttcagagtctttaagaataatttgtgcttttacactgcagctgttatttaagttaagggaaccaaaaggaggaaaagaaaggacagaaccacatgtctgcttttagaagagttactgataaagaacacagacctttctctgtcacttcatcatcaggctttatttgttcactgcataattccctctggtccttgctcctctgtgagggcatctgatgaattaagctacactgatgtgttattaggtactatacattcattgtatttctcttcacaggtagtatatttgtatttcaaaggggattcaaatttgaggaaataatttatcatgtgacagtggtaaacaattaggtcaaaaccaaattttgccctccctattcctgtcacagatccattagttgtgagctcaaaaaacattctctctccagatttctgttcaactattcatcacattacttaaacatgtggagtatacaatataaactattatcttagagaggtataaagaaacaacaaaggcaaggtacaggactgaatggcagagatatgtgccactcactcctaccaaccccatgcttggatgaaggcatcttcagaagctgtaagtttcatcactgtatgacatttgaattgatcatcagcaaaagacttatgtggaagtgattcactcagagctggtttcttgccagagtattctaggatacaatggattgtcccggagcttctctatgcctgtggtgccttgtcaggtgaccacctaacataatttatattctgaggcactaggcagggtacgagaacaccaactttcagccaacagtgaacaggtttatttcactgtgctttaaggtagaccagcgttgttcagaagaactttctgtgatgcagggaatgttctacatctgtgctgtccaatacatagccactagccacctgtttttgaacacttgaaatatggctagtttgactgagaaaatggaatttgaattttatcctttttaattaatttgcatttaaatttaaatagccacatgtggctagcggctactgtcttacacagtgcagaagtagaccttggaaaatgaggaaattgaataattagcaacttttatctttaacattaaagagaagcctgttagcctgtggtcacccatttaaatcactgtttttcctggtagctatgtatgtctgtgagtttgagtgactatgatgtgagctattgtttctccaggaaacatgtaaatttggtgttaagggtagagtccccttgccctctttttcagcctctagtaagactaacaagtagggccgctttctcttccatatgcagcaggcattgcctcacaaagctggattgggctttttggtaatagcaagaagctggagtctttccaaaaaataaaagctttccttaaagaaaagacattctctaggtactggctgtggaaataagtagaggcctcttaagtagaaataatggcagcccttccttcaactctccccaggaatgacagcattagtggtttgaatacattaaaggctggatcactctatccccactccaggcggatcaagcatatacatatttttaattccttgcccttggtcaaccaacaaaaggggattgggactgaaatcccatgtgcgtctccttggaatttaaagcccactttgctgagacaggattaggcaagataaaggaaaaagcaagaaaatgaacacaaacacaattagactaaaccagccctggagttaagtcatgtgtaatttccaatagaaaaagatttaattatgctgtcatgaccaaaatcacttattaagtgcccatttatatgtgatgctggactgagaagatagacagaaaaagtcagacttggtttcagcccactagacatacaataatgaaacagagagatattcaggatgggaattaaatacattaatgaatatttacattcaatgcaaacgtagcccccatagagcaggcttgaaactcaaataactacagaacaaagctctggactgttctcacttggatgtgttggatgcagaaggttgggggaggaggatgaaggaagttacttggatctgttattctctctgtgatatacataatgtgctatttgtccaatggggaaggtatatgggtagtggcaggtggagagggaggaagtccaggacttatacagcctggaagctgttctccttctgctccaaaccagagaaatacaaccaagcctgcacctctctctgcagcgtacgctaatgtaggtcacagaaggtgtgtggaagagagagacagcaagtgagtagttgaactccatgaaccaccaggagtccctctaaacggggtggagcaagggttttcccaccccaggccattgagataagagaggcaaactaggcttaaagctaagcacaaggctaaagaccaagaaaccaactgaaggcacccaaaagtttgccaaaccaaaggagctagaggtgcaaagtaggtatgaagtacaaagccaggaatgtagaaaccaagaatatgggtgaaagaaaatgggttgagaaaaaagagataaatttggggcaattacttagaacagttacaatcatttgaagcttgtttttaggctggcatatgctgaatttgaaaagttagatgagtcatggaggtaatgacaagtggtgactttgtagggcaaaaattggaacttccagcattgaaaaaatctgtgcaatagccaattagaaacctagagctcaaggatagtccatatccaaaccaaaatgtcacctttgtgagattaggaaaataaggtgtgaaaattctccaagtgtgctggctctgatacaaagaagtggttcttccatcacagaatggtgtggggcatggaacagcctggaacacagacaaaggctaagaagaagaaaaatctaaaagaacacaggatctttttctgaagtacaactccttaaatgtcttacctctctaaatccaatgggaatttttcaatccttgcttattttcttggtcacatttgatagtatggatcagtgttaccctcttgaaaacttttggcattggttctgtgacatcacattcttctggctttcctcctcacttgatatcagtcttttatggagtccatagatgccttaagacagttgaatgaacttctaaaattgtgtatgaaatattgcttgtttgcacttgaacatttttttccctttggaaagggggttttaagctttctttggatcctcaaagtagtccttcactcaaaacaagttaagaatcactattctattcactcttcttggatgaggatctccttcttttctgaggctttagttagactctatatgataaaaacatctgaatccatatctccagcctgtttctttcacctgtgctttagatacatatatctaactctctactagaaaacaccacctggcacataaaattcatcgtgttccagatcaaatttattattttttcctactggcctcaattctcctcctctacctgtgttttctactttgattaatgatattatgttttcttaagtttccccaaaagtagactttgagacaaagatttgagtgtagtatattttagagatgatcccaggaagcattgtgagggaggagggaagtggggttgggaagggaagatggtcaataaagtgtaaacaatcacaccagaaaccactgtgggaaaccaacacttattcctactgagaaaattctgtgaacactatagaacatagactaaagctgagatatttatacattagctcctatctatcatttgttgaggactgctttccatgggtgttacttctccagcactgctggcctccagcatggatgggcaaaatgtgcttcagtggctggagaaagacctcaggtgaaggaatgtaggggctgggagctggaaatttgtgtggcattttccaagggggtaaaggcaagaagacatgagtggggcaccaacagcatatactacaaccatccacccagttggtcaggttagaaacctgaacgtgatcctttatttcttgcctctttttcattcctcacgtgcaattattcagcagggactgttgcttctatctctgaacatctctcaaattcatctacctctctctttaatccctattccctgtcagttcatgctaccattttctttcacccagacattccacagcagccccctaaattatttatttttaaagagagggcattttctctctctctttgcattcttgtctcagttcatgagatgggaacttccgctggcctttctcccctcagggaaatgctggtgaatgccaacactgctaccctctccatgaagtttagtggaggagactctaacagtttttgattcctctccgctcctgacttcaatgccccacaaagagtattgaatttatctgagggatggtattggggtaaaggtcattgttcagcatggggctttctctttctcacccaagcaatgccctccacctgtctgcctatgaagcagcactttctcctttccattcctgcttccatgtggtaaactaaccagagaaaggcctctccaccttaatatggagtttgtatgtttcaaattcatccagttggataaactcaattcaaaaggaggaaataggaggagccattagaacttgggccccagtgtccatcagggaaatgtaagtcaaaaccacggtgagatatcaattcacacctgttagaatggctgttatcaaaacaacaaaagatagtaagtgttgcccaggatatggagaaattgaaacatttgcacacggctgatgggaatgcaaaatgatgcagacactatggaaaatggtatggaggttcattaaaaaatataaaatagcactaccatacgatccagcaatcccactgctgggtatttatctgaaagaattgaaatcaggatcttgaagagatatctgcactgtcatattcattaaactactatttataataaccaacatgtagaaacaacctaaatgcccattgacatataagtggataaagaaagtgtgttttatacatgcaacaaagtattattcagcctcaagaaaaaggaaatccttccatatgtgacaacatgtatgaaacttcagggcattatgataagtgaaatagtcacagaaggactaaatattgtatgatttcatttatagtaggaatctaaaatagttaaactcatagaagcaaacaatataagggtagttgtcagtactcaggaggaagggtaaatggggagttgctgttcaatggatatgaaaattcagttttgcaaggcaaataagttctagagatctggtgtgaaacattgtgcctacagttaatagtactgtattgtacacttaaatttgttaagagggtggatttaagttaagtgtgcttaccacatacaaacatgcacacgaaagtgtccggatgtggacaataaaatataggatcaccctacatcaaaactgtacctccccttggcatgacttacttactctcgccttggctttccttcctcctgtcattgccaatcttcttcccctgctctctcaactccagcctgtttttctcctgcattctgctctgcctcacctctgtgtgccttcggctggaatatgcttccgtgcctgctgcctgattcattagctaacccctactgttttttgggtcatagctttgttatcactccctttgggaagtctttcttcaccatcttagcctaggttactgctcacagcactctgtgctttccctattatgacatgtgtcacactgcattgcaattgcctatgaagctatctgtacccgtgctagactatgaactccatttagacagggattgtgctctctttgtcttactgtgcccaacacttggtgtaatttactctctgcacactttagattctcaggagattcttgttgaaaaatttaaatgtatagaaaaccaacgtgtaacctcattatttaagttccatagtttgttaatgtagtacaagagtcagatggatgaattttgcagtacatttcttaacaattacaaagcactttaaatacaaaattgcctacataggcaatgggtaatggctatgacctggagtgggttgaaaggacttgaagaatgaattgacttgagaagattggggaaagcatggaggacagatccatgaggacaatcgagtgggccaaggcacatagacccttgacttgaacctagcatgttcaaggaacagtgagcagagcagcttggctcaaaaacactagatgtaaatcaatatggaatcctaaaatgtgcttaagtaacccataggaaggcaaggaaagataaacacaggaataagaaataaaggaaacaaatagaaaacaagtaataaaatggcatgcttaagccctaacatatcaataataaccttaattgtaaaatggtgcaaatgtaccagttaagagactgagtgaacaaagaatataatccacctatatactttctgcaagaaactcactttaaatataatagtatatgcaggttgaaagttaaaagaatagaaaaacatataccatgtaaacattaacatttttttaaaagcaggagtgattatgttaatactggtcaaagtacacttcagagcaaaggaaattaccagggacagatagaggcattacataatgatgaaaaaaatcaatccactaaaacataacaattctaaatgtgcatgcgcaaaacaacagagcttcaaaatatgtgatgcaaaatctgataaagctgaagataaatgtgtaagtaaacgcataattatagttggaaacttcaacactgtactctcaaaaattggtagtactacattaaaaggttaagaaagaaatactgtgtgtattagagttttccagaaaaaaagaaccaatattttatacacataaatattgtgtgtgtgtgtgtctgtgtgtgtgtgtgtgtgtgtgtgtgtgtgtgtgtgtgtgtgtgtggaggggagggagagagaaggggagagagaaagaggtttattaaaaggtattggctcatgcagttgtggaggctgagaagtcccctgatctgccatttacaagctgaagaccccagaaagttggtggtgtagttctaaggcctgagaactagagggccaatgatacagagtgcagcctaagtctgaaggcctgagaacaaggagcgctgagggcaggagaagatcgatatcccagagcaagtagtcaggcagagggaccatgaacccaatcttcctccacttttttgttctattcaggtcctcacctgattagatgaggcacatccacaatgggtaaggccatctactttacttaggcctccaatccaaatgctagcttctttagataacaccctcacagacacacccaaaataatatttaatcaactatctgagcatctcatggctcagtcaagttttatgacacataaaattaaccatcacattgtgaacaactgtataatcataaattcaacagcttagatgaaacaaagtaattcctcaaaatgtacaaactaccaaaactcaccaagatgaaatagataatctgaatagacataaaaccattaaaaattgaatttgtaattgaaagctttttaaaaaagtagtctctagggctagacggtttcactggtggatcctaccaaacatgtaaagaactacactcattttactcactctcttcctgagaataaattattatggatgttttaagccactaagctttgatgtgggttgctatgtagcattaggtaactgaaacaccaggttacttacattctcttctaatggtcttattctttctgtaacccatgacaatccaaactggctccttccttgaagatgagctattatattaattacagagaatttgactggtgtatctgcagttgttcagtttctacacctggtatatagttgaccagtgccttacttacattgttctgttatttctgtttctaaatgtttatgcttcatcttatgcaatgttgaaactcttcctaggacacactgaagtaaagtaaatctcagagcgccctccagctattgtcatctcaaatccctctatctttctgccttaggcctctgctctgctcagagtggccatggagcatctttttatcttatggtaagggagaatcttaggttggtttttatggttataactgttatttactgctaacatttattgactgcttactatgtatcaggactatacatgtattcctccatagttgttatgtctgtgcctattggcagttctgggttggagatgtctgcagtccgatatacatgaggatcaataaggaaacccaagaaaatccttgctgggtcatccctcaagtcccaaggtccctaggcatttcaccttctttccacctttcagagttttcctatactcagttactgtgttgtgttatatacttggttatgttcaggtttttattttaattgtaagagagaagacccgggatgaatggagctactccattttggccagaagtagaaatccataaccatttatttagcttatgaatctacaatttggtcaggacgtatatctgccacttgtgttgtcagctggggtgactcaaatgggggctggaggatctactttgaagatggctcactcccatgactgccaagttggtgctagctgttggctaggagctgatccagggctgaggtctgggggcttggttttctttcagtctggtggccgggttctaggggcaagcatcctgttataaaagagaaactgcattatcttttataatggccttagaagacacatagtatcacctctgccttagtcaaaagcaagccctgattcaaggggagagaatgtagatacaagtctttcaatgggaggattactgaaagctcatgatagcagatattgttgtggccattttggaaagtattaatataatctgccatacccggaatcaaaatgataaaaggaacaggtaccctggcaggcccaggacagagatgattgctaatcctccctcagataagaagttcttaaatgaggaaagtttggaatttttttttaatgtagctattaagagcatgggcttttgaatcgcttgtcatgggttcgaatcccatctcccacttcttggttgtgtgcccttggacaagttgacttatcttcccacacctcattgtccttattttcagggtgatagtaacaataaatactaaatagggttttgttagcattaaatgggttaatgaatagaaaatactcagcacagtacctggcccatataaaattatcaagctatggtgattattgaagctttagatgtacatatcacaaatgcatacatcatgtgcattactagaattttaaattatatttattatataaatatatagaattacacacattatgctttaatcattattaaagttgaattcagttattttcaatgtacattttggttttcttcataaagtcctttgttaacgaatccctctaggtgtcattaaatataactaattcagacaggaatttccagaatggaaattgctgccaaggtcttggtgcactgagttgggagaggagaggaggtaagctcctctctcacaaaaagctggctgccttcattaaccacctggacacccatgactatcccacatctttcgctactgcaacacctacacagagtagatgctctttaaatgtgtcaatggctttaaattcccattaataccagtctctcagaaaactcttggttggagattgctagcaattacatatctaaaaatttctcagtagggaagagctggataataatatcacttaatcagaagataccagtggtctggctgtgactgtgtttgcagaagtcctggcatctcatcaatttctgggcctgctagattaagcaaatgcctgaaattctgatgctctgaatatgaactccttgatcaaccagttactctgatgcgggccccagataaatctccagggctctgtttcccttcctgcaaaataacattctccttcttcacctctcatttctcttgctgagtggagaaagtgatatctttatgaccctaagaggcaatgcatgatttagaatagcttagtaaagagagccataaacaatggttgggatgcagagcactcgctaccttctaatttatttcctctccatctgactttagatggaaaagtaaaagttgctgtttatttgcaggaacaatatttttatgtctcagctttattaagctagattttgagtctgtttaacataaatttctcagagttaaacctcaattccaactagattttctaagatggaagtataaattaaatgaaagttggacagggtaaatatttcagtaaaagtatctatactgcagtctctgttgaggctttgggtccactgtgcccagcatactcagaagaaggtttgtaggccctctcccctgtcactcagactctagtaaaccaggctgtgttgacctgccaacctcttcatattatgagatgcttcctacgccagaccttcccttctttctgccgctattgtgtgtgtctagcctactatcttggtttggttcatcttctccccacccaaaagcagaccctgagatggggatttagaggaatattatttggaacaggcccaggaaacatgtgagggagagagaagtgagaaggaaggatgccaataaaaggggtattaatgagagggttacctctgtgggcaactggggaacattcctactcaggatcccctgagaaattgtgtggaacactcctcagaattgagaagcaagaaatggggtgtttatctcttatctcccgtctctctttggttgagggctgctctcggtgctgttaactccctgacaatttcagcctgtcctgcaggtaggctgaaaattgttttgcagccatagaaaaccctcaggcagagtcacaagtgtttgcagtagaaagtcactgtaggtgtacagatgacaataaggaaactgtccaccgaacctgggtgggtcaagggaatataggtggggcaccaacaaagcagctgcaatacctatattctgcttcctttacctcttctcactcccatcttccaccccaacaccaggcccattcttaccttgcctttcaaatctcatttcaattagctcagttccattcagcgacattccctattgtctcacaccatccaaactcacatgtttaaattacctgcttggccttcgtaggtgtttactttgtgatccttggaataaataaaagtgtagacatggctgttaatggataaggctttggggagccagagtaattgatgtgactgtgggtaggaatagcagaagtcgagactaggaaaggagactgggaccaaatcatgaggcctggggaattttgttaaggaatgtgagctgtgttatatatttcatgatgaagtatggattttaagtagtgtgatcagataggcactggagataggtaacttcagagaagtatgataggaatagtaatttgtgtgtgtgcaagtgtgcgtttaaatccctctgggtgattctgatgtagctcctagttttgaggcccattgacacacaggatgaaagggtggggaagccgttgaaaggcagacattagtgaggggctgtgatggttagttttatgtgtcaacttgtctggactatagtatccagttattcaatcagacactaatctaggcattgctgtgagggtattttgtagacatgattaacatttacaatgagttgactttaagtaaaggaaagtatcctccataatctggggaggccttacccaattgactgaatggccttaagagtagaactaaggtttccttgaggaagaagaaattctgcttgtggacagtggtgcagctcctgcctggtggctccgagtctgctacctatctatagattttggacttgtcagtccccataatcatgtaagccaatgtcgtgaaataaatctctcttcctctacccctgattgtttctattgctctggtagaattcagacagacatggggcattgacaaagttcaaattgatgaaaatctatataggggctgtgggaacagagatatgaattgtgtttaagagacatttttgagatggaatctggaagttagatgtaaggcttaaggtaagggtgagaaatagaaaaaaaaataaggtaagatttatagtcctggagagtgcatggatggttatgctatgaatggagattaagaactcaggaacgatgacatgtttgggatgggaaagaagccagtacctggggacatggcaaatttaaggtgcttgaggaactttgctattatgtccagctggcatttgaaaattagtctgattctcagggtggagctgtctgggctggagagaagaatatgatcgttgaaagaatgttctctttttcctaaattattcatatttccttttttagttcatttctattttttcatctttttttttcatgacaactgtttttctcaaatatctgttgatctttggagatcagttcataggcaggcagaggctgtattcaatgcatatactgtgtataactgtggggggtaggatgaagacccattgacatgtgtacctaagacaattctttaataaagtacccagagcttttccattctttacattaataggctctagtcttgagcccttgaagatggctgacatattttaagtttctgtttcctgccttccttttccataaattcaatcccatgtgcttttccttcttcttgggtttcaaaatttttagttcaattccagttttctttttaaatttcttttcttgtgttatgatttaatattttgtatattaaaaaattgtatttttctttcgttggtatcttagaggagaagtgtggtggatattctacatttgcctctccagattcacattacgcccaactctgccctgctctgtgtctcaggagctgacctgtatgagctgcatcaataggcccttttgccctccatttgggttgagttcagctaacagaaggcattgacaagagactggaaggcaggaaataagagagaggttaggtgaggccaaaatttggtaagggcttcattactctacctatagctcctattcaacaattctctcctacagccacaagtctcatcaggttctggtaactgctctctccccttgcccactccatgctagggatggtagtagcttagtattcttgctgaacctggggtgcttcactattccttgttgatttctcttaatcctacctataccttgtaagagtcccttaactgaactcttttaaatcatactttttgagagttccctctaattcctgccagaattcagacctatacaggagtggagaaagatacgtgaattagaagcccagtgaaagagataatgagggcatttggaggttttcaatacctattatttaacttgaaatgaccgatttttccatttttttattgttgagacacaatctaaaagttaaaattccaacactggaatcagattgcttgggtctaaatactaattccacaggtactagctgtgaatccttggaaatttaccttaccattttgagctccagtttttttgtttttaaaataaagatcataatagtatctacctcattggtgctattgtgaagattaactaagttactgtaagtgaaatgctcacaacagctcaaaaaagacacattaaatgttagctgctatgattatagttgttatcactattattatctcttcttctcattctcctatctaacatgtaataggcagcatgactcagcaccgcatttagatctagaaggactattttctttacaacaggctgccgctttggtttcctgtgcaaaattatttagctgaacagagagaaacttaacactttcatcaattctaagaagttcccacgttcattccatttgttgtacccagcatgctagtgcccgtgccaggattcttgaattttcggtcttctttcttcttttcaaccctctacaaccaggcaaaattctaaattatgctctctaccccagtaaaggaaaacagggcttctgttgcctaaacttgagtgcatgagtttggtgagggagagttctagcctctatactctggtgtcatatgcctgtttcgtcaagcccattctcttctcagtgtaattggtttcatgcctgacggagatggaaaatctagggattttacagttttcagatctgcagctaacattctggagactctacaaacaagacacgatggagtgtgaattagttactactcaatgatgttaacagaataagaatccgacttagtcaaggttcttttagttgtaagtaatataaacccactcaaacttgtttctgccaaaaggaggaatttattatgagaatacaaggataaccacagagctcaagggcaggaagtagagctaagcttctttgtgaattggaaccatgagtagaaagctgtaacagcaggtttagcttgtctgtctcactgcttgttctcttcctatgtggctttctcactctttatctccatgcgtagaaggtaataactggcctgcagttcacacatttacttgtttcccttccagccacaggaagagattaaccagctattcagaatctcaattgtatattccaaggagacagactgtgattggatcagtttgggggcaatgtctatcttggatccaattagctgtgatctgaggctcaaggtcacataatacaatcatggctttcagagtcctatctctatggatgaagggagcagttctcagaagaaaaaaatggataattttgggatagatggagatcattaaaggtctctccttcactttcattttcctctttcctctattttttcctagtctctcatgggagaaaccaattttcttatatgattaaaaaaaattaaaaaactcttttcactcttttaataatttctccatactactaaagtaactgaatgtgactcataaattagatcttaaattacaaaccaccaggatcttggaattttctggaactagagactgtagacattaagggttcctggcaatttaaagccaagttttgtgttcattagtttgggtatttagtgggtattgcaaatatcattatgctttgtgaaaaagtcaaagtatcttcttggattttattatttcttctagagactagcttgatggaatgtttgtcatgttattgatgtgctgtggtctgaagtgagaggtcagtctcccagttgggatgcagttacttccttagttcaggatgttgtaatgttacagtaggtagtcaggcagacacgagcagggcagggaagcaaccgccatcccaccaggaatgtcaggcaaccatcaggtgatggtcaggtggttattaagctgtctctctaaaataataattggttgcagccagtgccagggaaaggcagtctcccaataaacagaaacacctgaaactggtgatcagcagcttcccaatatctcaagagttgggtgaatgggctgaagcatgtgcactaagagtcaaaatggcagtgtttaactggtatatgaccttctagggatgtttgactggttcctatggagaggaagaatgcctcaagtgggcatgcatacaacttcagtaaacacaccatgcatgctcacttcccaagtgctagcaggccactgcacatatggacagcccaccccaaggggagaagggacacaagaccctggaagcatgccagcatataaaaccccaagtcaaaaggtcaaaccatgcacttgatctcgcaagtcacctgttggccctcttccaagtgtactttactgcctttcattcctgctctaaacctttttgataaacttttcactcctgctttaaaacttgcctcagtctctccttctgtcttactcctgtcagttgaattctttcttctgaggaggcaagaatagaggttgctgtagacccctatggattcactgccagtaacagtaacctatttatggcctgactatagtttgttcttgtgagttggtaccgtgagtacagcctggctgtaagaataggatgaggatttctcagcagtgacaacagtagtggcagtagcagagaagaaagaatgactatgtgatacattgaatactcagcagtatcttacagaatattgcaagatatccatcactttacgtgtgtgaaggcagataatcatcattgggcaaaattcttcatgattttgggatttgtatgttggtgaggaccttaagatagtacttggaacagtctcaagaaaaatgacacaggtttctaggtacgatcttcccttctttccaggttggcctgttttcactttgtgtttttgaagaacatcatgcacttgtcattttgctcagtgtcaatcccaaagcatcagtgtagtcatgaaagggtaatctctttcagcagactgaaaaggaagacctacaatatggggaagatgaaactctgttgctttacaatagtcaagctgtacatcaggggcgatctgattaaacaacttggacagagagacaaagaaactgctgtgagctctctgtggagcacctttcactttagaagtttctcgttcacaagagtcatcttctgtctagcaaatagcaccaacagcaattagatactatgcattcaatggatattttatcttctgccttttcttatttgttttcgttgttgaaataacaagctttgaaaatatcatcgatgtcagaggcatatgccttgaccttcaccactgggtcctgcaaacccacagggaaagcagacagcacagtgagtgagggcttgatccaacgcgggattttaatttatcgtttctggaaaacaaactgtaaaatggatgccataagaggtacgagtaggtgttgctgctgattagtgggtttaaccacatatatcttcttactggccgagtaaataaagtcaccacccagagcatttaagataataaaccatgagaaaccataaagtaatgaaatgtactttttctactaattatctagcactgcttttacttcactgtggttgagtaggggagtggtttttatgaggttgtattatacattttttaaataaatgtttattgagcacctactatgtgcaaaggattatcttaggccttgtataaataaacaccagcacacagagaggtataaaaagggacaagtggcattacaagtagaggggtgagtgtagagattctcatttatttcttgctgcctttgtctcacgctgattcttcttttttcattgatctgaaaggacatactggtaacatgaaagctcattaatttctcctgatccccttattatttctgtggcaaagaagctcttagaacttgtgctgactggagagtggtgagagcctccttgctgataacattctcctaaggcctgggtgtaactacaagagaaaataccactttagtccaggaagcatttgaattgattttggtgcacccacactgacttcagtaatacaccattctctagagcacaggctttcaggaaactcaactgtgatggatgccatgatgtgctgattgcccttcagaaatgaagcgcttactcctccagttgctgggagtgctgcctgcagactgtcttcagctgtcagcctttttggaaattgcctccactgaagaagactgcctcacctgagatctcacctccttcctggggaagtttgtatacagtgagcagtgtacagacatgaaagtccgacctccttgttttaacctgatataaccctgaagggccatcccagatccagagctaccctagggttggctgaaacttttttgggctttcagaacagcctaacttctccttatgcccactcttgcttccttcccctcctcttcacggggctgaacatctaacacggcacctaatacatgtcgagacatgctcatctctgtctcaaattctgctttccagaaacccaaactgtgatatcaaccctccagaacacagcctgaactcagaagcaggtaggaaaggaacatgagaaactacaatagtcatcatgaagctcttacgcaaaaggcttggggaccaggcgaagcaaaatagacacagaaataagtaaacaaaatattctctgttcctgtgtgggcttgatgagtgcctggacagtggctgaacgatgctaacgatgtctccacagtgtaatgagaactggcagattgggatggagttgggaatgggcatgaatgtggtagcactttgctggagtagttcctgtagctgtttgcaagcagaaagactccaaaggtaggatctctgagcctgatggctatgtgtatggtctatgcacctttctgactaatgtatttgttagttttgaggattgcatatgcattctgataccattagcatatggtattaagaaatgcctgtgaaaactctggctttttagaaaggatgaagggtttgaagatataataaaggaaagaatgaagggaaagaactgcctctaaaaattttaaagggtgggaggatatggtagaaatctagctcaatgatgtgtataggcacctactatgttaataattgcttcaaggctagtgttgggaagtggatgatggagtctgaggagaaaagtcaaacattcgtgctatggaagcggctacattgtctggggtaaatacccggggttcgtattctcctgccaaaatatttaggacacgaacacacacgaggagtttaggagcagaggtttaataggcaaagagaaagaaagagaatggaaaacagccctgtctctctagtgagagagaggggcttttgagaggaaaagcctggccagctgcagatgcaccagattttatagtcaggctagaggaggtggtgtcagtttacatagggctcacagattggttggatcaggtatggcgtttccatagcatggggaaggctggctgccccaccctaatcttattatgcaaataaacttgccccttgactggcaccatattgtctgttccttactgtactcatggctgacaaagagaagggaagatggcgccaccattttgaacatgattggcacaactgccagcatctatgtctgcagcttgattttacaggctgttctttgttagaaaggaaaatgatttggggctgcatttcactgaaaggaaatccttaccgaggacttctgtaccctcactatctgtgtgagtaatttcttcttaactcctgtatcacagtggaattagagcatgatgttggaaaagtaggggctgcgtcccatttgttcacctttccatgactagtgtctagcacagcctctggtacatagttggtggtcattacatgtttttagtgtgaatgaataaatgtactgtgatagtaggtgattgtaaatatatgaggacttcaggagaaggaacatattatggggttgaattaggaagccttcatgggcttcgagatgggcataaatggtagtgaaagatttggaatgggaaagaatagtattctaggcagagaggctggaatttgagggttgaaaataaaaaaatgtttataggagaacaagttctgatttggtgaccaagaaaagagaagggcctaaaagtaaggtgagatcagtgaagggaggccataggggctccatctggccttgatctgatgatcaatgaggaaccatccagggctcttcaagagaggacagaaagtggaattttacaaatgggtatatctctatcttgttttataggatttgtgttttctagttatcatttttatcaccatcactatcactaccttcaattaatatttaatacacaatctattaaaaaataatcaaattctttgtcaaatttgatgaattgaccacatttcctctttctcccaacaccaaaaatgatgtgatggaataaaaatgtgtagactcatggcatgaatagaatgatagggaaggctggagcaggtgagatatttcaacacatttctggaagacagaaaatgcatgcaagagtttatactaatgaaacacacaaaagatgccatagctcatatcgtacacggaggagccacagttagggaggactgaacctgtcctgctgaactacaaatatgatggagagttaagggcgatacataagggattaattgaagtctggatatgaaacagaaatctcacccatccatcttgaaggtggtgcatgcagtatgtatatcactcaagcagaaaaaaattacagaattctcaaaataagtgaaatgtctctggattaaaaaaaaaatttctacattctgacatttaatggctgcacaatcaatggtctccaaatatgcagaactcctctcatttattcctccccctgccaagtgggcatttaaggaaaatctatactatggagcagagacacttagataaacaaatagaaaaatataatttcgaggtgagagatacattgagaaacaaaagacagtttgaaactcagaaagaatattatattaacaaaacaaataatacaggatactataaaaagggaacaacctgagaacaagaaagaatgcttagaaataaaagaacattgtgaaataaaaatatgtataaaagagttgaaagatatgataaagaaaatattttaaaaaggagaatgtgtctgtcaggattttaccagggaaacagagccagtaggagatctatagctatatttatctatctagaagttgtcttatgtggtggccaggcgcagtggctcacacctgtaatcccagcactttgggaggctgaggctggcagatcacctgaggtcaggatcctgttcgagactagcatgaccaatatgacgaaaccccatctctactaaaaatacaaaaattagctgggcgtggtggcatgtgcctgtaatctcacctactcgggaggctgagacaggagaatcacttgcaccctggaggcagaggttgcagtgagccaagatcacgccattgcactccagcctgaacaacaagagcaaaactccgtctcagaaaaagaaagaaggaaagaaagaaagaaaggaagaaagaaagaaagaaagaaagaaagaaagaaagaaagaaagaaagaaagaaagagaaagaagaaaagaaagaaaggaaggaaggaaggaaaggaaggaaggaaggaaaggaaggaaggaaggaaggaaggaaggaaggaaggaaggaaggaaggaaggaagaaactggcttatgtgattgtgggagctgactagataagttgaaaattcatagggcaggccaataggaagagtaagctggaactcttgggcaggagctgatgcagccattcacaggtagaatttcttcttcttccttagagaaaccagttctgcttttaaggcctttcaactacttgggtcaggtctacccagattatgaaggataatctccctttcttaaaatcaactgattgtagatgttaaccacatctacaaaatacattctcatcaacacccagattattgtttggataattgggtactgtagtttagccaagtcaacacatgaatctgaccatcacaaatgacaacaacaagaaaacagataagacagaagatccattcaggaggtctaacctaactgattaggcgtttcaggaagagaaaatagagaaaatgagaacggaaaggttatcaaactaacaatagagaaagaaaaactaattccaaaactgaaatgtcaggagtacaaatatccacattgaaaagcctattgagtacccccggcagggaataaacatacaaataaacaaacagaaccatcatctagagaaatcaccaagaataaagttaaattcttaaaaattttcagagggtggagaacaatgccatacaaaaaatgagaatcagattggtctcagacttttcattatcaaccctagataccaaagggtaatagagcactgccttctaaggtatgagagataataattttcaacctataacttgttaaccaatataacccaatctgttactcaaatctgagggtagacaatttgagaaatttcagaaaacttgttttctatattacttgaggatgtactgtggtaaagtaagggtgtagccaagaaaaagaaagacatgggatccagtaaatggtgacatcccaggacagcagggaaggaaaattccaggatgacagctgtgccatcagaccagcgagatggagcaggtggatgaaaaactgagagaaggagctttccttaaaacacacataccacacaacaccatgataggatggagagtttaatcatttgcttgaaagagaggcattgcaaaggcgatgggaagaaactattatttttgttcccaacttttatcttaagttcaggggtacatgtgcagcatcacgtgcatcaggggtacatagtgcaggtaaatgtgcactatggtttgcagcacaagtcatctcaccacctagcccagcatccattagctattttttctgatgctctccctcctcccacccccaaccctccaacaggcctcagtgtgtgttgttccccaaccatgtgtccatgtattctcatcattcagctctcacttataagtgagaatatgcagtatttggttttgtgtttctgcattagtttgctgagaatagtggctttcagctccatccatgtccctgcaaaggacatgatctcattcccttttatggctgcatagtattctatgatgtatatgtaccacattttctttatccagtctatcattgatgggcatttaagttgattccatgtctttgctattgtgaatagtgctgcaatgaacatacatgtgcatgtgtctttataatagaatgattatattcatttgggtatacattcagtaataggattactgggctgaatggtatttctgcctctaggtctttaagcaattgccacactgtcttccacaatggttgaactaatttacactcccaccaacattgaaaaagcgttcctttttctccacaacctcaccagcatctgttgtttttggactttttaataatagccattctgactgttgtgagatggtatctcactgtggttttgatgtgcatttctctaatgatcagtgatgttgggctttttttcatatgattattggcagcatgtatgccttcttttcagaagtgtctgtttatatcctttgcccactttttaatgaggttgattttttcctgtaaattttttcaagtttcttgtagatgctggatattaggcctttgtcaggtgcatagtttgcaaaaattttctcccattctataggttgtctgtttactctgaggatggtttcttttgtagtgcagaagctgtttagtttaattagatcccacttgtcaatttttgcttttgttgcaattgcttttggtgtcttcatcatgaaaactttgcctatgcctatgtcctgaatggtacttccttggctttcttctagtgtttttatagttttgggttttatatttaagtttttatccatcttgagttgatttttgtatatgatgtaaggacggggtccagtttaaattttctgcatatggctagccggttcttccagcaccatttattaagtagggaatcctttacctattgcttgtttttgtcaggtttgtacaagatcagattgttgtaggtgtgctgtcttatttctgggttctctgttctgttctattggtctatatgtctgtttttgtaccagtaccatgctgttttggttactggagccttgtagtatagtttgacattgggaagagtgatggcttcagctttgttctttttgcttaggattgttttggctattcaggctcttttttggttttatataaattttaaaatagtttttttctaattatgtcaatgtcaatggtagtttaataggaatagcaatgaatctataaattgctttgggcagtatgaccattttcatgatattaattcttcctatctgtgagcataaaacgattttccatttgtgtgtgtcttctatgattcctttgagcagtggtttgtagttcaccttgtagaggtctttcacctcccttgttggcagtattcctaggtattttattctttttgtggcagttgtgagtgggactgcattcttgatttggctctcagcttgcctgttgttgttttataggaatgctagcaatttttgtacaataattttgtatcctgagactttgccgaagttgcttattagcttaagaagcttttgggctgagactatggggttttctagatatagaatcatgtcatctgcaaacaaacataatttgacttcctctcttcctatttgagtgtcctttattcttttctcttgcctgattgctctggccagaaattccaatactatgttgaataggagtgatgagagagggcatccttgtcttgtgctggttttcaaggggaacactttcagcttttgcccattcagtatgatattggctgtgggtttgtcatatatggctcttattattttatgatatgttcctgcaatacctagtttattgagagtttttagcatgaaggaatgttgaattttatcaaaggccttttctgaatctattgagataattcatgtggtttttgtctttagttctgtttatgtgatgaatcacatttattgatttgcatatgttgaaccaaacttgcttcccagagataaggcctacttgatcatggtggatacgttttgtgatgtgctgatggatttggtttgccagtactttgttgaggatatttgcatcaatgtttatcaaggatattggcctgaagttttctttttttattgtatctctgccagattttgctatcaggataatgctggcctcatagaatgagttaggaaggagtccttcctttccaatattttggaatagtttcagtaggaatggtacacactcctctgtgtacctctggtagattcctctgtgaatctgtctggttctgagctttttttagttggtaggctattcattaccgtctcaatttcagaacttgttattggtctattcagggattcagtttcttcctggttcagtcttgggagggtgtatgtgtccaggaatttatccatttcttctagagtttctagtttatgtgcatagaggtgtttatagtattctctgatggttgtttgtatttctgtaaggtcagtgatgatatcccccttatttctgattgtgtttatttgaatctcctctctttacttctttgttagtatagctaatggtctatctattttattaattttttcaaaaaaaaacagctcctggatttgttggttttttgaagtttttttttttttttggtttctcctctctttcagtttggttctcatgttggttatttcctgtcttctgctagctttggggtttgtttgctcatggttctctagttcttttagttgtaatgttaggttgttaacttgaactctttctagctttttgatgtgggcatttagtgctataaatttccattttaacactgctttagctgcattgcagagattctggtacatggtgtctttgttctcattaatttcaaagaaattcttgatttctgccttaattttatcatttactcaagagtcattcaggagcaggttgttcaatttctatatagttgtgtgtttctgagtgaatttcttagtcttgagttctaatttgattgcactgtggtctgagagactgtttgttaggatttcagttattttgcatttgctgaggagtgtcttgtttccaattatgtgatcaattttagagtgagtgccatgcggcaataagaagaatgtatattctgttggtttttggtggagagttctgtagatatttatcaggtccacttgatccagaggtgagttcgggtcctgaatatttttgttaattttctgtcttgattatctgtctgatattgtcagtggggtgttaatgtcttctactattattgtgtgtgagagtaagtctctttgaaggtctctaagaacttgctttatgaatctgggtgctcctgtattaggtacatatatatttaggatagttcactcttcttgtcaaattgaaccctttaccattatgtaatgcccttctttgccttttaaaatatttgttggtttattaatgtctgttttgtcagaaactaggattgcagcccttgcttttctctgttttccattgcttggtaattttttctccatctgtttattttgagcctatgtgtgtctttgcatgtgagatgggtctcttgaagacagcatactgatgtgtcttggttatttatccagcttgctattctgtgttttttaattggggcatttagcccatttatatttaaggttagtattgttatgtgtggatttgatcctgtcatcatgatgctagctggttattttgcagacttgtttatgtggttgcttcatagtgtcactggtctgtgcacttcagtgagtttttgtagtggcttataatggttttacctttccatatttagtgcttccttcaggagcacttgcaaggcagctctggtggttaaaagttccctcagcatttgcttatctgaaacggaacttattcatcctttgcttatgaagcttagtttggccagatatgaaattctgggttgggaattcttttctttaggaatgttaaatattggcccctcagtctcttctggctcatagggtttccctgagaggtctgctgttagtctgatgggcttccatttgtaggtaacctggcccttctctctggcttcccttaacattttttttcatttcgaccttggagaatctgatgattatctgtcttggagatgatattcttgtggaatatcttactggggttctctatatttcctgaatttgaatgttgacctgtcttgctaggttggggaaattctcctggatgatatactgaagtatgttttccaacttggttctattctctctgtctctttcaggtaccccaattagtcatagattaattctcttgatataatcccacatttctcagaggttttgttcattccttttcatttttttttaaattatactttaagttctgggatacatgtgcagaatgtgcaggtttgttatataggtatacacatggcatggcggtttgctgcacccatcaacccatcaactacattaagtatttctctaatgctatccctcccctagctccccatcccctgacaggccccagtgtgtgatgttcccctccctgtgtccatgtgttctcattgttcaactcccacttatgagtgagaacatgcagggtttggttttctgttcctgtgttagtttgctgagaatgatgatttctagcttcatccgtgtccctgcaaaggacatgaattcatcctttttatggctgcatagtattccacgatgtgtatgtgccacattttcttttttctctattcttatctgcctgtcttaattcagaaagccagtcttcaagctctgagattccttcctctgcttggcctattctgttattaatacttgtgcttgcattgtgaagttcttgcagtgtgtttttcagctctaacaggtcagttatgttcttctctaaactggctattttggctgtcagctcctgtaatgttttaccatgattctttgcttttttgcattgggttacaacatgttcctttatgtcagcgaagtttgttattatctatgttctgaagcctacttctgtcatttcacccatctcagccacagcccagttctgagtccttgctggagtggtgttgaaatcatttggaggaaagggggcactctggctttttagttttcaacatttttgtgttgattctttctaatctttgagggctcatctgcttgtgatatttgaggttgctgagctttggatgggttttttgtgtgttttgttgttgttgttttctgttggtttgtttgtttttcttttaacagtctggctactctcccatagggctgccacagttttctgggggtctgtctggtccagaccctagttgccttggttcttcccatacctggaggtatcaccagtgaaggctgcaaaacagcaaagatggtagcctgcctcttcctctggaagctccgtcctgggagttactgacttatttctggcccaaacatgcctgtaggagatggctggggaccctggttgggaggtctcaacctgtcaggaggagtggtatcagggacctgcttaaagaagcatttaggctgcattttggtagagcaactgtgttgtgttggagatctcttcagaccctgatcagtttgggttctccaaggcccacaggctggaccagctgagaagcccgaatggccaaggtgacagcctgccccacccctcaggcactccatcccagaaagaaattagagctctgttgggctggtagagcacagatagagatggctagaggccctggctgggaagacccaccctgtgaagaggagtggatcggggtcccacttaaagaagcagtctggccacagctcaacaaaacaactgtgtcatggttgggaaccaattttgcccctgttgacttggactgtccaaagcctgcaggccagaaccactgagtcacccaaccaacctgggtggtggcccttccctcccctaggcactccatccctgggtgagatcagagatctgtccataatatgtgcaggtgggcaggcgtggctagaggtcctggctgcgaggtcctgcccagtgaggaggaatggattggggccctgcttagagaagcagtctggccacaatatggcaaagccactgtggggcactgctggggggatccttcctcgactggattatttggagtctccgaagcccacagacacaaatgactgagtcaaccacacagcagagatggcacccacccctccccttggaggctccatcctgtttcaggcaggctccgccctgttgccagtggctggctggaatgccaagccagtgagtcttattttgtgagatgctgtggaagtggggtccacagaatgatactgcttgagttcctggattctgcccccttcctaggggtatgtgtggaccttctgccttgcctgagttgcagacacgtttgttggggatcctggagccagattatgcaaagcttctgggcctatgcatgcctgagaaggtgctctgccaacttcacatagctctgtgtgtcagacctaaggtcctggtggcaggggatcatgaggggatctcctgatccatgatttgcaaagatccgtgggagaagcatagtttcccatgagtgcaaaatcattcaccgcttcccttgactggggttcccttggctctgtcattcctgagtgggccatcgccccaccctgcttttctttttcctctgtgggtcgagttattttcctgatcagtcccaatgtgactacctggatattttagatgagggtgctgtattcacttgcccctttcattcctctctgtgagtgctgcagacctcagctgcttctaattggccatcttggcccctctgaactctctttaaattataccctgactcttttgattattttaggttgacatttgatgacctgcagatgggacctgaagcaagcttcctacaatcctcactgctttgctgacatttggaactttagtacaggatgagtggctttcacttatttgacttcatcagagctgaagagggtctctggcatggcttctctcaggttttgaatctccctggttttggctgagattcatactttattcaggcattctgattccacactcaacaaaactggaattgaagcttcacttttaaaagtgggagtttcatttgttatttctttagagattctgctgtttgctgatactgttagtataatttggttttgttttgaaaggtcaaaagtatacgtgcaacaacatggatgaacgttgaaaacattatgctaagtgaaggaagccactcaccaaggaccacatactgtatgtttccatttatatgaaatctccagaataggcaaattcctagagacaaaagtcacattagtagttgccggggctggaggtgggtgggtgggggaatggggaatgataactaaggggtaaaggatttcttgtcaggtaatgagaatattctaaagctgattgcggtgactgatgtacaactatatgaatacactataagccattggattgtaaactttaaacgggtgaattgtatggcatggtatgtcagttaaatttcaataaagctgtttaaaaaacactcatgaagactaactggaagctcctcaagtgaaaaacatgctattatcttgtcagcctaaggcaatttttacaaaaggctctccagactatcttctagttctctaacctagatgggctacttgagtttgtatcaactactttcctttggctgctcacagcagttccgccccttggctgaactcccatctcagacttagcccttgcccttcagtctgtcattagtgcattgaaccttttcccctatggctcacactggttccacggtccttaccctcatctccaccagtcccaatactgctctccctcctgcctcagtctgctgggcaaatttctagcacatcatcaaatcagcctcccttgaacccttgcagatatcccccttacaaaatatcatctagtgctctcaacagagacaaggctaggagaccagtggtcagagatgctggagagaggggtttgagcactgggaggaagattgaattagaatgaccaatgcttctaaaaatttaatgtgaacacaaatcaactgaatcaactgggggtcttgttaaaatgcccatgctgattcggcagctctgaggccttaggttgtgcatgcctaataagctctcaggtgatgctctgctggtcctgagaccccactttgagtattaaggagacagaccatctctgaggtctattttagctcttacattccatcttatacttgaccaagttgatcacaggagacccacctacatcccatctgacgctgctgttgcagctcatgaacagctcctgcagagttctctctggaggctctggaagtgcaagttacaatgtaacagaatggaaaacggcttttctcttaagcaggataatattgctagcattaagagtcatatcaaccaaatatggaatataaaatatgatcaaagtaccatcaaatcatttttgtctcaccaaagttgattaatttctgaggaatgcttttatttaacttacatttaagtctcatttgttaaagaatggtatataaaaccatttttagaagttggcaaactgtgccaggagtaagagaaaaagagaactcaaaagtgttacgataatttttatttcaacgattgattcacaactctagaaaatcaaaagggtaaaatccataatttttagattacactaattattaccatcaccatgttattaattttattattattttaaattagaataattcatgaaaattgttttcaaaatgcatttgtacagaaacatgtgtaataataaacagtagtccctgatatcaccccttcccagttgcatctatttttaaatgattttgccccctttttctttgtagctacttccacattcctaaatacaatatatttttctactgtttcttgatgtatcagttgtacacatgatatattgacttcctctataataaatgagaattttgcttctgtatttcttctctcctcatcttactaacaaattcatatgcctatttcagttccactgttagttacctctgtagatctaagtaatacattttaattttatcaactagatacaaagtacagaatccttaactcctcactttttaatgagaatcttaaggatgctaccttttcttaactcttctctcacatgtccacctcctaacttttgcccccatacacttgcatttctatttgaaggttcataacaaccatgaacatataattcaagtaagtaaatcctctccttttctgtaagttaattctacaagtggaaaatcaaaaatgtttacatcattgtagctatgtaaatattgttcactgtcagacaaagtagtgttactatgacatttcatttctccaaagctatttcttaacttttcttattgtctttttattgcagtaatagaataggccctcaacttgagatattcttactcaaaaagtacttacttttttagttaaaagcctcagaaaattcccagatcttcttttcttaccttaacatagtgtcttaatccatttgctactgctataacagaatactacagactgggtaatttataatgaacagaaatttattagcttatggttctggaggttgcgatgcccaagatcaaggagccagcatctggcgagggtcttcttgctgtgtcatcccatggcagaaggcaagaggaagagagagagcaagaggttgaatttacaacctgaagtccttttataatcagcatgaatctattcctgaaggtagaaccctcatgactaattaggccccacctcccaacagtgttgtattggggaataagttttcaacacatcctttttgggggacatagtcaaaccatagcatatgggttttggacctgtttgaattttgttatgtccccaactcatcctttttttctagttcttagtgaagtttgagctcagattgctccaggacacaggataagaagaagcatctggctcttcaaagcttgctctggagtaaaagacctacaaatcttaaatgattatctgtgtgctggaaggtcaagactcctttcccttgcatcagtattttttaaactgcagctcactacccaatagtgggacatgaactgaatttgctgggtcacaaccaacattttgaaaaagtgaaatagaatgaacagacttcatcatccatagtaaggtttaagtgtttttaaaataatatgtatatgtatatattagtatgtgtgttctgattgcatgtgaaatatatatttaactgttggttgctattaaaaaggcttgaacaatcctgtcttgcatgctgaatgggtctcttttgggcctgatttctggttttaaagttgccctttttgatcagtgtataacacttcttggtactgaggagatgggacctcactgtgtctaacagagcctcaggctctacttctttttttctgaaattcatcttcccatgttaattactgagacctgttgtggctcaagttccctgtgggtttctgaacctcatcttcactgggactcctggtgggaaatggctggtctccctttgtgccttgcctggtgtattgaaaaccagaatagatcatttattgatcaaattatcttcaaagtagtcatgatataaaatgaataatactggccagaaaagaatgtagacagtgaacattttcttgaacttcaaatatattatgccagttttaaaaagtaataagaataaatattacagtacaaaaagggacaaaatgtatagatgaatactttttaattacatgactgtcatgttggggaaaaatggtgacatggccacggcacacataaagaaaaatgtctgaaagcattaataccaccaggttcacagaacaattttgttcatgaaatagcagaattgaagtaactcggtttctgtttctctgtatttataatcattttgctatcacttcttagtttgaatctactgtttaaatgcagagatgtgctgtattacaggggatggagcaaggaacttcatccaaagtgagctccattcacttagaactgttatcttctctagcaatgggcccatgtagctgagactacatgtgtcaggatgtctctataactgggagttctctgaattcatttccttgtaaaataccatgttgattgaagaataagcaatacaaaatgctgttttgaagtttatgtatatgtaacagttttaaagcttaaaagcaatcacgaaaacaagagaatttttttttttttttttttgcggggggagtattttcttgctgatttatttagaattgctagtacatggtgaaaatcaagcagatggactagctggtgttattattgttttaaaataatctataaacaatgtagtctcttattgtctgtacctgggattgactgttcccactgccttacctgtggtaccccaaactccaggaagaaaagccactcccactcttttattagttcttttgataatgtgtttagagtcctcaaatagaattagggaaatgaacctgtgaaacgcaacacaatgattcttgctcacagctagctcctcattttcttttggtaggctttaagccagggaacaggtttatggacttttcttggctctaagtttctactcccagcaagcgtgtatgtgtgtgtgtgtggtggtgggcaggggatggatggtaagcgttgggtggaatgaggaaaacacacggaagcaaatttggctacagaaggttcataggatgcacatacatgccaagtgaaaggaaatccctggacatccataatacttctaagatcaagtctaatcaaaatcttgggttatatttgccaatatacttgcaagtttacatgggtactgcctctttgcttctcaccgccatcctcagttgtttttctctcagttacaaacaccaactcaaactttcctcagattctataagcagagtcacaggttgtttggttaacctttgcttttatttttcttcacttttcaaacaggagaacatctgtgactgacttaatctgcctccagcgttataaatgtgcctttgttgcttacttttttacttgtttcaatggcaagggtcctagctttgtacacatgtaggttcccaacttaagtccacccagcctagcctaactttcagagctcaatggggggaggggatttcttccagagggaacaagttacttaaaatggaggaacagcttagtgctaatgaaattgtttcaaacaggaactctctggcttcaaactgtcttcctgtcttattttgagctcatcattctcttgcctgaattccatatgagaactagcctgggcttcttgatttctcctcttgttttatacatacttgtatcctgccatgtatccccgggcttccttctggccttagggccagcttggcctctgcttccccttcagattcagctagtggagaaggtactctcatctttcaaggtttagtttcaaggctgcgccttcaatgcagtctgttatcccagccaaatgccctttgtcctttctctacagccctaagtcccttactctgttattgcccaagtgacttgcacagcttgctgctctgcactgtagatatccacttgcggggtcgggggaggcatcttatgcagccaatggactataaaccatttgaaggtagagcctaacttattgaacaattttttttctcactatacaatgtatcatatatccttgaacaaaatgtatgcaccataaatttgcttagtggataaaaagtttaaaaatggaatgagagtcacaaaatgtatccctgcattaattgagtctgtgtgtatatgaagctattatttaaacattttccatgattctgttaatacaaagcaatgcttttcaaaacaacaagacaaagacaaatattccaatagataatgtgggaaataatgtgatcatttaaaaaatatgttgattagatatttgtgtttcttcttttgtaaaatgtgtattgactatcaatagcaatcaaggaaatacaaatcaaaacgacagaaagaaagccactttttggcctaactgagcggcaaaggtcttttaaaacagtgtaatacttagtgtttggaaaagttccatgtgggatctgatatgctgctgggagattgtaaggtttgagaacctttctgaatagcagtttgcatcaagagacttaaaatgtgcatattctacaaccattttagaaaactgtttgacagaatatactgagaataaaaatatgccatctcaataaactagtatttccactcctaagtattaatacatatccaacagaagtttgtgtgtatgtgtcccatggtgagcaggtctatgcatagctaccctgaaaagtctgaggaagttgaggggctgaagaaagaggctgacatatggtacaaaacgactggtacaaaaacaaacacatagagcaatgaaacagaatagagagcccagaaatcaggctgcatacctacaaccgtctgatctttgacaaagcagacaaaaaacaagcaatggggaaaggattccctattcaataaatggtgctgggataactggctagccatatgcagaagactgaaactagaccccttccttataccatgtacaaaaatcaactcaagatggattaaagacttaaatgtaaaacccaaaactataaaaaccctgaaagacaacctagacaaaaccattctggacattgggcaaagatttcatgacaaagctgccaaaagcaattgcaacaaaagcaaaatttgacaaatgagatccaattaaactaaagagcttatgcacagcaaaataaactataaacaaagtaaacacacaacccacagaatgggagaaaatatttgcaaactatgcatctgacaaaggtctaatatccagcatctataaggagcttaaacagatttataagccaaacaaacaaccccattaaaaagtgggcaaaggacatgaacggacacttttcaaaagaagacatacatgcggccaacaagtgtatgaaaaaaagctcaacatcactgatcattagagaaattcaaatcaaaaccacaataagataccatctcacaccagtcagaatggccatcattaaaaagtaaaaaaagtaaaataaaagagatgctgctgaggttttggagaaaaaggaatgcttatacactgttgtggggggtgtaaattagttcaaccattgtgcaaagcagtgtggctattcctcaaagagctaaaaccagaactactattcaacccagcaatcttatcactgggtatgtacacaaaggaatataaattgttctgttataaagacacatgcgtgtgtatgtttgttgcagcaccattcacaatagcaaagacatggagacaacctaaatgaccatcaatagtagactggaataaagagaatgtagtatatatacaccacggaatactatgcagccattaagaagaaccagattatatcctttgcagcaacatggatggagctggaggccattatccttagcaaactaatgccagaatagaaaagcaaatactgtatgttctcgcttacaagtggaaactaaattatgaaaacacataaacacatagagggaaactacagacactggggcctctctgggggcatagggtggaaggagagagaggatcaggaaaaataactaataaatacttggcctaatacctgggcgacaaaataatctttacaacaaacccccgtgacgtgagtttacctgtataacaaatctgcatatgtatctctgaacttaaaagttaaaaaaagagactgatatattctgtttctcagaaggaaatatttaatagagacttaacgaacagaaaccatgtctgtctcaggcagtggtgagacaagatggtggatccccacaccattatccatcagaccctgtgctccatagggaaagggcatatgtgactcagaggaatgtgtaggacaattgccaagcgcaagacacatggtaagtatgataacatcaaggttgttttaacctaagggcaggatttatggtaagtacatgctcttatacaagaaacaataaactggaaatcttggagggcttcccggtactgaagttaatcagaggtcagcatggtggattagcatccaagatggagttgctttagcctctgcaatatgtttaccaaaagacatgttttagaacgttcatagcagaactattcttaatagctccaaattgaaaagtattcaaatcctcctcaacagtagaatggataagtaagcatggcatgtgcacaccatggaataccatccagcaatgagaaagaacaaactatcgctacactcaactacatggatgaattgcacaaatgacatagtgttgagtgaaagggccagattaaaacaagagtatataccagaaaatgattctatttatatggcatttaaacagcagtaaaattaatttattgtgtgaaaggtcaatatagtggttacctttggggtatttaggaactgacaggggtcttctggggtgatagaaatatttcttgatctggattttgggtattttccgtggttgtattcccttgataaaaattctagcaatgcccttacggtttgtgtatttttctgtgtgtattttatacttcagaagaaattatctaaagcctgcatgttctttcacccagtaatttcacaactagcactttatcctggtgaaataattatacatgtccacaaagaatttatatgcaagtgttttcatttcaaagtgctgctttcaacagtgagaaaccggaaataatagaagcatcaaacaatagtgaagtggtcaaatataaaatggtaggatatttacagctctgaaaagtcatgtttatgatgactacataatgacaaagaaaattatgattttatgtaaagtaaaaaaaagcaggactttaaactgtgtacagagaatgatcacaatttcatagtgaaatgtattcatgttcaatgccaacactggttattttgaagcgataggttttcagatggttttattttcttcgttatactttaatttatattcaaaattatatgcaatgattacataattacattttaatcataaaatgtatttaaaatttttatgaaatcatgacccaaagaagattctgtcatcctcagtccatgcttttgcaaagcttatgaaaacagtaaagtcaaacaggcaaactcttttcttgttggctgggcatgcaagccagttttctctctccaggcctactgactcccatagaagtatccgaagcacacgaaaaatctcacaaatcctagagggagataaaagtgaattaacctcatttctgaaaggcaaatgtggactcatggtagaagatagggactgtaggaggcaggaggccagatgagaggaatccattatttttccatttcctaggcttatagtgcagttactatccatgggctaagagagagcactactgtaaacagctaccgactattctctctcatccgcacagctccaaagttggatggttacagtggaggacaaaccctgggaaatccttttctatgtatgaggctgcataacaaactaccttgtgcgtgccttgggagagatggcttgattcagcttacattcttgatgccaatcagaggcaaaggagggtggcatttcttagaccagggcaccagaacctcattaactgatgcatataataagcaaaatattctactttttttttctttttttttttattatactttaagttttagggtacatgtgcacattgtgcaggttagttacatatgtatacatgtgccatgctggtgcactgcacccactaactcgtcatctagcattaggtatatctcccaatgctatccctccccactccccccaccccacaacagtccccagagtgtaatattccccttcctgtgtccatgtgatctcactgttcaattcccacctatgagtgagaatatgcagtgtttggttttttgttcttgcgatagtttactgagaatgatgttttccaatttcatccacgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcaggtgtctttatagcagcatgatttatagtcctttgggtatatacccagcaatgggatggctgggtcaaatggtatttctagttctagatccctgaggaatcaccacactgacttccacaatggttgaactagtttaaagtcccaccaacagtgtaaaagtgttcctatttctccacatcctctccagcacctgttgtttcctgactttttaatgattgccattctaactggagtgagatggcatcttattgtggttttgatttgcatttctctgatggccagtgatgatgagcattttttcatgtgttttttggctgcataaatgtcttcttttgagaagtgtctgttcatgtcctttgcccactttttgatggggttatttgtttttctcttgtaaatttgtttgagttcattgtagattctggatattagccctttgtcagatgagtaggttgcgaaattttctcccattttgtaggttgcctgttcgctctgatggtagtttcttttgctgtgcagaagctctttagtttagttagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccaattttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaagtcattggtagcttgatggggatggcattgaatctgtaaattaccttgggcagtatggccatgttcacgatattgattcttcctacccatgagcatggaatgttcttccatttgtttgtatcctcttttatttccttgagcagtggtttgtaattctccttgaagaggtccttcacatcccttgtaagttggattcctaggtattttattctctttgaagcaattgtgaatgggagttcactcatgatttggctctctgtttgtttgttgttggtgtataagaatgcttgtgatttttgtacattgattttgtatcctgagactttgctgaagttgcttatcagcttaaggagattttgggctgagacaatgaggttttctagatatgcaatcatgtcgtctgcaaacagggacaatttgacttcctcttttcctaattgaataccctttatttccttctcctgcctaattgccctggccagaacttccaacactatgttgaataggagtggtgagagagggcatctctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctgtgtttatatgctcgattacatttattgatttgcatatattgaaccaggcttgcatcccagggttgaagcccacttgatcatggtggataaactttttgatgtgctgctggattcgttttgccactattttattgaggatttttgcatcaatgttcatcaaggatattggtctaaaattcgcttttttggttgtgtctctgcctggctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaagatattgattgttgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcagtggtgataccccctttatcattttttattgcgtctattagattcttctctctttttttctttattagtcttgctagtggtctatcaattttgttgatcttttcaaaaaaccagctcctggattcattaattttttgaagggttttttgtgtctctatttccttcagttctgctctgatcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctagtatgttgtgtctttgttctcattggtttcaaagaacatctttatttctgccttcattttgttatgtacccagtagtcattcaggagcaggttgttcagtttccatgtagttgagcggttttgagtgagattcttaatcctgagttctagtttgattgcactgtggtctgagagacagtttgttataatttgtgttcttttacatttgctgaggagagctttacttccaagtatgtggtcaattttggaataggtgtggtgtggtgctgaaaagaatgcatattctgttgatttggggtggagagttctgtagatgtctattatgtccgcttggtgcagagctgcgttcaattcctgagtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgattttgttggtttaaagtctgttttatcagagactaggattgcaacccctgcctttttttgttttccatttgcttggtagatcttcctccatccttttatttttagcctatgtgtgtctctgcacgtgagatgggtttattgaatacagcacactgatgggtcttgactctttatccaacttgccagtctgtgtcttttaattggagcatttagtccatttacatttaaagttaatattgttatgtgtgaatttgatcctgtcactatgatgttagctggttattttgctcattagttgatgcagtttcttcctagtctcaatggtctttacattttggcatgattttgcagcggctggtaccggttgttcctttccatgtttagcacttccttcaggagctcttttagggcaggcctggtggtgacaaaatctctcagcatttgcttgtctctaaagtattttatttctccttcacttatgaagcttagtttggctggatatgaaattctgggttgaaaattcttttctttaagaatgttgaatattggtccccactctcttctggcttgtagggtttctgctgagagatccgctgttagtctgatgggcttccctttgagggtaacccgacctttctctgtagctgcccttaacattttttccttcatttcaactttggtgaatctgacaattatgtgtcttggagttgctcttctcgaggagtatctttgtagcgttctctgtatttcctgaatctgaatgttggcctgccttgctagattggggaagttctcctggataatatcctgcggagtgttttccaacttggttccattcaccccatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctttcttccagttgatcgcatcggctcctgaggcttctgcattcttcacgtagttctcgagccttggttttcagttccatcagctcctttaagcacttctctgtattggttattctagttatacattcttataaatttttttcaaagttttcaacttctttgcctttggtttgaatgtcctcccgtagctcagagtaatttgatcgtctgaagccttttctcagctcgtcaaaatcattctccatccagctttgttccgttgctggtgaggaactgcattcctttggaggaggagaggcgctctgcgttttagagtttccagtttttctgttctgttttttccccatctttgtggttttatctacttttggtctttgatgatggtgatgtacagatgggtttttggtgtggatgacctttctgtttgttagttttccttctaacagacaggaccctcagctgcaggtctgttggaataccctgccatgtgaggtgtcagtgttcccctgctggggggtgcctcccagttaggctgctcaggggtcaggggtcaggagtcagggacccacttgaagaggcagtctgccggttctcagatctccagctgcttgctgggagaaccactgctctcttcaaagctgtcagacagggacatttaagtctgcagaggttactgctgtctttttgtttgtctgttccctgcccccagaggtggagcctacagaggcaggcaggcctccttgagctgtggtgggctccacccagtttgagcttcccggcggctttgtttacctaatcaagcctgggcaatggcgggcgcccctcccccagcctcgctgccgccttgcagtttgatctcagactgctgtgctagcaatcagcgagactccgtgggcataggaccctccgagccaggtgcgggatgtaatctcgtggtgcgccgttttttaagcccgtcggaaaagcgcagtatttgggtgggagtgacccgattttccaggtgcagtctgtcacccctttctttgactcggaaagggaactccctaaccccttgcgcttcccaagtgaggcaatgcctcgccctgcttcggctcactcacggtgcgcgcacccactgacctgcacccactgtctggcactccctagagagatgaacccggtacctcagatggaaatgcagaaatcaccgtcttctgcgtcactcacgctgggagctgtagaccggagctgttcctattcggccatcttggctcctcccacaatattctactttttaagcgtcatatgcatagttcattttagttacaataactcacaaaacatctttaaaatcagcatactgatgttcgtggtcattttcaaagtagcttgccatacctaacagtttgttccgtggtcaaaaggacactccatgcaattatttgcagaatgttcagaacatttgtcaaggtggaaggtctcagccaaaagtgtcataaaatgtcaaatccatttatgctcaaatccccaacatctgtgattatattcattgtaaacacaataatacaatattaaatattatataaaagatgtagctacatgaaatgttacctcaggagcttggtaagaaggcaaacgtatgctctgtgatagtgaaacaaacaaaatctaaacataagatgtgtgtctgtctatctatctaatagatctattggcagttgatgggaattaaaggagattgtataattgaagtggctgtgtgcaaaagaaggaatggccagcttggtgcattaaagagaaaacatggagaattgtctggaggaaaaaaaaaatgttctttcagctgacaggaacatcagtttgcctgcaggttacatattgccaccatggcagcaatacagaagctatggagacctgatggaatcaaatcatatatcttcctaccacctactttgaggtttcatgaagatgaagaccatgcagatctggctgccactaacatttctcatgtgcaaacagttggcaggcacagttggcacacacactttgtgcttgcattaattttttagggccactgtaacaaattatcacaaacttggtgtcttaaaacacaagtttattctctcactgctctggaggccagaggtctgaaatagttaccactgggctgaaatgaaggtgtcagtggcagagctgcactctctctgggggctgtagtggagactccattccttgccttttccagcatctggtgcggcccaagttccttgatgtgtggcctcatcactccaatctttaagaccatgatcttcaaatctcactctgctctgtgtttacatggccttttcctttgtgtatgtgtagtcaaattcctctctggctctctcttagcaggatgcttgtgattgcttttagggtccacctggataaatccaggatacgtttcccatactgaccacttctgcaaagagccttttaccaaataaagtaacattgaaaagttctagggattaagacctgttatctttgggctccattattcagcctactacaatgctcagtaaatatttgttgaatgattattgattctgctaacatgacttttcaatctatctagaagttttagctctcattgaaaattagtaaattttcactctgaatttacatatgaatctctagtaggccttgttagttggaggcggcatccagcatataatcatctcaaagactctgagaaagctgagtttgttgaagcacagtcctggacagtgatgaaatcactaaggtgctttgtgaggaacactcacattctgacttttactgaagagagcttttgtcgagaaaagatttcctgaaccaaaaattctacttctacagctttgttttgaaaaactttaaaataaaatttaaaaatttaaagtttgataaaatgctctagcaagactttactgccggcttagtattgctcaaaaattaaattcgatatggatttttaaactcacagcaaaatcacaatgaaaatacttgtatataatttttttttctgttagagatcagcctaaagtgtatgtctatgtttgttggtaggatcaaagtcccaattaaagccctgcccatttgtttgaacataagctgcagagtgaaatattacagggcttggtatctttctctctgctttcaaacacagagaagatgactgagcttttgagccctatcagcctcctcctccttccctggtaggattctgcacctttcattctctttgatgctgggcagggatgatgccactcaccaatctgggcttctcctcctctgccaatgacaaggtgagcccactgggtgagcagctttccttgttatcaccactaataccttggattttgttgaaggctgttctttgaggactctgaggaacttacacagatatacttgttatcctccctgtaatcctttgaagtggcagagactgtggacatttgtaaatgacctagatgatgctggtcctgccctcaagtttacttaagtttattatgtccgttacctggcattctgtcaaccaggactctctcttaatcatcagatctgaacatcaaagtagactgagataaaaaaaaaatccctgttattcatataaccttaagtcacttaagaaccctaacgggcttttagaattacctaacagaaaatttggtgtatttatccatggctttagtattcagtatggatttttgataaacaaaatatttaagaatttttaaccttcaaatgatatatcctattgcttgattcatgagactgccaatgaactttggaccttttaaaaaattcagatacatatgccttatgccagacccattaaatcagatctcttggatgggaccaaagcttctctctctccctctctctctgtgtgtgtgtgtgtatgtgtttcttcatatctctatatacagtatatttttatatatatgtatatagcatatttattttaacttcttatggaatttttcaaacataaataaaagtagaaaatacagtattccctacatagttgtcatccagattcaacgtttcaacactctgctgttttaagttttacttttctttacccccccaccccactttttttttgtttgctgacttcttccaaaagaatatgtcagtatttacctccatagacaaggaatttttaagaaaaaatgaccaaatttttattatcgatccacaaaattaataataattctttattatctgttgtctagtttaattttctctagttgtctcaaaaaagtcatttgtatattatacattaaatcagaatccaaacaaggtgcatacactgtatttggttgatatgcttctctcatatctcttaatctatgatagctcttccctttcttaatgtagtatacacacttttctccatgtagcaacatattgaaatattcctattgctttttacagctgcactggactttgttgggtgaatgtacaatattttatttaatccctctcctggtgatcaatatttgagttgtttctagtctttggctattacaaacagtattgcatgcctggtggatgtctttttacttttttgccattgtgtctttggtataaattactagaggtaagattgctgggtcaattactgtatatttgattttgctctattattaggagatcatgttgctttgataatattctttgccttcatctcaactttagtgctgttttatagggaatgatgtcaattactaacctgctgctttgcttgtcactagctttcttttcacctcctgtgactttctttcactggatagatgaccagcttcaaagtcttgaggtctttgttcttcatgattattaggtttggaagactgtacacagtcaaaagctaactcacttgtaattcagtttattggcactgttcaattacatgtgttacccatttggttgcaaatttcctgaatactttatgctaaaaaattggcatttacattttaaaatccgcaaacagcagccctttgagtcccctgtccaccactaccctaactctaatgtatcacaactaagatcactgttcctaagaaacatacaagaacaacagttgtactgccttgaagttcctgattgaaacagaatgattcagcaaatttggaggaaaaaagaaagcactctgttacatattttaaaaatcagattcattattgatagcaaacatattcaaacttaaagcagacacaaggagaacttgaaatgtaagaatataaggataggccaacatgcaagcaccctgccatgctgccactgctggtgcaaacacacagatgccactgccctgttcccatttgcatcccatcccatctgatgtgcacgtatcctcaccatactgctgtagctgctggcacacttaagcgagtacagatcctgctgccaccactgacaaaccgctttggcaagcacccccattggaatgttgtggccagcagatggaatacccaggccctccagcacagcatgttactgacctcaaggggccagagaacaaagccaggggcccaggtaccagcccaacagagttagagcacacaacccaggaatgctgagctgagccttagccccctgaaatcttccagaaacgaagccagttgactgaatctaccttataccacaatcaaactgatatggtttggctgtgtcccaatccaggtttcatcttgaattcccacatgttgtgggaggaacctggtggtaggtaattgaatcatgggaggtgggtctttcccatgctattctcatgatagtgaataagtctcacaagatctgatggttttaaaaacaggagttcccttgcacatgctctctctttgcctgctgccatccatgtaagatgtgacttgctcctccttgccttccaccatgattgtgaggcctccccagccatgtggaagtgtaagtccaataaacctctttcttttgtaaattgcccagtcttgggtatgtctttatcagcagtgtgaaaatggactaatacacataccctcaagggcatcaaataagatgaaagcagcagcaacaacaacaacaaaaacaaaccccatccaaataacagaaactctgaagagtgaaagaacattggtccacatggatcagaaagcatcagcacaagaactcttgcaattcaaaatgcaagagtgtcttcttacctccaaaggactatactagtttcccagcaacagttcttaaccaggctgaaattcccgaaataacacataggatttagaatatggataggtatgaaaatcatcaagattccagagaaagtagaaactaattcaaagaatataaggaatataataaaatgataaaggagttgaaatataaaatgaccattttaagaaaaaacaaaactgatctgataaaggtgaaaaactcactacaagaatctcataatacaatagtaagcattaacagaagaacagtccgagctaaggaaagaatctcagagctcaaagaccagttctccatattaactcactcagacaaaaataaacaaaaaaattaaagtgaatgaacaaaacttccaagaaatataggattatgtaaagataccaaatccacaactcactgacatccctgaaagagagaaagcaagcatcttggaaaacatatttgaagatatcatcatgaaaatttccccaaccttgctagagaggctaacatctaaattcaggaaatataagatgaccatccccaagacatagtcatcagattctccaaagtcaacatgaaagaaaaaatattaaaggcagctagagagaaggacaggccgtctagaaagggaacccaacccaatcaagctaacagtggacctctcagcagaaaccctacaaaccagaagagattgggggcctatattcagcattcttaaagaaattctgaccaggaattttgtatccagccaaactaagcttaataagcaaagaaggaataaataagatccatttcagagaagcaaatgataagggaattcattactaccaggtctgccttacaagaggtccttaagggagagttaaaatatggaaatgaaagattgttactgccaccaaagaaacacactaaggtacatagaccattgacactataaagcaactacacaatcaaatgtacatgataactagctaacaacatgatgacaagatcaaatttgcatatatcaatatgaaccttgaatgtaaatgggctaaatgctccaattaaaaggcgtagagtgacaagttgtgccttgccacatctcacatgcaatgactcccataggctcaaagtaaagggatggagaaatatctagcaagcaaatggaaaacaaacaaacaaacaatagcaggggttgctattctaacttcagaaaaaaacagactttaaaccaacaacaatcaaaaaagtcaaagaagggcattacatggcagtaaagggttcaattcaatgagaaaatttaactatcctaaatatacatgcatccagtacaagatcacctagattcataaaacaagtcttagaaacctacaaagagatttagataaccatacaataatagcaagatgcttcaacaccccactgacaatattagacaaatcatgaaggcaaaaagctagcaaaggtatttgggactttaatatgacacttgaccagatagacttaacagacatctacagaactctcacaccaaaacaacagaatatacattcttgtcatctgcacatggcacatcttctaaaatcgaccacacaatcagccataaaactattctcaccaaattcaaagaaactgaaatcacaccaagcacagtctcagaccacagtgcaataaaaatagaaatcaattctaagaagatctctcaaaaccatacaatcacatggaaattaaagaacctactcctgaatgacttttaggtaaacaatgaaattgaggcagaaatcaagaaattatttgaaactaatgaaaacaaggataaaacctactttaatctctgggacacagctaacacaatggtaaaaggaaagtttatagtgctgaacaacaacataaaaaagttaggaagatcttaaattagcaacctaaaatcacacctagagaaatgagaccaaactaaccccaaagctagcaaaacaaacaaacaaacaaaaacaaacaagaaacaaccaaaatcagagctgaactgaataaaattgagatgcaggaaaccatacaaagaatcaacaaaactagaagatggttctttgaaagaataaataagattaatagactgctagctagactaataaagaaaaaaaaagggaaaaagatccaaataaacacaatcagaaatgacaaaggggacattaaccaccaaccccacaaaaatacaaaaaaccttcagagactattatgaatacctccatgcacacaaactagaaaacctaaaataaatgggtaaattattggaaacatgcaacctcccaagattaagacaggaagaaattgaaatcctgaacagaccaacaggttctgaaattgaatcagtaataataataataataataaaaaaccccctaccaaccaggaaaagcccaggaccagatggattcacagccaaattcaaccagacatacaaagaagagctggtaccattcatactgaaactattctaaaaaattgaagagagagactcctccctaactcattttatgaggtcagcgacattctgataccaaaacctggcagacatacaacaacaaaaaccttcagaccaacaactttgatgaacctagacacaaaaatcctcaataaaacactagccaactgagtttagcagcacatcaaaaagctaatccaccacaatcaactaagctttatccctgggatgcaaggttggttcaacatacgcaaatcaataaatgtgattgattatataagcagaaggaaaaacaaaaatcacatgatcatctcagtagatgcagaaaaggcttttgataaaattcggtgctgctttatgttaaaaaccttttaacaaactagacactgaaggaacatacctcaaaatattaagagcaccctatgacaaatccaaagccaaaatcctactaaacaagccaaaactggaagcatttcccctgagaactggaacaagaaaaggatgcccactctcaccattcctattcaacatagtactggaggtcctggccaaaacaactgatcaagagaaagaaataaaaggtatccaaataggaagagaggaagtccaactatctttcttcacgtactttatgattttataactagaaaaccccgtagtctctgcccaaaagctcctggatctgataaacaatttcagcaaagtttcaggatacaaaatcagtgtacaaaaatcactagcatttctataccccaacaacatccaagctgagtgccaaatcaagaatgcaatcccattcacaatagccacagaaaaaaaaataaaatacccaggaattcagctaaccccagggaggtgaaaaatctctacaagaattgaaaacattactgcaagaaatcagagatgacaggaacaaatggaaaagcactatatgctcatggataggaagaattaatatcgttaagatgaccatactccccaaagcaatttacagaatcaatgttattcctatcaaattaccaatgactttatttacagaattagaaaaactattctaaaattcatatggaaccaaaaaaaaaaaaaaaaagagagagagagagagcccaaagagccaaagcaatcctaagcaaaaagaacaaggctagaagcatcacattatccaacttcaaactatactacaaggttacaataaccaaaatgatataataaaaaaaaagacatgtagaccaatggaacagaatagaaagcccagaaataaagccatacatctatagccatctgaactttgacaaagctgacaaggaaaagcaataatgaaagaattccctgttcaataaatgataatagaataactggctagccatatgcaaaagattgaaactggcccctttccttatatcatatatataaccaactcaagatagattaaagacttaaatgtaaaacctaaaactataaaaaccctagaagaaaacctaggcaataccattccggacacaggctccagcaaagatttcatgaccaagatgtgaaaagcaaatccacagccaacaacttactgaacaggaacaaacgcaaaaattgacaaatgggaaataattaaactaaacagcttctgcacagtaaagctatcaacagagtaaacagacaacttgcagaatgggagaaaatatttacaaactatgcatccgcaaaggtctaatatccagcatctatatggaacttacatttacaattttaaaaaaaccattaaaaagtggacaaaggacataaacagacacttttcagaagacgacatacacatggccaacaagcatatgaaaaaatgctgaatatcactaatgattagataaatgcaaatcaaaaccacaaaaagataccatctcataccgctcagaatggccataattaaaaagtcaaaaaataacagatgctggaaaggttgtggagaagagggaatgtgtaaacacaactggtgggaatgtaaattagttcaggctttgtggaaagcagtatggtgacttcttctagaacttagaactaccattcaacccagcaatcccattactgaacatatacccaaaggaatataaattgttcagtcataaagacatatgcatgtgtatgttcattgcagcactgttcacaataggaaagacatggaatcaacctaaatgtctgtcaatggcggactaaagaaaatgtggcaaatatacatcatggaatactgtgcagccataaaaaagaatgagatcatgtcctttgcaggaacatggatggagctggagactgttatcctaagtgaactaatgcaggaacagaaaatcaaatctgcatgttctcacaagtgtgagctaagcattgtgtccacatggacacaaagaaggaaacaatagacactggggactccttgagggtggaaggtgggaggagggtgaacatcaaaaaactgcctattaggtactatgcttattatctgggtgatgaaataatctgtgcaccaaacgctcacaacatgaaatttacctatataacaaacctgcacatgtatccgtgaaactaacattaaagtaaaaaaaaaaaaaaaaaaaagaacagcaattactaaaaatgttcatgttcatagcaaataggaacaagtttttatggataagtggcagtccaaacattcaagagcacaatcttcatattaaaatattcatgttatctaacccataattgtactttacctgaagcttggatagaccgggccaagtcacagctaaattggctaaataggcatcttggcaggtgaggggaccttggcataagccaataatggctctctccactccctggtataaaatatttgtgatgatgctttccaatcaaatgctggtgactcttgggcatataaggaaaaatattctgttgtaagttgatttcaggcagaaaatggtatattctttcttttctagtctcatacttctagaagtcatatcaaaatgttggttagaaattgaagatgtcccattaaccatttgtaaactaaatatgactttgaagtcttaaagacctgggtctaacctcaacctctcaggaagtgtataaactttttcacgatttaagtatcctgaactccttttactcgtgtatagttgtaatgtaaggcttacaaggaaggctcaatattatgttcagccgtgatagctggtaaaattagtgctttgtgtgcactaattacaagtttccctccctactctgctcctatggatacagtccggagacaaacaactctccttatcacaggaatcaggcacggtttctacatatctttgagtagtgggttacagtttcctgacagttaatggaattgtccaaacaagccaattgcatcctcccatggaaaccagggggcaccccatcctatacttgacactgcaaagcttcctatagcccctagttgttcactgtgttctggagtacaatcttcatgtggccctgcatgccacggtgtcctcctcccctgagctatgagtatatgtaagaagctgctgtcactctcatgtgactagtatcaggtgttgtgagttcagccatccccacaacccaaggttaggaacccctccctcaccatcggagtgaatagaaggctattaaagcaatatctcatagggctattgtcaggaataaattgaattaagtgaaatacttggaggtaaagatctgtgcaacttctctcaagatattttgaagtactaaagaggagagaaagaagagtttctgtcctcaaggcattcaaagcataatggaagagagacatcacatagcacaataatccttgatttacacttaagagtgaaggtgtagaggtaaacccagggttctcagtgagccaaaggaaattagatgaataaggcataaatcccttagctcagtttctggcgcatagtaagggcttaataaatagtagactgagttgaatttgaaggactaatagtcattactagatgaaaaaagtattttacaaaatgtgaaagaccctaatttatttctagggattactattaattcttggtttttccaagaatatattttctaggagaaaataatcaatttagatgaacagaataatgtggcttctttatattaagcagttccacagtttaaatgttcataccactgtcgtgaaaatccccaaagtatcctatagaaacacacagaattcaacctttttggcagccctggcatgtttgttaggcaattaggaccacaactgacttcacagattttgttcgcttgctcgcttgtttgtttcacgttttgtttcctttgggtttcttttaaaggcttcccttagacatgcaccattttgttaataagtaaaaaatacaagcagtgtccagagtgcagtgtgataaatatcacttctgtcttgtgatgtctcatcaaagacgacccatatgcagtagattttataatagcactatcttcttgtgaacttgggtttaattgacaattacctgctacctttggctgtttatttctggttatcagataaaagggcagtatggtggagtagaaagagacccattcaggtgtcaccagatggtcttttgtgtcagttctgcccttagctaattttagaaactagagaatagctcttaacctgtgggagcttcagtttttttcttctgtgaaatgaagtattgggctgaactcaaagatccctcataactctaacaggctgtgaatgtgagagtcagagttaggggtttggagcctgacagatttggtttaacattttgatttgccactcattagctcagggatctagataaactctccttgagggttatttttctcatcttacacaagttttattacctttattttactaagagttgactaatatttttaaaccaattcatcagtaatcttgttgtctatactttcaaaataattccagaacctgaccaaatcttattaccttcaagccaccatcatctcttgccttgattattccaatagcatcctaatcagcctctgtagcttccatgttgtcctacccactccaacagtctgttttcaatgtatcagacagagtgatccctttaaaatatatcaactcatgccgtttttctgttgaaaattccccagtggtttcccaactcactcagagtgaaagttcaaacccttaccatggctgatgaggttccacatgatgagggttcctgctgcttcctctcttgtgactctctctctaattactccactttagcaatacctgccttctttatgtttcctaaatactttgccttcagatatcctataggggcattccttcattgaagggaagtcttttcaaatcttaccttattagaggtgccttttttctattatctttaaaatagcattccccaacctccatcccattgctccctatctcccactcaattttattttactttacagcatttatcatcattttctgcctccctttgactcaaatggaagtttcatgaaagcaggaacttcatttcattcacagaggtagcctcatctcttagaatagcacctggcacatagcaggcactcaataattatttgttgatcaaattaataggctatataaatctttgggcactcagtaaatgccacttctcaatgaccttcttagaaacaaaatatttggcaccctttcatcctgttatttgattaaaatgcaatgctggacataccctggttttagctctgacgtgtaaagagttaggaagttgtcactcccatccttacaagaagaaaaatatagacaaagtaaaaatcaacaacttttcctgaacccactagagagccaaattctataacccgatgattaactctcagtgtttagtgggtctgtatctcagggatgtaacatgcacaagtatttctccactgtcacacctttcctttttccttgtaggacaaattgtcaccctgaaatctgtatagacaggtgtatcaaaagagtcacagctgagatatgctaatttgaagcaggagtctctggagacagaaactgataggaacatttaaatagtaatttgatgaattgttggcacctcaatgtagtctaacatgaaagtaagaaactcatggggtttcagttatagaggggccccacaattttgtaggttttgcctccaggaacccaccaaattcttttagggagtattaaagaaagatccccttgtggcagagaaatgggaagcataatcattgtgaaattatctccagagccttttccataagaaaatgttgcagtcagaaaggtaggaggggccaagggagaaaagaaagctgtgccactgcagaaatacttgtgaaggctacgtccctgagacataggcccactaaaacactaagagttaatcaccagattatagaatgctcccctgccacacacttaccagcaccccaagagggctctagtatgatagtggattatagctgaaagagctgcaagacacaaactctctctgagcaggagaactttgggaaacataaagtcaagagaggagacaaaaacaaagacattagaagattttgaaatctctggcacctgtagctatgggaaattttaaacacagcccaacttctagtcatattaacatgaatcctcacattaaaggcctatttacctcaattcctattttccaatataaactatctgattttcaacaacaaacaacaagggaaatacagcttaaagagacaaagcaatcatcagaacaagacacagatatgacacagatgttggaattgtcagacagaatttaaaataattatgatgatgtgtcaaaggctctaatggaaagagtagacaacatacaaggacagatgagtagtacaagcagagagatggaaaccttaagaaagaatcaaaaggaaatgctagaaattttaaaaagtaacagcaatgaaggatatcttcaatggactcatcggtagatttgacatgacagagggaagagtcagtgagcttgatgacaggatcatagaaccttctcaaactgaaatgcaaggagaataaagcatgggtgaaaaaaagaaaagaacatttaacacacacataccaggagagtagagagacagtgaagcaaaagaacaatttgaagtaataatggctaagatctttccaaaattaatgacagataccaaaccacagatcaaggaagctcagagaataccagcaggaaaaatctctgcctccacagcccaccatgaagtcctcacaccttggtatatcatattgaaacacagaaaaccaaacacagagagaaaatcttgaaagaagccaaacaagtgtgtgtatcaggggggcacgggggttggggggtgaagggaagagaaaacatcttacctatagaggaataaagataagaatgtttatagcagcacaatttgcaattgcaaaaatatggaaccagcctaaataaccatcaaccaatgaatggataaagaaaatgtggtatatatatataccatggaatactacatagtcataaaacagaacaaaataatggcattcgcagcaacccggatggagttggaaaccactattctaagtgaagtaacttaggaatggaaaatcaaacatcatatgctctcacttataagtgggaactaagctatgaaagcacaaaggcataagaatgatataatgaactttggagacatgaggagaagtgtgggagggggagtgagggataaaagtccacacgttgggtacagtgtacactgcttgggtgatgagtgcactaaaatctcagaaattaccactaaagaacttatccatgtaaccaaaacccaccggttcccccaaaactattcaaataaaaaataaaaaagaactacagtgactttttaatcagaaactgtgttgtaagaagagagtggagtgaaatatttagctttgaaagaaaaaacaactcaccaatctagaattctatatcaaaaaaattatctttcaaatgtgaagaagtaaaaactttcttaaacaaaaactaagagaattcactgccagcaaactcaccctacaagaaatgttaatagaagttcttcaggcagaagaaaaagtatataggtcagaaacttgaatctacataaagagagcactagagaatgaataaataaagatatgatgaagtactttgatttttaaatttttaattggtgtaaaatattattgtttgtttaaagtaataatagtaagaatgtattgggttattatggcatgtggataagtgaagtgaaatctgaaataaaattaataatagcaatgttacaaagaatgagtgggatgaatttgggatactctgtcataaggcatctgtactgtgcttaaagcagtatagtattatttgatggtgaaattagaccagtttaaaatatatattggaaagtctagggcaatcactacaaaattttttttaaagaactgtaattgatatgctaataaaaaagataaaatggaatgacataaaatgctcaattaacaccagagaagaataaaaagaggagaaaagtaataaaaaaatgcaatgcacaggaaacctttattatttttttttaaattttttttattttttattttattattattatactttaagttttagggtacatgtgcacaatgtgcaggttagttacatatgtatacatgtgccatgctggtgtgctgcacccattaactcgtcatttagcattaggtatatctcctaaagctatccctcccccctcccccgaccccacaacagtccccagagtgtgatgttccccttcctgtgtccatgtgttctcattgctcaattcccacctatgagtgagaatatgcggtgtttggttttttgttcttgcgatagtttactgagaatgatgatttccaatttcatccatgtccccacaaaggacatgaacttatcattttttatggctgcatagtactccatggtgtatatgtgccacattttcttaatccagtctatcattgttggacatttgggttggttccaagtctttgctattgtgaataatgccgcaataaacatacttgtgcatgtgtctttatagcagcatgatttacagtcttttgggtatatacccagtagtgggatggctgggtcaaatggtatttctagttctagatccctgaggaatcgccacactgacttccacgatggttgaactagtttacagtcccatcaccagtgtaaaagtgttcctatttctccacttcctctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaagtgtctgttcatttcctttgcccactttttgatggggttgtttgtttttttcttgtaaatttgtttgagttcattgtagattctggatatgagccctaaaccactgctcaatgaaataaaagaggatacaaacaaatggaagaacattccatgctcatgggtaggaagaatcaatatcatgaaaatggccatactgcccaaggtaatttatagattcaatgccatcctcatcaagctaccaatgactttcttcacagaattggaaaaaactactttaaagttcatgtggaaccaaaaaagagcctgcatcaccaagtcaatcctaagccaaaagaacaaagctggaggcatcacactacctgacttcaaactatactacaaggctacagtaaccaacagcatggtactggtaccaaaacagagatatagatcaatggaacagaacagagccctcagaaataacgccgcatgtctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaagccctaaaagaaaacctaggccttaccattcaggacataggcatgggcaaggacttcatgtctaaaacacgaaaagcaatggcaacaaaagccaaaagtgacaaatgggatctaattaaactaaagagcttctgcacagcaaaagaaactaccatcagagtgaacaggaaacctttattaaaactaaatttttttctgttctgaaaaagatactgctataagaataaaaagtcaaggcacatactgagagaaaatatcagcaaaatacatatttaatgaagaacttatgtctaaaatatacaaagaactttaaaaactcaataataagaaaacaaacaattcaatgtaaaaatggacaaaaggtctgaacagattccccaccaaagaaggtatacagatggcaaagaagcctatgaaaagacactcgccatcatttttcaagcaaattagaaaaatgcaaattaaaacagcaatatgatactaccatacaagtatataaaggctaacacctacaatctaacaatactgattggtggcaaggatgaaaaacaaaaaaaaccctgtcatttattgctggtggggatacaaaaaggtacagccattttgaaaaacactttggcagtgtctgacaaaggtaaacatagtcctaccctaaatctagcaatactgattggtggcaaggatgaagaacaaaaaaaaaaaccctgtcatttattgctggtggggatacaaaaaggtacagccattttgaaaaacactttggcagtgtctgacaaaggtaaacatagtcctaccctacaatctagcaattgaacgtctaggtatttacccaaaggagttgaaaatttatgtccatataaaagcctgcacatcaatgtttatagcagatgattggaggtgcagcaagatggtggaatagaaggctctaccagtcatcccccacacaaggacaccaatttaacaactatctacactcataaaacaccttcatgagaagcaaaatcagacaaacaaaagctgtgggattttatcaacaccagactggtcctacaaaaaatgctgaagggagtgtttcaatcagaaagaaaaagacattaatgagcaatacataatcacctgaagtacaaaactcactggtaatagtaagtacacagaaaaacacagaatattataacactgtaactttggtgtgtaaactactcttatcctaagtcaaaagactaaacaatgaaccaatcaaaagtaataactacaacaactttccaaaacatagtacaatcaaatataaatagaaacaacaaaatttaaaaagtggggggatgaagttaaggcatagagtttttactagttttctttttgcttttttgtttatgcaaacagtgttaggttgttatcagtttaaaataaggggttataatattgaatttgcaagcctcatggtaacctcaaaccaacaaacatacgactgatatacaaaaactaaaaagagactaaatcatatcaccagagaaaatcaccttctttagagaaagacaagaagggaagaaagaaggaaggaagagaagactacaaaacaaccagaaaacaaataacaaaatggcaggagtaagtccttacttatcaataataacattgaatgtaaatggactaaactctccaatcaaaagacatagactgactgaatgaatgaaaaatcaagactcattgatctgatgcctacaagaaacacacttcatatgtaaagacacacataggctgaaaataaagggatggaaaaatatattccatgccagtataaacaaaaaaagagcagaaatcactatacttatatcagacaaaatatatttcaagacaaaaactataagaagagacaaagaatgtcactatataatgataaaggtgtcaattcagcaagaggatataagaaatttaaatatatgtgcacccaacatgggcatatccagatatataaaggaaatattattagaactaaagagaaggatagaccccaatacaataatagctggagacttcaacaccctactttcagcactggacagatcttctggacagaaaatcaacaaaaaacattggacttaatctgcactatagaccaaatgaatctaatagatacagaacatgttatccaatggatacagaatacacattcttttcctcagcaaatggatcattctcagagatagaccaaatgttatgtcacaaaaaagtcttaaaacattcaaaaaattgaattaataccaagcatcttctctgaacacaatggaataaagctagaaattaataacaagagaaattttggaaactatataatacatgaaaattaaaacaatatgcttctgaatgatgagtggatcaatgaaggaattattaagaaaattaaaaaatttattgaaacaaatgataatggaaatacaacataccaaaacctatgtgatacagcaaaagcatactcagagggaagttgatagctagaagtgcctatatgaaaaagaggaaaaacttcaaataaacaatctaatgatgcatcttaaagaactagaaaagaaccaaacccaaaattagtagaagaaaataaataataaagatcagagaagaaataaatgaaattgaaatgaagaaaacaatacaaaagatcaatggaacaaaaagtttattttttgaaaggttaaacaaaattgacaagcctttagccagactaagaaaacaaaagagatctaaataaataaaatcagaaatgaaaaaggagacattccaacagatactgcagaaattcaaaggattattagtggctactatgagtgactatatgccaataaattggaaaatctagaagaaatgaacaaatccctagacatgtgcaacctaccaagattgaaccatggagaaatgcaaaacctgaatagaccaataacaagtaatgagatataaatgataataagaattctcccagtcaagaaaagcctgggactcaatggcttcactggtgaattctatcaaacccttaaagaagaactaataccaatcctactccacctattctgaaaaatagaagaggagggaatacttccaacctcattccatgaggttggtattaccctgataccaaaccaaacacagacatatcaaaagaaaaaagcaaaaaaacaaaaaacaaacaaaaaagaacccaaaaaaacactacaggccaatatctctctgaagaatactgatgcaaaaaatcctcaacaaaatactagtaaattgaattaaataacacatagcatgttctcattgatttgtgggatctaaaaatcaaaacgattgaactaatagacatagaacgtagaaggatagttaccagaggctgggaaaggtagtggggggcttagggtaagatggggatggttaatgggtacaaaaatagtaagaatgaataattcttagtatttgattgtacaacagggtgactatagtcagtaataacttacttgtatatttaagataactaaaagtgtgtaattggatttttataagcaaaggataaatgcttgaaggaatggatattcttcatgatgtgattattacacattgaatgcctgtatcaaaacatctcatgtaccccataaacatacacacttaggtacccacaaaaattgaaaataaaaaatttaaaattaaaaaagtttatagcaggtttatttatgaataatcaccaaaaactagaagcaacaaaaatgtccttcaataggtaaaggaataagccaactgttctacatcatataatgtaatactattgagtgatgaaaaggaatgagttatcaagctatgcaaatacaaagatgtaaatgcattttgcctagtgaaagaagctagttttcaaagatatatttggtgtgattccctttatatgacattctggaaaagagaatactctagacacaggtcagtgattgctagaagttcagtggaggtggggaaaggttgaatgtgagaatcacgggggatttttttttaaggcagtgaagctattctgaatgagactgccatggtggatacacaatattgtatacttgtcaaaacccacagaactagagcccaaagagtggactttaatgtatgcaaatttaaaaaccatttaggagatcagtggatctcagaatggaatgcagaatgtgatttttaaaaatctaactgtattacgcatgtgttaaacaacataacggaagggggggtagaggaaatgtacaaggtaatgggtagagtctataagactaaagataaaaggaactgtacataagcactactctaaatgataaagttgtttcctattgggatatgggttcacaattcttaaactactatacatggatactaggattacacaataaggaaatggacggcagatggtgggagctagttttctcattgttggagcagaaaggttacagataaggagaaaagagtagaataattcatgtggtaatggattggaattaaagacattagtatgaactcatgattagtttaatatagacacagatagatacatacagaaatgtttacagatatgtgtatatacagcatttatatatacaaatgtatttccttgtgctgtcagtttacagggctagaaccaaaaacactccagtaacagtagtcacacatagtgcacagatcttggtttctaataccatttttcgataaaataaaccagggctcctgggagaaatggctgattctaggactggggcaggaaatatgcagatgatcctggaacattttgtactgctagaaaataagaaagtactcaaaaaaaaaaaaaaaagaaaaaagaaaagaaaagaaaatccacagtggtggaagtgtgtcagaaagacacaggagtcaactgaaagagctcccaatggctgaaagtggaatgatttgaggatcaaaataaataaagcagtattggattataagccaaagtataaaataaatatccatgagttcatactgacataataaatgattgaataaataaatggggaagaatatacaaaaatcccacgtagaagaattccagataatttacgtagatactccccttcaagaattctcacttatatgtggacactaaaacaatcaaactcaaagcaacagagagtaaaatggtggttaccagaagctggggtttagggggaatggtgaaatcatggtcaaattatacaaagcctcaattaggcaggaggaataagtttttttttctttttttgctttgagatatattgcacagtgtggtgaatatagtaaaaataatatcaaacatttaaaaattgctaagagactaaattttaaatgttctcaacacaaaaaatgttaggtatttgaggtgatgggtaggttaattagcttgattttattattccatattgtagtcataagtcagaacatcattttgtaccccataaataggtataactataatttgtcaatttatatttaaaaaacaaaaaaagaaacaatgtattaatatcggttcattaattgttacaaatgcgctatactaatatatgatgttaataataggggaaactgggtgtgggatgttttggaactctgtactatcttaataacttttctgtaagtctgaaactattttaaaattaaagaaagtttatttaaaattgcagtgccaaaatagaatattcaattttttttagatatgagacctttattttttaacacaaaggagttgctctggaatctattgctagggcagagcattgggaattcaatgcgctggtattattcacaaagtccagattttatcagcaaagtcttcccatcttgttcctctgcctttattagcatttgcaactctctcaatttagcatcgttcacaatgtcattaccatgctggttatttcctcttccagatcattaagttaaaatagaccagctccgacaccacaccctatggcagttttgggaccttgtcctcaaatggcggcagatctgtgaagttagaaaccagctaaataataattatctgtaaatggcaatttcctaacttaattggttgaatttcattctgcaggtggtgatattaaagcaaacactttcctgctgtccaaacagacacactctggttctgaattatgatggaaaggtaaccaagtgagcttgttgtggcatattatttgtcactccccagggctaattgtttgtatcttagaaagctgatcattatcagatcagtatttccataatcctcttttatcactttatactactttcctgtatgtagagtgtttagtagaaactaaaccacatgtctgtcaccaactgcattcttcctctggacttactagtcatacagaaaagtacccctattgcaggcataaagctcaatgaattcttaaaaggtgaacacactcttgtaatcagtgtaatcaggacccagatcaagaaacagaacattaccagcacccagaaacctgtccaggcttcacctgccacatcctcaatatcaaagagtaaccactatcctgattttgaaataatagatttattttgactatttattgcatattttgaacaaattgaattatagcatccattgggtctgacttcttttgctcaacattatgtttgtgatattcatccatgtgttgcacgtagttgtagataattcatttacattgctgtatagcattccattgtgtaaatataccagaatttatctgttcaattgctgttgtgcatttgggtggtttctagtttttgacttttaagaataatactgctatttaaccttctagttagcatgtatttttcggtgaccatatgaatgcatttttgttgggtattgtttagctttggcagatatgttaggcagtgtataattaaatacttggagctgaaattcagataaacctggtcttaaatttggctctactacttactaggaacttggacaagttacccaacctctctaggccttgcctcttgtagtctgtcaggtgaagatttaaaaagttcctgcctcgtagggctgctgttcatattaaaagaaataatgtatggccatgatttaatacagtgcttggcatagagcaagcatcaataaatgtcaaccattgtgattttttagtgttatttattgaaaaattgttcagtattatttaaattgcaaacagaggtgaaataaacagattatttacagaaacgtttttcacttgtaagatcttgaaaaaatgtgttccgaccctgtgaatactattcttaagacctctccacccagccacgccccagctattgttccttactccctcaaattcttagcgcaaggacatgcttgcagttaaaccttccccatcccaccggctgccatagaagctgagaagaaaataaggggaataagtcttcatttctgtcagtttccttgtgggaaggactgaaaggatatttgatacctgggactcactgccaaatttgtatccattttgaacacttcatctattctagattattcagaccagatcttcattattaaaaatatatttcatagtattatgcaaatactatgcggttcatgttgaaaatgtcacatataaaagatacccatatctttttgtgtaaaaaaaaaaaagcactcttttctttcaatataaataattcatgcttttgttacaggtagttaggcgtgggtggggcaggagagggctctccccccacccactagaaaagtcaggtgatgatttggcaattatcgcattgcctctcttaaaatgataattcggcagccagggagagactgatggtccacacctgttaattattaattaaaactgttaactgaatgcagacgccagggagaaacagcttcttgggcatgcatattaagagacaaaaatggcgaagtatgatccttccaggtacattccactggaaaaaggaagaaagcctcagatgggcatgcctgtaactccctaaacacactgcatgagctcacttctcaagggtaaggagggctctgtgcatgagggcagcccactgtaagggaagaatcatggtaaagaggcgagcttatgaaagtcccaggatcacagttaaatggggcacttgtccgctctttaacctttcacgtgcacgcttgggtctcttccaagcgcacctgactttctttcctgttctaaggccttttaaaataaacttctattcctgctgtggaacttgtctctgtctctttttctgattttgtccctcagtcgaattatttcttctgaggaggcaaggactgaagttgctacagacccctaaggacaggccatcggtaacactgggtaaatcagatctcttccacgggtaagactttctataaaaatattgaaaaatacaagaagtagttttgtatgctgtaaatattcttgtatgagaagaagaaaatgaaaaatatttgtaatcctattgcccagagatttctgggtagtcttttcagactcaaataaataatatttccattacaaaaatgtagaaaatttgttaaaacataggaaagcaaaaacaaaacaacaaataataaatccctgtgttcctaagatataaaacaaaatttcaacagagcttgccattccattttttcccctcctcttttcctctctccttccctccttttctcctctcctttctctttctttcctttcttctctctcaatataatagcatcattttataatactcttttgtagtttgctttttaaaaaccttttatgggcatgtcaaatatttcatatttcaataaatattcatctaaaacttgatttttgatgactgcataacattctatcttatgaataatttgcctaacagttctctagtgttgagcatttattttgtttatacttattcactattatcaagaaggccatggtgaactttgttgtatatacatctttttgcatctttgattattttaggataattttatggaagctgaatcagtgattcaaagtttatatacattaaaaatattttgataaccatggccaaattgccttctagaaagcttatgtcattttaatttctactatcagtttatgagaagcctatttcatcatgcctttggcagtcctgagcattataactttaatttttacaaatgtaaagggtaaaaaaaatcattgttcttttatttttctttgattaacagggaggttgaatttttctggatttttaaaaaatttttattctatgaattagttttttatgccctttgatgattattcctaatgtgtttatgtttttcttgttgggttattggcgttttatatcttaaaggattttttgcatgctttttaacgtatttttaaatatcttaagggactaatatttgcttttcttatttatttttaatattttcctaattcattatataacattcatggtgtccttggatatacaaaagttctaatgctttacgccaagaatcaagtcttctttttatgtagtcgtatttttagctgcttaggttataatttcttacattatttttatacttagtaatcccttttcagtcagaaatcaatgaagttgtcacttatagtttctgccttttgcaaaaaaaatggttttgttcttaacatttgactctgatttgtctggaatttacttgacagtacgagattatattatgagacagagatctaacattcatttctccaaatacatagttaattttccaaaccctatgcattaaatagaacatctaattcctattgctttgtgattccttctttatcacatttgaagttatagtatatactaaagtgtatttgctcccattcatctgtcttttatttatgcaacatattttttaatttcattttttatttcaatagttttattggggtacaggtggcttttggttacatggatgagttctttagtggtgatttctgggattttggtgcacctattacctgagcagtgtacactgtacccaatatgtagtcttttatccctaaccccccttccacctttcccctcaagtccccagagcccattatattattcttatgcctttgcatcctcatagcttagctcccacttacaagtgagaacataagaattttggttttccattcctgagttacttcacttagaataatgtcctccagctccacccaagtggctgcaaaagacgttatttcattcctttttatggctgagtagtattccatggtgtatatataccacattttctttaaccccttgttggttgatgggcacttaggttggttctctatttttgcaactgcaaattgtgctgctataagcatgcaagtgcttgtgtcttttatatataatgatttcttttcctttgggtagatacccagtagtgggattgctggatcaaatggtagttcttttagttctttaaggaatctccatactgttttccatagtggttatgcaacatatttttactgagtacctagacctactgtgtcccagaccctatggttgtcctggaacacatgttgctgaaccagacagacagtgtaaactccataaggacaaggagaatctcgttgtgtttcttcccccacgtgcttcttaacatcaacttaatttgaaagccttcagaaggtgagaaacaagtcttcattttccatgcactctccatggtgtttttgccagggccaaatggactatagggcttcataggaaaatccatcaaaaaaatgttctactcctttcctcccaccttgacttagcaaaggtatagagtctctttttcaagatgcagccatggtgaatgagaacattagatctagagtcaagaaacctgggtttgaattgtgattatgtactaacttcatgcccttcaaaaaatatcttcactccttggaaactcagtttcctcatctttaaaatggagttaataggctgggtgcagtgacttatgcctgtaatcccagcactttaggaggccaaggcaggcagatcacttgaggtcaggagttcgagaccagcctggccaacatggtgaaaccccgtctctactaaaaatacaaaaattagccaggagtggtggtgcacgactgtaatcccagccactcagaaggctgagacacgagaattgcttgaacccaggaggcaaaggttgcagtgaaccgagatcgtgccactgcactcaagcctgggcaacagagtgagactcagtgtcaaaaaaaaaaacaaaaaagtaaaaataaaaaataaaaataaaatggagttaatgcttataggaatctttgagtgtgaactgaaaattggtgttaaaactctgaaaattgtaaaatgtcatggagataaaaattattattttcatttttagtcaaactaaagtacaaataacctgaaagcagggctcatatcttgctgcctttgtgaccccctctgcctaagtacactatttacttagtacttgtactgacaggaagccctaaccaaatatttattgaatacataaataaattcccctgctcaggtagatgctcttctaatataacctaatggaaacaccccctgccagaaagcctaagcaaataactcattatttgctctggattttagttggctttagtagattatatatgtatcctgataccccagagtttgggagccaacttaaatattgtttaaaagaataaaaaggatctataagataacacattaagcctttgatatttgaaagagatacttccctaaaccctcacaaatctccaaatttgtaaatactatgatgatgcacactttccatcactgaatacagtaaaatgtaactaaaatatttgtgatcaaattgttggtgattctgtaagtccactggctctttagacttaagttcaactggttggcctttgctttctttttggagctagtttctcctgttagctccatagtctgctctgctaacaggcaccagcagacttcttgaacactgaatctaggatgaacagagcttatgcccaaattgacctccctcctcaactttaaatcttttctatcaggataataattcatagatcttaataaaattgatgaggccagatgaatagccaggaggttgaggagacttgaaagccgaaaaaagtgggtattttgaagtcattggtcctgtcagagttttaatctcattttacagatgaggaaaagtaggactcaggaagatttaataacttgcctaaggtcaaggagctgaaagaatcagtactgcaaactctgctagatctatatttcatactcctaaccatcttgttctatggaaatgccacggactcttttggatgccaattttttcctgttaggtattcaataagtgcccagataaatttaagaattgtggagaacgatttagacttgctatgcaactggaaggtgaattttattctgtttcaaatctctctgtgaacaataggaaggattaagcagctggtaagcaattaggggtctgaacagctgagccccacactgagcaagacagacagtctgccaagtggcagtgagggcgggccccgggtgctcagtgccagttcaatctggcaacttggtgaccccagggattctgattcctgcagccccacagcacctccactactatgtttaataatttccgcatctgtcagcagatacccagacatccccaattctcatgctgatgggcatttgctctcaaatgaaaactgggatgaggaaggcctagatgtctggatccccagctaagacaggggtttgttactgtggtgccagagttctcttttgtgcctcttctcagcacctgcttggcatgttgaggatacaaaatgtgcctccctatcataatgcacccaccccatgccctaccccaagttatctgaaagggaggcctcgtctcacttatcctgttttcttagttagggtaaagaaggtaggtccatcctcccatcaaccccagctctcctctgggagaaccaaaccctctcaagagtcctcccctttcaaatttggaagcacaggtctcttttaaacattgcaaggattatctattactcatcaaatcctatggtctttattacaatatgccaaatatgcattttggccaaatgctaaaaggccagtgtcaaaattcatatttggtcaaagccaaggccaaagtggaaaataaccctcataaaatgaccttctaggtcataaggatacatctgaaaatatatcaaaatatttattattaaaaatctagtagtcacctttcatgagattgacattataaaccagggacaatattttctcaggtactgtcatctgctggattgtttgtgtggtcactgtactgtacaagtgtgataccaaatggatgctcactttcaaatgaggttggtggataaacaagattttttgaggcttgttttgtcaagtaggattctgctggggctaaggctgccaccacattagtgagcctttctttctctctcctagtaaccaagtaaggttaaggatatttcctcctcatctcttggacttgaacactggttcatggtgatgcactttaactgaagcaatcctccccaaatgaagctctgtgcattgcttggggaagatgctttcttaaattttcagaaacagtcttacaagttatcttgtttcatattatgaatgatatgaataatcatgattattcatatcattataatcgtatttcatatgattataatgaaaataatctcccaaaaaatagatgtgtgatgtagtctaatctctgttgtttgcccttgtattgttactgaatttaagtttttatagaatactagttggcttagaaaggaattaatgttctttttaaacttatcaactaatactcagtatgtataaactgtcaatctacatctctacttatttaactacttggaagttcttaatagttgtttttgaatataaaattaacagctttcacatcaccattaattgtagtagcatttaacttttgcaaagataaatatgcattcatacttcaacggtttgaaagaatttccatgtacaaagcccataaggagattttttgttccatgctacattagaatatctacctctaagtttccattagaatttgaatgtgaacattctgataatatcaattaatcagggtgacatgtcttgttcatctcacaaatgttatgtttactaaatatgagggtaatatgcatcatgacgtgatcattgattgttcacaaatgaccagaaatgatataggtgtttagttgttttttgtttttgccttcccaggaccaagactaatgcagattttgtcttaatactgaatctaaaacgtcatgttggatacatctttagttttcatcttaaatacttttaggaccgtgttcaaagcagccctcctttaaaaggtcatcccttcacttgaccttgatgttcctgctaactactggtccactacttcccttctttcacgggcatacctctcaacaaaggtcttccctctttccttctattccacagtactcactcattcattcatcaaagattgtctgagcttgtgtaatgtggcaggcaatgtgctaggtcctagagatacagctgaaagtaaaacactgccttccctcaaaaagcttatatttctagagctggaaagatgggtaaacatgggattactatatatagtctgtgattaatgttatgaggcaagagaacacagggtgctgtggtaactcctaggaaggtggcacctaacccagcctagagaggcagaggtaacttgctggggtttcccactgaggctggttagaagaaagccaagaaaaccccaaaccaaaccagacataagcattaatttggttcttaccctttttgatgaacccagttggtacttggtgtgattaaatgaccttcttgtaaaatccaatggtccttgtttttgtttttgttttttctttcaatggcctctgagacttgaaaccatgcacattttccctttcctgatactctggctctcatggcctcatctgctccagtgtcccctatccttgttgacaacttctgtgcttcccttgatgatctctccttctcttctctctatctgtgtatggaaacacacccagggctccacctgtggcccctggaattgtcttctccttctaggacagttaatcaaccttcaaggtttctatacctttagtccaaaacttccctcatttaattcctttgcaccatacctcggactacctgtggatatgtcccattgtctgtccgtatgtctatctcactcctatcctggccctcctcctgtagcaaagcccatcactaggaagagaatggacattggccatcaacatatcaattacaattggttttctccttctgggaatggtagcaatggtttcatttcaagcctcgtttcaaactataggatatagattttatcccgttagaggaattttttactccagcagacatatgatgtagttttttgttttatttttctggccggggctgcgtgcacttcccaactctcttaaaataatagcactgaaaatacatatggaaacaggtttattgtatattattatcaatcaaaactgaagaatgtatttaaatatatacagaatgtgtatgtgtgtgtgtatatatatatatacctacatacatatatatactatatatatacacacacacatatataatgtatatatttgttatttattgctacttaacaaattatgccaaaactttatggcttaaaacaacaatttattatctcatactttccatgtgtctggaatttgggaacagcttagctgagtggttccagctcagggtctcttgtgtggttagagtcagaattttggctaggtctgaagtctctgaggacttgactggggctgcaggatctgcttccaagatggctcactcacatggctgttggcagtaggcaacagttctccaacatatgggctactccattgagctgcttgaatgtccccatatggcaattggcttcccctagaaagagtgatgagacaaagtgggagagagagcaggaggaaaggggtggggggtaggggtgggaagaagcaatagaaaactgcaatactttttatgacctagtttcagaaatcacacaccgtcacatctgtcacattctattagctagaagccagtcattacatctgacccactctcagtgggaagggaattaggttctaccttttgaagagaggagtgtcaaaaactttgtggacatattttaaaactaccacaatttgtggaaagatatctgcaataataaatgcaacattttaaaacaatgattttatctgggaggtgagattatcaattatttgtttatatttttcccattttatgaacataactatattaaaataataaaaattttaaaatagaccaaaattgtattatgctgatgttgtataacactgaacatatttcctgaaacatcctcaaaggatttactggaaatggtttggctagaaatgtttgcatggcgcagaacttctgaagtacatattattgttatcctcagtttatcggtgatgaaactgaggtatagagagattaactgaggttaacaagctacccagggtcctagagtaaataaatacgtggtatagataacatggaaacctaggcaacagagttctatagcccaagctcttaaactaaatgaaacatccacaatacatattggactgtatagaatcacactgtagatcttacaaacaatagctcagagatgtgaaagagtcaagggctcatcttagtcagggaaattttcattaaaaaggtggacagtgagctgtgccttaaggaaaaagtgagatttgggtaatctagggttgacattccaaatgagggacacagcctggctgaggcttaaaaatgggttggggcctggcctttccaagcatgtcccagtgagaagattagtgcaggtaaagttgagtgattcctggtaagctgtgtgagttaaggcaaaatggattgagatggtggtaggggtgggatgccagattcagaggaaccccagatgcaggcaggaggtcaatttgtattcatacacagacttggagatcttggccctttaccatcaggaaggaacttagaaatgttgtggctcgtgccccttattttaaatataggaaattatatggaagaaaatgattcattcaccccaaatgtatttcttatttattctgttatgttaaaggttgttggactgttaaagcattttttaaaaacatcttaattattacatttttaccattaattttttttctagtacaaggaataaggaatccttttactaaattaggctacttcaggctatagcttattccatactaattgaacctataagaattctgcgtgctagactaggacactagattcaaagaagatccgtttccagaattactcagtgcacttcatgctcacgtggggagatttacttacttatttgtttgtttgtttagtatatcatgttctggatgcatagggcttctcaaaccagatatacaaacctgtctgcaaggactaagcagtttaaagtccatgaaaacttggaaattatcaaagttagatgttttcagcaaacattggaattttattactctcagaaatagtttccagatggaaaatttaaaaatatccaaataatgaaagacaccctatttggtttcttttctgtgtatcaaagtctatgttgaaataaagcacttaaagagctgggatcagttctccatgttactttgtacccatttcacactgtgggctcttagatgatctcataatgttaattacctagaaaggctggatgaaataattattttccttcaatgactaatgatagctggtggatttttatcgcctcccccatgattttttcagcaaggattcaaagaggttttgccacaaactagatatgggttccaactcctggatcattttgaattcgctagttcagactgaagatgacaggtgattcagagtacacacacacacacacacacacacacacacactgccctgggaactaggcaggatgtctttatcttgctgggtaatttccagggtaccaaccttggcttatacatggtctctagtaatttccaagaatgaattatagcttgctgtttccacctctcatctctttcctccctccctcctttccttcctttctagcaacaatgtaagagaaacaatatgcaattattgctggggcgcttcgaagccaatcagggaaaagaactgtatatgtgacattgtcaaagaggtcaggccattagcaaggcaattaatgtaccctatgatgcctctcattgagagtcaagtctccttaatagctaatgtggggaaaataatcttcaagcatccattacagctcccagataaatgcccaagggaattagttcactggctacctctagttgggaacactgttctcccctgacctgaggccttcgtactcagtcacagctctagcctctcttaggtgactcacctggctcagatccacatccaaagcactgcttagctttgccctcttctcactcttcctgccatctggggggcctcctattcacacactcccaggatttccaatggactctttctgacttccttcccaaacccagaatcatgcaatcaaccttaattgtcactattttatgttaccacttctcaagcttcttattgagtgccatttcctctgcaattttttttgcctctttggtttttcttcagttgtactttctatccttcagcactttactatggtattttttaaaaaagaaaattgcccctgctaatggggattaaattgtgggtgtattaaggcacacattgagcaaatgttttccaaaggcagcatgtattatttccctctttctgtattttgtatttttttaaatggcaattttattttgtagtgaaataatgctataaatgtaatattggggggaaaagctttagctcaatacttggttattcagttataatttctgtcacatattaatcagatttctgctgagataatgatgcataaaaaacaatgctccaaatctcagtaatttaccaaaaaaaccacagttttttttccctcactctttggtctgcaggttgactgggagagcagcaagtaggtgcatgtgagtgaaacactgacatggggtggggccagcaaggaacaggtggaagaagacgaagaccccagaggtgggcaggtggcaggtttacaagggccttatgcaacaaggagacaatggggaaccccagagcttttaaagtaaagaagtggcaggattttattttagagaataacactgatgttgtatatagaatgggccaaagctggagtcccctggagtcagatgtccacccagaagggtgtcacaggagttgaggcaggagctaaggagcctatgaagtaggactttgggccgtaaggaagggatgcagagcacagatactagaaattcgttccaggaggcaaaaatcgtcagtctattctatgtagggagtaaggggaggagaggctagggtgaaaccaacattcaaaggccatctaggaagagggtggtgcagccctggagagagtaggcgagttcagtagaaaccgaggaaaaggaggaccttggcatcctgcagacccctccaggataaaaagggaaggcgtgaaaacttgtttccttagccagaaaattagttcagaatgtgggagaggcaactgactacaatgatgatgatggcagcaattaccattcattaggttgacaatgagccagatgttgtctctttttattgcattatttcatttgaatctcacaacaatcctatggaataggtactattactatccccatttcacagataaggaactgacatgcagaattggtaagattccaaagacacccagctgataagtggtagagcagaaatttgattccaggtgtgtctgcttcttcatctctgcttggtgagacagttgttaccccagtgttaggctgatattcaggtagagcagactggcctatgactagagggatgatttcacacttctctgaagtcctcttgaaatagtctgaattatataattcagtgcctttattttcacaatcattgttcggttgatggattgattgatttcagtggtttcatgacaatcatcttcctaactaataaagttcaccccttacaagagtagtgtcaggcctctgagcccaagccaagccatcgcatcccctgtgacttgcacatatacgcccagatggcctgaagtaactgaagaatcacaaaagaagtgaaaaggccctgccccgccttaactgatgacattccaccattgtgatttgttcctgccccaccttaactgattaaccctgtgaatttccttctcctggctcagaagctctcccactgagcaccttgtgacccctgcccctgcccaccagagaacaaccccctttgactgtaattttccattaccttcccaaatcctataaaacggccccacccctatctcccttcgctgactctcttttcggactcagcccgcctgcacccaggtgaaataaacagccatgttgctcacacaaagcctgtttggtggtctcttcacatggactcgagtgaaaagtagcacttttcacttcacagatatctttcacatgcatcttctcatttgctttttataaaaatgctgatgggaatgcagggtggatattatgatcaccaccttttagtccaaaggtcagcagagattttccttaaagggccagattctaaagattttaagctttgtgagccatatagtgtctgtggcactactcagctctgccattatagcatgagagcaatcatagaccaatacaatacaatacaatacaatacaatacaatacaatacaatacaatactaaattattgagcatagctgtgttccaataaaactctatttacaaacatagatgactgtctatatttggtatgtggccatagattgccaacccttgctctaggtaaataaacttccatgcaaagtgattaaatgatcctcccaactttatatagctggtagaagtatgaatggaacctagacctcttgcttgctttattcatttaataaatatttattgagtccccattatgtgtcaagcactattgtaagtactggggacaaaaaaggtccctagccgcaaggaccgtgcatattttggggacacatatgatgaacaagtaaatgagcaaagaagataacttcagaaagtgaaaagtgccataaggaaaatacaactgtgatagagggcaactgtagctacaggaatcagagtgatccagtctgaagcagaaaaatgtgaactgcaatctggaagaagagaataagcaaattatgcagggattttgggatgattattccaggcaaatggaatagccagtggaaaaaaaaataagtgtggctagagcaaagtaaataaggaagaggagatctgagaaataacagggggcagataagggcaagaattataaaccatggcaaaagatgtggatcttatttgaagtgaagtgagaagtcagtgctttcctggttttaacattccatccttccttttgtgtctcctctgctgcccaagcacgaggcagatactttcagaatatattggttgattgatgggttctgtcactgaggtgccttcaaggcatgaaagacttaacacgctgggctcattgaagacccttatgaggggacatatttagtagatcctctttcattgtaggtttccaagaaggctgtgcctaatgctttttttcagagacagcatggtggccctttgttctctcctggggtgattctgggcatcatccagaccatctgctctggccccggctccctggccatataggctttgccatcatttgacaaaacactccaatagctaggagtgagatgtctctgacatcagagccactttgtcaggatgaaacatcatggtggattaacagttttgtggcaatccagttctaagtgtacaattgaccagctgtgaggaagcaactcaaagagttgttggactggtgaaatcaacttatgtatgttcaagtcctagtatactgcctgggccttagagtgcccagtggaagtcagctgccttttcttcccaaatgctcttgtatttagtgtttactggccatgtcccattgaaagcagtgattcacttagcatcctcatttcattagggcttacaaaatactaaaatattttaggaagccttaaagtaattgaaagtaaactgatgcagttcggccatctctgaaattattgacttttcagagagaattgttttggtggatactgggatgttcctccacccagattccccttcaacagaggatgggttgtcccagccactggaagtgcagtcagcagtcagccttcagtgtcagctgcttcagagattgcctcatgctacagagaggagcctcaccaactattttggcccaatttgggacaactctgaaggctccagagcttctcaaggaggttagctgaagctgttgttgagcttgcttcacagctcaacttctccctctatccaatcctgctgccgtctccttctttccacaagtgtagatcctaagatcattctctaaaaaccatcacgcatggttaaactccacccagagtctactttccagaaaacccaacctgtaacaattgggtacaggtgtcagtgttagcattcctgtgatcttctatttgtgaatttggtgctcatgtaaagtacttccttacaatcgttagcatttatgtcctgtgtctgaaagggtatatgacctatgtattgtttacaaatgacttttcttctgtaaagtttaaaaatgacagaaatgtcaaatattcactgaagcacctggaacatatttctctatgttataagagctaaaagaattttaagggatctttgattactaaatattcattaaatatgaatgacatggatgtatatcaaatgagaggttaattatagacttatctatgaggttatgtatcatatcagcatgcaagagaaggagaacatcctggcatttgaggggttaattcagggtcagaaagattaagaaatttagaaacgcatagaaaagatggtatatcatatttatttgaatcccaggctactgagagtttgcaaatgcttttaaatggttgtacatggcagcctgtgtccttagcagagagtgtccttgggcaaattagtcttagagaggttaaatgagggttgttgtggtgattaaatgagaaaatggatagatggtacatggtaagtgctcaataaatattagcttctgctgttgttgttattcaaagtggcatctggctagcagtccccagggaaggttctctcaatatctaacaaaaacactaatgaaggcctaggggaaaaaaaataaagctcccaacgtggaaaataagactgatgggtaatctaataccagaaccatgaaaaaactggaactaattcccggacagaaggagctgggtttggacacaaaatcaacttcataaaaggtagaaaaatagttcgtgcttctgtcactggagattcaggatttgaactagccagaaacttaggggcatctctcttttctcctgggtatgggaagagacagtacatctacaggcaacaggttggtagggtattatttgcatggggcctttgtaggaagaccccaggtagcagtgtaggctgagaattgtagtatttgacataacacatcagttcagagtaccagagaaccagacggtgaggtagggggaagacgtcagattgcaaggaacaaaggcacacaaaattaagttccacttaacttgctcatcaacttgtcattttgttataaatagtaaaagagtgttttaccactagcatgggacagtgtgcaggacaaaggactagctaagacgaataaagaaaaaagtagcaatggggcctgtgaaatataccacagaacaaggaaacagacagtatctagaagattcaggagaaaaacttctgataattaagtgaatccagaggaaagcctcaaaaaactatttgacatttgcaacagagcataggaagacataatcttcatgaaatagctgtggaacattagaaggacggcactgaatattatttaaaaatttgattataaaatcaaattaaaatgtcaaaaattattccaaaatgagaaaatacatgattttaagaaaatgatagacttaaaatcctttattatgttattaataaaaacaggtttattgggccctggtagtgagggtcaggaacattagactgtattgtatcccttctctcaaacagaggaaactcaaatgatataatttcactgctcattcataaggattagacagagtgcaaagcgtttataaaaataacttctaaatgactattaacagaattaaagtcaattattgtcaaagaacagaaagcaaaagaaaccagaaggaagaactaaaaataggaaggcatagaataagatgacagaagccaaattagtgataacaatactgtaagtaggttaaaccagtggttttcaaaattgtaagcacttgaagcttattttcaagtgaaatactatgtttaatcacaaactacaaagctctacttttttcagttgcatgtgtttattataaagccaattaatgagaccaaagttaatgaaaagtagcctccactgagtgcataccaccaatccttgagctgtcagtttttttgaaaattgatctgtagatgaatgcaattccaatcaaaatattgtaggtgtgaaaaaggaaagcttcccccttcatcctctgaaggcttgctgaaaatgaactgacgaaaggcaaattaataggaaaaaaaggcataaaaaatgtattttaacatgtatagaatgggagaatttcaggagaatgatcactcaacaactcaatgggggtacagatgcttgtacctttttcttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacggggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccatagtcatcctgggccgttctcaatgagctgttgggcacacctcccagacggggtggtggccgggcagaggggctcctcacttcccagtaggggcggccgggcagaggcgcccctcacctcctgggcggggcggctggccgggcggggggctgacccccccccacctccctcccggacggggtggctgccgggcggagacgctcctcacttcccagatggggtggctgctgggcggagaggctcctcacttctcagacggggcagctgccgggcggaggggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggtgctcctcacatcccagatggggcggtggggcagaggcgctccccacatctcagacgatgggcggccgggcagagacgctcctcacttcctagatgtgatggcggctgggaagaggcgctcctcacttcctagatgggatggcggccgggcggagacgctcctcacttcccagactgggcggccgggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcaccttgggaggccgaggttggcggatcactcgcggttaggggctggagaccggcccggccaacacagcgaaaccccgtctccaccaaaaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggggagcgggagacggagacggagacggagagggagggagagggagagggagagggagagggagagggagagcagaaacttttcaatttaatcacttctactaccctagtctctctccagatgcttgtacctttttcataggggaagggaagtgggggaaatgtggcaatttgagggatagtaagtgatttttagggagaaatgaataggcctaatgctaagacaatggtaagcaaataattttctttggaaattgagtgggatagagagtagacaaaggtttgggatgaagtttttctggggttttagatgtgatgttgacgttttagtctctttaggtccagtagcaaggggaggtcagagagattttgaggctgtttagttcagctgtatttcagagtgaggtgaaatattctggtttccttcataacaatgcaatttttattagaaagtgacaaaatgagtctaaagaacattttggaaaaataaagagaaaataagccacaaagacctaaaaagaagagtatgaggggggtgaagttgctatgccagatattaaagcatactgaaacactctaataattaaaagtgtgataccagctccagaatatccatagaactttaaaaacccaactatatgtgcatgtgtttatattttttaatttagaaaagattgcaattcaactcaattaggaaagtatggattattcaacaagtgatattaagccagatgtttaacattgagaaaaaattcagttaacaaaattaattataaatgtattaaagacaaaaagtttaaaagtgaagacataaaagtaagaatagaatatataatataatataagataatatagaaaataatatatgcttgtggtggagaataactttcaaaacatgacatcaatggcttataccagagattcactgctgaatttagaatgtagccatgctcattcattgacatattgtctattgctgtttttgacctacaaaaacagcattgagtagttgcaacagagaccattaagctggcaaagcctaaaataggtattttctgaccctttacagaagaagtttgctgacacctgtcataaaccatacaataattttatgtggtcaaatctaaaaaccttagcacagaaagtaacattgtaagcaacaaggaactgggaagaatatttgtagtatatgtggcataaaatggttgcaatatatatgttatatatataaacagcttttacaaaaaactaagaaaagttgtacactagtagaaaaatggtcaaaatacagaaacaggcaatgcacagcataggtatgataaatagccagtaaacccatgtttaaaggaatgtattcaaaaaataccacaaacagatattagcaggggctcccagccccttggctgtggactagtactgtctgtggtctgttaagaactaggctgcacagcatgaggtgaggagcaggtgaacattaccgcctgagctccacctcctatcagattagcagcggcattagattctcacaggaatgtgaacctattgtgaactgcatatatgagggatctaggttgcatgctccttatgagaatctaatacctgatgatctgaggtggaacagttgcatcctgaaaccatcactcctcctccccctgtttgtggaaaaattgtgttccctgaaactggtctttggcgccaaaaaggttggggaccactggatattaggaaaccaaaagaagaaaaatactcaatgtgggccaaaatatggaaaaacagagtctcatgagcttttggtgggtgtgaaaactgaagaggaattggtagcatgtaggaaaacctttaacatgtatatacccccccctttttttttttttttttgtgatggagtctcgctctgtcgcccaggctggagtgcagtggcacaatctcggctcactgcaagctccgcctcccgggttcttgccattctcctgcctcagcctccccagtagctgggactacaggcgctcaccaccatgcctggctaattttttgtatttttagtagagacggggcttcactgtattagccaggatggtctcgatctcctgaccttgtgatccgcctgcctcagcctcccaaagtgctgggttataagcgtgagccaccacgcccggccgtatataccttttgataaagcaactccactacaaggatttactctaagtaagtagctaaggagtggtacaatgattaagttccaaggatgttcattacaggattgtatataatggtaaaacattggaagcaaatttaaatatagaagcatatggcattttttaagtaaattatcaactcatgggataaaattttctaagctattgagattatgttgttggactcttttttttttttaaaaaaaaaaagcacaaatgttcagaatatattcctgagaatagaagctaggtcaaaaaacaacgaatactttgtaattgcatttttgaaaagaaattcacataagaatttttggcaaacattggttaatattagttatagctgccttgtgggataacagatgacttttattttctcctctttgcttattcatatgtaagtgttttattgaactgtctcatccctgtggggtatgaagaggaaatggttttatttttctccattctaagctctcactcccacaactgtgccatatgaaaaatccctccctgctggctcacagactccttaaggacatcttaggatgattccttaactttgctttttggatattaaaaatctgtccatttcatttacccttcagaacttttctctttccccagggcctgagaggtttgtggcttgaggggcgtgaagtgaatatggtttgtggtgagctcctctgggatgctctttctctgccccttgctcttcctgctacttatctggtatgggcaaaggaaaggaggcggaattaggggaaagagccagttacttagctgggctcccttgcaatctgcttttggtcattgctccttctctgacaggtcctaagtgccctccttttgaggaggtcaaaacccctgctctcctaaggggcgatgagatgtgtaccatttgcctctttttttatctgttccaactcctgctttctctccaggcctgctcaaccactaggcttctggggtggggacatctgcaaaacttgctcagctttgcttcctttgcagccattctcatgacacatgcaaaactcagtcatgaatggcaaaccaaacttgggaagtgcaagctgcttcacagtagctctgctgtctcttccactgctcttccctgctcagcagggcacaaggatggatcagtaagtcctctccctacttagatttcaagacaggacctggtaccagtctccacctcttccagggaaagccaatgttactactggtgattcccttagagcctctcctctggcttgactttcttcatatttggttagctttgacaaaaggaagtgctccggtccattgaagggtagggaggagagagaagggaattcaacagccctcctcacttctacaatgagctaggaatccagaaatgtccccctttttcctctccctgtcccctcttataaatcagggattatggaatgatgaaaatcctagtgggatttttttctttgaatattttaggaagttctttgtgaagaatgcactgatgaataatgttataaaatgtgaaaatttgaagttatttgaatgttttttgaaatatttccaactgcccacacattataaaatgtgtgggcagttggaaagacttgcttgaccagatctcaaacacattatacaattacagcataattatgaccaaaaatgttgaatgatcaatttttaagagaacacatagccctcgaacagattctagcatatggaagaccttagtgcgtgctaaaggaaatatcagactaatgagaagggatgacatattcaacaaaagtgctgagaaaattatcttggaaaaaatattatgttacattctcgtacaccaacataaatttcagatgcatttagaatttaaaatgtaagcatgaaaattctggaggataaaataggtagttgtagaactgatcttaaattgagtaaactatttctcagccccaaagcagtggaaaaagatacaaagaaaaatatgatcattttctgaaaagtaaacatatgcaagtatgttatgggtctattgaaaactccatctaaatagaagcaagtgagatatgtcaaatccattctagtataacaggacagacaacaggctagtatatttaacacataaatatactaccagtcagcagtcaaagcactaatgtcttcatagaaaaatgggccaacacagaaatagaaaggaaagttgtattcatgaccccaaacgatatcaaaaacatatctgacctccctagtaataaaatactgcaagctgggcacagcggctcatacctctaatcccagcactttgggaggctgaggtaggaggattgcttgaggccaggagtttgaggccagtctgagcaacataacaagacccaatatctatagaaaattaaaaaattagctgggcgtcgtggtgtgcacttgtcccagctattctggaggctgaggtgggaggatcacttgaagccaggaggtgggaggatcacttgaagccaggagttggaggctgcagtgagctatgatcatgccaccacactctgggcaatggcgcgataccctgtctctacaaataaatacatacataaaataatgcaaacccaagcaacaataaaataccttttcacctataaaataagagattttaaatatgtgcaagacgataacagaacagtgaggtgatcatttttatccacagcagatgagagagtaaattgccctaacttttaggtatgcacttgagcataaagtaaacagagccttaaaactcctaatcctcttccacttagttattgcactcctagcaatctatctcaagggatgaactgaatgttcaacacaatttatgcacaagaatattaatcatatatttataatcatcaaaagttgaacagaaagacaaatgttgcatgttctcacttatttgtgggaattaaaagtcaaaacaattgaactcatggaggtagggagtagaggatggttaccacaagctgagaagggtagtggggtgtggggagtggggattgttaatggatacaaaaacatagttatatagaataaataaggtctagtatttgatagcataacagggtggggatatagtcaataataatttaattgtacatttcaaataactacaacagtataattggattgtttataacacaaaggataaatgcttgaggagatggatactccatttaccctgatgtgattattacatattgtatgcctgcatcaaaatatcccatatgctccataagtatatgtacctactatgtactcacaaaaaattaaaaattaaaaaagttgaaaataaactattatatttttattgggcattcaaaaaatgcattacaatgtctttattggatggttttggtacctgtgagatatgccaaatattccatgtgttggagaattttaattgacatggccaagtgcttatgtgaaaaaaagctaactacaaaactatttatagcatgactgatttttttttcaaatctcagaaacatggctttgatcattttagtgctcatgcctgttagattgtgcttttttcatatagacagagagaaccttcccaaggcatgagaatttcagcccaaaaaggaaacagaagggattcagtcctatattccagttatagcagtcatccctgtcctcttcactctcctttctcagtgcatcctctgtcaaaatttttaaaattgtactagattcaaatattcaatttctattttcttaattatatttctaaatatttgtttttcttatattgttgacattttaagaaaacagcttaattgagggataattgacatgcaataaactgcatgtattaaatggtgcaatttggtacattttgacatatgtatatgcttgtaaaaccatcaccataatcaagataatgaacatagcatgattgggattttattataagaacatatggcttggaaagaactatgccataaagctcagattatttatatttaacaaattttattttactcttttgaatgtgttttcaaaattttctatgatgcatatgtgttacttttatgatcagaaaaactttgaggaaaagttagtaacagtgactaaaggtgggtggcagaatggcaggtcaggacttgctgccttatggaaaccaaataaagagaaattcttagtgaggaaggctcaagactttgaaatctcatgtatcagacaattaggttccatcagaaagggtccagctccatttttgtggaaaactgatagaggagattaaaaaagagagagtgagttaagaaatgaatgggcttggcagagtggaagaggaggggctggggcccaggtgacaagataagcctagaccctgaggagggatacttcctcccctgagaccagaagtaatgaaactagagggaaaagagaagtcagacaaaattttatattggtgggtggagagttaacagctacatcacagcatcacttttgcttatggagcaggaggcaaggttgtctcctaccaataatttgacttagaggtcataatgaaggacattggtgcttgcattgaagaactgcctggtggcagaagaccaccgtttgaaatagcccctattttcctgttttgctaaattttgtcagtagattggggcagaagaaaagtgaggtgtgggattaattcagtgttggagttgacagagaagaagggggtaagtaaagaatcaaagagttagggacacaagttaggtcaggggtactttattattgcaggagcaattgctgggatataaattagaaatatctactgttaaaaaagcagtgtgtgtgtgtgtgtgtgtgtttaaaaacttaaaattatcactcttattactggaacatggttgattttgatcatatttcaagttggattatcacattctcctccagctaattgttcacccaatatcatttagttggcattttctaaacactccctgtgctaattcattccatcattacaatatagcagttaaatcagctcccttgttttaaatgaaatgccaggagtagtacctgcctgaagtagacgttctacaaatatgtttaatagatgaccaagtattcctgtgcatttacagtcacatataaaacagtgcatcattaaataatggctttgagattctttcagatagccacgaataagacaatgttagcattatctgtaatagatacttgggaggaaaataaatttatcagtattctaggatctctaaaatggaagaatagcctacccaaccaaatcaatggcaaatgtggtattgtcctcagttctacacagatcagatgacagctgcgaatggatgttatctagtgaaaatttcccaccatattatacttgcttgcttcaggcatcttcatgttttattaaagtcactaaataaattgtcatttcctttccttgctcttggaatgttctaaagtttctgagagtcattacttttcagagagcacatgaaattacagaagttgtttatcagcactaggtatttcctttgagagttgagctttagggatagcatatatttatttccaccaatcatgcaagctaaaggaaattgtcaagaactaatattaaacagccctaatagatttgcattaactctagatctagtattcaccaaagatcattttcagcagtttttgtatgcttcctatctctgccattctcatttaagctatgttcataattgaagagtcactgtcttgaatttatattttgaaagatgccagcctgttatatggagtattccagtgcctgagtttcagatctaagcttcgtcttttttccaggaggatcctcatacagtggctgggtgaagtgacttttgttctctactgcaagtagtgatgtctcagtgaaggtactggaaactttccatgcttcagtttcctcatctataagatggtaatagtatgtctggctttatacaacagaacttttcagagattcaatattttttttaatgggagaacactttgaaaataattcagggcaaaacaaatacaggaaatttttcctcttgtaagaagaattcaactcaatgcaaagaaggttttcccttctggaatgttaccattgggatcctggcatcatttctctcagtattttgatgaagacttctggttgaaccactcttccatcattgtttagaatccactacacactattcatttttagtctcttataggagctaaatattgtccctctctggatctcatcctgtgtacttggagcaagatggcacccaaggctctgagagacccatttaagactcttgaaaatttggtagttggaactcggtagtctctgctgaaggagaaaagccatccttagttattgaagaatagtttttatgtttaatttgatttcattcctgataacttaattgttatactgatttgtttataatgttgaaattacctcttagctcagtcagtaatgatttattttgatattacaaaaagtcattaaaggtaagataatactccttctcctattactttgctgcttttctaaagataattgccttaagatttatagttctcctattcttaaaataagaacatttgtccacacaaaactatttgcctagctctaataaaatattatccacatagacttttttctggagaaagaagtatacttgaattctgaacactttcactatggatttaatctctactgcaaactacaaacattatcagtgtgaagataggaagtaggtatagtgggatgagtattagtagcatttagtgctttgggttggaatgacaggagtttagttgcaatagttaggactttgaatgaggatttgcgtctaagtttcttttcttttttaaaggctgttggaagagtttctacctagataaaccaagaacagagttatcacattacccctgactatttgaggtagcagatactgttagagccccacccatatctcttcagctttagggatttcattgcatgccagcccaatttcaaatgccagcaattgcatttttgcctgagggctttctctgggtgcttgagccaattctactcttgcccatagcaggccagaagcaccaggaaattaatgccacctgagaatagccttcaattaatggctgatgaaaatagctgaataaattcctcagcctttttgcttctgggacactataacactgagttgtgttctatgctgtttctcagagttctccagtgggattgagttcacattgccctcagtggtaacttcatggtaatgcctcttttattgacctttccttctctgtctcacttcctcactcctttactggtggtttctagaatcacctccaaaaaaatctacttgcacttaaatacttgacttacggtttgtgtctgggacagttgtgaatgtagaacagttggaaatctagattctgtccatacaagtatgtttagggagggaggttgacagctgtagtcaggatagggataatgaaggatgaagagtgaacttacggattcacatcgtagaactattcgcaagggctatgatggcatcagagagaaggctttctgcccttaactaaaagggcaggtgaacaagtaactcagttcgtgtggctgagagagaagcaaagagagagaaagacgaagagagagagagagagggaaggaggggacttgagggccaggggcaggaagagaacttgacgttgagagtgacatatgagagcatggacaccagagttcacaggtgaggagtgataacagtgttgcttgtggcaacgcagtgcacagtccattctgatcagcacagtggcagtaagagcttttctgagataccagcattcccagcacacaccacccttttgtggctctcccttcactcaccctacattaccaccaccccataggaggcatggctaggacttggttgatacagatttccatgcatctctccctaactatgttatttaaaaagcaaatgtggatggaccatttctggtgagaataagaaacctgtaggtagttaatattcccagttcatggtagagagcagcactgtaagaggagcaagatgttgtttgacatttaaaaatagacctaactctaccgattagtctgttctgtccatggtaaccttattcaatgttatggtagtaatcgcttctggaaagctttgacatattttataattgaactgccaggttcacacttagctataattcattcacagataagtgtgtcttgttaaccaaattatgttgactcccttggaaggccagtgtgaggactttcctgtttcttgtcttcatgtggttttatagtctcatgacagaccattagcatgatgaaagattgattattgtcttgggtaccaaactgtaatttggccctattttcatttttctttttcatcaactgcagaatcatatgcatttatcaaaatgggtgtcatctgttttgaaattcatgaagttagattgcacacttgtcaaacattttttttctggcattgacaaaacatcaacatcaagctttacttaagttatttagaaatagagatgtccaggtgaaagaatggtggaatcaaaatgaaagactaggggctggaatggctcattcattctaccgacattttttgaatgcattcagtgcacatggcaaattgccaggtggtgagctggagtctgtgaatggttggagagacatgaagctgattcattcactcaaaaacgtttagtgcctacagtgcttgacactgtactaggcactggggaaacagcagtaacaaaacaggcaaagtccctttccttacagagcttatattctagagagcttatataatataaaagaaagggaatatttagtccttatcctcaaagatcttacaatctacttggaaagataaagtaaatgtattaagttaaaattacacagcaatgcaaaaatgggacaaatgaataaagaatgtgttttacatgtaggtggttaaagcaagtgcaataaaagaatgacccaacactgctctgccagaaacttgctaggacctcaaggaagtcatttaactgcccaaaactgttcctggagcagtgatttaggggcagttttgctgctgattggagcctttgactatccgtcttgaaggccattcacaatgagcaatctggaagaaaggcaatctctgaatgcaactttaaaaacctaaagtgaatatcatacgaaatgctgatgcatatattcatttaagatttagtgacaagataaggttgcctgttagcactgtttggatttaacgtggtattaaaggttgcaagcggtgcatcagacaaggaagattaatacagttttaagaactggaaggaagaagttaaattgtcattatttttagacaatctaattgtttatggagaaaattcaagaaactcaacaagctattagaactaataagaaatttcaacaaggttggtggataaaaataaaatttgaaaagcagcgatattccaatacatcagaaacaaccaattaaaaatgtaattttaagaatcctattaacatgagcaagaaacacttaggaataaatgtaataaaaaatataaacaacttgacataaaaaaactgggtggagagtactacatgtttgtagatgttatttcgacaaaaatcccagtagttgtgtgtgtgtgtttgtgtgtgtgtaatttgataagatgatcttaaaatacaaacaggatggtaaaaagccaagaccaccaagccaatttgaaaaataaataaataaaagcaaggtgcaagaacatgacctaacatatatatacatatatatgtagaaatatatatgtagatatatatatacatatgtatatggatatttatatatgtagatatatatagcaatattacattaatttaaacagtatagtgttgctacagagactgaaaagtagaccatttatcataggaaactgtaagcatttctgtgtgagtgtgcttatgtattgaagtgtgtgaatgtgtgtcctattttaaaatagaagtattctagtctcagttctcattgaagcatgaagacaataaatcctatactccaaagacaccaccatacaaacatttcaaagtcaaaatatgacaattgtttattttgcctctgagcccttttctttcatagaggatgtagaaagcagtggagacttggaggggggtttgtgaagaaaatttctttggtagttgctgtctcactgcaaactcctgccagggcaggacagttcggattgctctccctttgcctcaggtccaaggagaagaaaggactgtgagaagttggtatggaggtcctaatggactggtgctgggccccttccatgaagtttagaggctgtgtaaggagcagggacctgcgttggcgatggagcaagtgcccctgtgctgagattggcttccactcttggactttgctggtgctaagggtgtcagagtggttcctgtggatgagatggggccacgtgcagaagagagagccagcctggagctttacacaaccctgtcctagagaaccaccaggaggggcaaagagattccaagagagagtgatctatatggagtgggcacctgaagagcaagagccgagaaaagtagccagcaaggggagaggcatttgcctggctcacaggacatccacctcaatgcctcaggggaaacgtttgttcaaagagagaaagtcaactgtggtgtctgccaggcccagagagtataaagtcatcttttactccctcttctctccttagctcctttataatcagaaagctggggagcaaggtaggggcagggaattggaggctttaggcagagagacaaaggggaaggatcatgtactgttctacaacacagtcctcatgtctgcagaaggcccagctgggtgcaaaaatataactttaaatcagtttgagttttgatcattatataggactaaactttcatatgtatgtatatattcaggctcctgctataacaccaagtatgcatttctgaaaaacctctcatgttgcaaaatcacacactataaataactggcttatgggaaaaatagagttggggcagaccactcaaaatatatggaaatttctaactagactactaacaaaaccataacaattctaataaaaaccctggcatagttccatctccaccaatatttacactcagcctcacaatcagctgatccttgtctgctcttggccatagatttctttcacatttgagatgcaggatagtgagggcattcaattatgatgagaactttaatcaaaacaaaaaatcagatgcagagtgcagacattttaaaatcaaggtccttccttcctcccgcttccctctccacttccacatcctccctctctccctccctcctttcctccttccctcctttcctcccttcctctcactctctctcccttccttccttctaattggccagcttcatgtaatatcttgttgacggcaaataatctcagtgtcaaattttggaagatcctaagaagtcatttaattgaaattattgaaaggaaactttcagcaaaaccatgaaggatgctcatcggcacactggcccacctaggctcttatttcttcatcatcatttgctcagcttatcttgattgcttgatcaatgggttattttgccagccatcttttccttcatttggcccttcatccactactcagctgccaggcccaagtctccatggtctgtgtctgatttgtgttgtgatacagaacttaaaaacagccagctaaactacataaaaaataaatacttccaaataccacctaaaaacctaatggcatggctctgataactatgtctaggaaatgtaaaatgtaaaagaaaaatttcaattcaacactaaacatgtactggatgcttgaaaaagaaaaatatccatttctctaccaatgaccaccaaccataggtagttgcatccatggcaggaaagagtcaagaggaagaggtagaccagagggaaaaacagatggataataagaaaaataagccatcaggttaccaagttgaattctagcagagtctctgttgaaacttctctctccttctaccactgtctcagcccatgcctccctcagggtactcacctcattccctggtgaccaagtcttctgggtctactgcacatttatttaataagtatcttggctgcactcggttccattgattgtgaacttctcacttttcataacaaaatctgtagcctgtaacagcagtgtgactgagaaaattgcaatcctgtttccaagtgatccacagagatcagaacaattcctgaggaacactgtttcttttgaactatgtaatcttcttttgtggtcctatggtatccaaaggaaatctaaccttgtgactttatcagggaccagagagaaaagcatctagaatccaagatgagtaactggcatttaggtttgataggacacaatggatttaaattgtttctgaggttaatcttttttccttgactttgaaattgtttattattggtcagaggcccatgtttcccacacaatgatagagctggaatcaaggttcttatccacttgtttccaaagtccaggcttaggtaacaaggtcattaaattcagaataatggacatagtttgctagggaatttaagggtatgatatctttgtgacttggtaggcattgtatcaccacaaagggagcagattccctgttgtacaatacgaaattagaatcccagcaatgattcttgcccaccgtgtgactttgggcaagtttcttaacctctctgagtttctacatctgtatagagggagtaaggatttatacataatgaagttgtgagaattaaatgagattatgcatgtcaagtaccgcatgcagtgcctggaacatttggaaacagtcaaatagtaccttgctactccatttttgagccctgtattactttttgggaattgagctgactggaacaagtttgatgtttgtcttagtaaggatgggctatgttatactgtcataaaaaataatcctaaaatatcagtgtcttataacaacaaaggctagcttccttctttctgggaccctaggtagcagagtggcctcgtcctggaacattgccagtagttgtggcaaagaaaaagggaacatggcgaggaagagattggcccttaaaacctccatccagaactgacacacatcacttctgcccacattcattggtcaaggcaagtgacttggccatacataggttcaacagaatggagaaatatactccttccacgtggacaagcagcaaatattggtgaagaatagtagtttaccacagggttggttcagctgaatgtttattttccagctttatttctctgaactctccagacaaacatgtggagtgagtatctgatcatatgattatccactcatatgagaagtttttgtataatcctacctacttatcctttaagtatcaactcagatgctgcttccaccatagtcttttgggattctccttgctgaaaaataaactctttccactgtggtatgacacttttcttcctagggcatgcaccacacactttcatggattataatgtattatttgtatagattttttttcttgagagtaattatcttcaaggagtttacaatctgtatcttattaatctttaggaaaatacctagttcagtgtcttgcacataattgattcaaatatttatagagacagactgaagatctgaggtgagaagtgataatattggtgggcaaggtggaggaaagtgggtgttacacaacagagaagggtctcctcttgaaggcaaatatatgttttctggaaaaaccttggtagtaatcatgggaaactccctggggaaactggatgtcagctgagactcctgagaactacttgtgcagggttcagaaaggacagaggctgttagagaaaattaaagtcatcagacaaatatatcagctagtttataattagcaattactgcaggaaggagaaacatttatcccattctgacaacaaagattgcataattgcaccaagagtgtttgcccacaccctttccaagatgtgttaagcatttacaaacagaaacaaatagccttaacattggtgggagcagcaagaaaacaggctttcttaggctgtcactgatccatgaacactaggcaacaacatggttaccatgtgggtggatgaaccgtgtctccatgttcattttctttaccaataatctctagtgcttagtcaggtctgagaaagaaccaagaaaaatcaattcatccccagttactggagataccaataaatcacctgtatatttttaattcaattattaggtattgagaatctactatgtgccagacagtgatagcttgagtctacccagtcttttaaatgacatagagtcttattctcaatgcctttgtaaatgtttttccctccacctgaaatattctgatctctgtcccctacatacccttctggttttgctttagacatcacatcaattcggaagaatttctagacctccagacaaaggtttcagttcccccttcaatgtgcttttataacaatataaacttcctcacacacaaaaaagcacaattgtattttcttgtttaaattgtctgtagtttccattggcctatacactcttagaaggcaaggcctgtttcttgctcacttctgtatctcctgcaccattgtgatgcctgatgaaagttgattaatgtgtcattatctttttatggctattatatgattatattattacaatgtattaccatgtcaatgccctataatagtgttaagtgtctatgtacttttcagggatttagccatttgcagctagctgtaatttttgaagagctatcttctatgtgtagcgtgctttttgtttcagtgagctaaacaaagccaggtttgtctctgtgactatcttgtggtgtggtcttgggaaataactttacgtcttcaaactttttccctcatttgtcaaaaaagaatgtgaaataagagatgccatatgtttgacattctgtggtggcaactgtgtggtgattttgaaacatgacccaaacattttttaactctcctcccattgagtggtggggtctatgttccctcctcttgaatctgggctctgtgactgatagtccaatagaatatagtagaaatgatgctgtgccagtttctaggcccagactaagaaactgacagcttctacttcctgcatcttgggatgctcacatttgaaactcagccaccatgccgcaaggaagcccaggtattccaaagagaggcctgccatggaaaggaactgagttccctggtcccccgtcccaactgagctctcagataacagccagctctaagttgccagccatgtgagtgagccattttgaaagtgaatcctgcaggcttccattgagctgccctagctgatgctgtgtaaagcacggaggagctgttcctgcccagcccttctcaaattgcagatataagaataaagtaaatgattgttgttgctttaaaccactaggttttggagtggcttgttacacagaaatagataattgatatacaccttttgctacttcacagtgtctcagacctttcatccactacaatattctggtatgtataaaattaactccagacctttgagaaatcaatgcttactccaaatttattacaggaacaaaagcagtaaggatgagatgccattaaacgatcaaatgctggttgagtagtgcctctcctgggcttcacagcagaggttaatggagaaaactttggttaaattaactgatgtaggtgacaaatgggccaaccactctccattggaatgtaagttctatgattggtgataactctttgaaggactttctggagatgactgtcaattacgggtggatccccaaaccacatgggaggctttcccttcatttattttgtgcaaagtaatgttctcaacaatagcactgaggtatccatttaccactgcccccctcagtggcctggggcttggagccgagaccatttctttcaaatggcattatgctacatataaaataagatatttacatcctccaataaataagtctctaggtgaaacagtctagggtgcataatgaagagaagctcttctttttcactagctaagacgtcaatcttcaacaggcttgggaaataaggattgatggtgacatctttgtgctaccattgtggtttctgggactggtggcttctggactaggtaccaggaccgaacttctgtgattactcttctacgggagggagttgcttttcccccttagagcacaatggttgtgagcaacagccctggagccaaataatctgggtaaaagcccagctcactagctgcatgaccttgtacaagttactaggcctttctatgcctccattttctcatcatggtgataatactagtgactgtttaatatggttgtttttctaaggttaaacaaattaatatgtataaagcatttagaacaatgcctgtaatattgtttggatgttcatcccctctgaattcatgttgaaatgtgagctccaatgttggaggtgggcgcagtgggaggtatttcagtcacggaggcagatccttcatgaatagcttggtgctgtcctcttggtaatgagtgagttctgactctatgagttcacacaagatctggttgtttaaaagagcctggcacctcctccctgtctctcttgctatgtgatatgcctgctacccctttacctcctgccatgattggaagctttctgaggccttcactagatgcagatgctgacaccatgcttactgtacagcctgcagaaccatgagccaaataaccctcttttcttcatacatttcccagcctcaggtatttctttatagcagtgcaaatggagtaacacaacctgcaatgtagaaagcactatataagtgttagctattactattactgttaatattgtcattagttaattttatttttattttcttcttaccttacagctgattaccttgcctataatcagatcctttatgtatggacaccaagcagagctgccacattcagaaggccttttattaattgcaaaagtgcaaagcataccattggaacagggaacactttgggcatcctcttttcctctcttattcctgggactttgtccgccacagcactctcctcttagttattcctcctcctaggaactacccactcccattccacttctactagtccctttttataccatcttttgaataacatatttgagaaaagatttggggtttgaggcctcgtatattttgggagtttttttcccccaacactcaggtttaagtctacacctcagattgcattccctggaaatggattctagatagaattgtgtgtagaaggtttactgggttgtgctccagagaaatacacgcagaaggaagtgaggaaggcaggactggacaaaggcagaagactcatgatggggttgctacagaagcctcagttgatcctatggggagtgctagatcagggaaggcccttcaagttgtgccaaattgaggtttatggggccaggcttttgaatctccaaatcagacactgaagccgaactacctggaggaggcataaacttgggcaggctgtttctcataggcaagggcacttcatgtgaaggggtgcagctgtgaatcatctgcagctgatagttccagcagctgtggatgggtgcattgaccctgagaagaggatctggacagagcaccacagtgtccactaatgcagacaatttgtttcaagaaagatatatttctagtgaaaagagctttgaagtatactcacaaggggtatacgacccaggcaaattattgaatctctctcaccctccttttctcctatacattggagatgagatcatttctaaaggctaacagggctctgcgactgcatctttcctacggggaatactcagtcaagtctagctcccgtcccatcttgctcaattgcatgacaccaaaaatcttaggtccagaaattctagccccggtattttcaaatggctctggggcctgtatgtctgttctcacttagcgctagccctgagggcaggaagtgaatgccacttaagcacctacaatgagccaggctctctgccagctcatgtcaccttcaccacaacactgagggcaggtgttaggtcctcattttacacaggaggaaactgaagctcagacaggtgaaacgacttgcttaaggttatacggctaataaggggcagagacaagactcaaatccatgttcatacactgcttcatgtactgctgccctggcccaggtataatgctcttcactttaaagcccaagcttccagaatatagctggaaacaaaaaattaaaattttaagggggattaatattttacaaatattgatgtaattttctattctgccttcctgagcatgtgattgtactctagttggctcatgatacccaagtacctagaaatatttttgaagctatgtgtctgtatgtgtgtctgggtatgtgttagggttaagaaatgttaaggaatacagaaagagcatgaccatatttgcagaatatgattgtgcagcagggcaacagccttgtaagtcaggctatagtcttagaaaaggatttgctcagtttttaaagctcattccctttttacaacatagcatatccagcctcaagggcccagagtagaactaaaacacactgagtccacacagcaaagccatgaatcttgctgctcagtactagaaggagaatatgacccagggaactaagagatagctgaacccctttccctcccagaagaaagtgggaaggagaaagaggtaagaggaaaatggagatcaaactaagctgttatgcgtccctgattgttttcgctccaggtgtcagtaaggagatggtgaggggatttagagaaattagggtaatgccaagagtgaatgaggcatagcatggctggacagaggaagcccctaggttaaactttgtggtactgccagtgttcaattcctggacttggagttaccatagacttggagttgagaatccatggacttttcccagggatcccctgtgacagaatgaagaacaattttactgagtcttggggtagatatctgggccaacaggcatgatggagcacttggcagagacccagggattggtcagtaaccagtgggggttgaagtgaagccaagtcaccactgagttggaaacaagctgagagggttagcaaacaagggatttaccacccacagccctcagtggatagtggggacacagtaaatagtccattcaaaaggggactaaggtgttccccttattgctttggaggcagaggtcaccatgcctgaggaactcaagctcttcctgccatcatgaggatgcattagtcccccaagtcctgtcccattgaataatagtgtgttagatattattttccctattcccacacaggattcattttcatccttttctgcacctaccagctcccttgacttctggcttctggctgcctttggctaatggacatcaccagcaggaaggcaagagtgtgggtagaaagattgggcttattttcttcctgctccctccatacctgacagtggattaaaggggactgcattccccggatgaaggtcacagcttctaatgagcagccctctcccatagccataagcctcaccaggctctggaactcttacctccttttactcttttaggcttaggggtggcagcatcctcctactgttgtgggccttaggtgctttcccatctcttgttggcttctcttaaccctatctacacctttgaaaaatagacccttaattaaatgaaccccttttgactgtggtttccatctggatagaatgactttctgtactggtttgcccccagacagtcccagtctattccaattattccagtataattatttcagcatcctgctttactctcagaagttcctggtttggacagtatcctactcctgggaccctgactgctgtagcatcttagggagggtggcaggaggaagtgttataggttatatttgaaccatactgcgcctttaactaactggctttcctgcacactcacaggaaggtatccaattagttatagacgcaatcaaagaagctaaatttcctctacacttgcaggttgtgatgtgaatgatttttcaagtcctatttctcaatcgtcactcctgggggacaggactctaccttatgcatctctgccagctcagctataccaagttccctgtctggcccaatgttcataaacactgtctgaatgaacaataaaggaatggtgtcactatattcaatcagcgtgacaactcactcacacatagaggtaaccatggcaccagttcttacaggagctgcacatatttcacagaagaagatgctgttaaagaaaaaggaatgggaggaatggatgtgtgtgtgtgtaggtttggacatgagattataatctaaatacgaattcacaatgaagtctcatttctgttattagggtgagcatgaaatttaaagatctgcctgcagatactgtggtcccaacaacgagcatccctgagtgcagtcagcctccttgcatcaggagttagaactcactgcctctacctcctgcctgacctctttctccctttatctgaacaaatatgaatagaagaatctcagtagaactcatttgtttctcttgagaagcaggagtctggggtactcaacgaccacaactgcctatgacaacttctcagaaactcaaccagccaagagtagccttagcccttctgggtgggcttgcactttctctcaggcaatgatgttcattactgagatgctggtggccagaggtgggtgttgtgacagggagtttcctgtgcaccttgagccaggcctgggtgattccacagttgtagtcctgaaaatgacacttatctcatactcatcatggtgggtctctgagtactcttcgattttgactaccgctcctctgggctctttctccctgccatacagggctcaccctcatattaagcaacctctatcctcaggtccgggatccatttggggtcacctttttgctacagcaacttgtcatgacctcccctgcggtggacttgttatttatgggctccttcttaccttttctctggccatgaccacaagcatccctgagattcctgatagagtctctgcattctgattctagctccttacgactgcccccacttgtttcctataccctaaaaggacaatgggttccccaactcaagagatgtgtcatgcttaacacatgactgcacatttttgtcactcgtcccatcaagagctaaagtctaatccccttcctcttgaacatggcctggccatagtggtttgcttctaacaaataaaatgcaaagaaaattattctttgtgattagacctaaactacatattaaattatttcatcttaaaagatgagacagcattggcctggctctctgtcttttttgagaggctcactcttgaaacccaacccaggcaccagagacaggccacaggtgggtgttctggcctacgaccccagcagaggtccttgttaacagccagcattaaccaccagatacatgagtaaggacaccttcatgagaactccagttccagtctctgtctgactgcaaccatttaagagaccctcaagagaaaaccagctagccgagcccagtcaacccccaggcctatgaaagataatattaataaatggttgttgctgttttaatgccatcgtgtttggggtggtttcttaggcagctatagacaaccataatgagaggcaagaagaacttggataaagctcccagagagccagaggctgattaaaaggttatatataaaacatgataacatgctggggaggctgagcttctagccaaccaaaggaaagatcaagaggaaatttaaaaaatatctttaaaaacgcaacaaaggagactaaaccttcttgagttccagtgaggacagcataacaagaaatcagcttaaattgtagcatgacaatttgggattgatgtaagcagtgatttttgagtggggaaaaagccctgggtagtcatattttcacatatcatatatcccctttattgtcctcctacccagttaggtgcctgcccttccttcatgttcactgtggtttctaaaaactattaatacaaaatataataaatacagattgaagataaaatgcattaattagtttatagatattcattatttgggttttaaagaattaacaaagaaattatgtccaaacaagatttccttagaacagtgtcatctccttaaatagtatgattttttaaaaattaacacacctgggttagttggtttggagctatgtaatataatttgccaaaaagattcatgtagaagtgtgtactggagagatatcacttagcattctcgttatacatgagactattttgcaattccatggctttcaactttcttcaacctggaagcacccccatcttacctcatctgcctgtacagttacctgttgctaagtaacaactgcaccctacccaaaataaaatatagcctaccttccgtatctgtgggtttcacatatgtggattcaaccaaccataaattgaaaatatttgaaaaaaataaaatggatggttgcatctgtactgacaagtagacattttttcttgtcattattgcctagagtgtaacaactatttacatagcatttacattgtattaggtattatgagtaatctagagatgatttagtatacaggaggatgtgcaaaggttatgtgaaaatactatactagtttataccagggacttgggcatcattggattttggtatcctcagggtcctggaaccaatccctccacaagtatgaagggacaactatattatgtaagcagttatttttgagtgggggaaaaagccatgggtattcatattttcacatatcatatattgcctttattgtcctcctacccagttaggtgcctgccctatttatatagctcatgattctgaggattggttgagtcccatggtgtctttgaaactctagtctgagactttgctatactgtatatagtttggagacgtgttgagccatcagcaggtgaggtgctccatagccaccaggagtactgtagttcatgagcagagactcagaaacccttgactggaccgccgccctcactcagtcttgaaatatcgtttgtttttattccccaccccttccacacttacccatccactgacactctttgggcaggaacctggatttacagaaaacatccagaaacctcttgaaggaacaagaatgaccctcctgcatcttaaaggtaatcacaaaagctgaactcggagaatttttttcctactgcttctgctgaaattttttgatgctggaaggcatttattcagcttttattattttcttattaaagaatatttaatcttactagtgggttgctgtgggtggtgatcacttcagagggaagaaaaagaaatccaagcatatttctgtggaaaaaatacgtgttaaccattatatgatggtacattatttagggttaatatacagttcaggaaagaacataagagaatagcttccaaaccatacagaaagcaaaatcaactctgtgtaaaccataccctgtattaacaaactctgagctgtgttatcttggaaaccagattgattttctggtggacattttttctgaattaacttattgtttataaagtaccctggagctacaaagtaacattggttatacaatggatcagaaattctcttgacctacaatgttgaaggctcaaaaaagaaggcccaagagaactaagagagggccttggaatgtttaccttgtaagtaccaaggccagaatcttgaagaaaacatataaatgacactgccattaaacaaatcacagtttagtaaaatgttaatctaagtttgtcctaccatttgctatggtagaacaatccctttagtttaactgccccaggaaacaatactctgtctgtgatagactggttatttcttaatgtcttcatgatctgtgaaatggaaaataataatagtaatagtaatagtaataatacccccttcatgaggttgttttgagtattgcatgaagtaacacataaaaatgtgtagcccagtgactggtacttaatactagctaacactcagagtcatgatgagtattactgctagtaggcatcataatgcatgtaagaacatgtgtttttaaatttgatataattgaatttaaatgccaattgcttttttaaaaacataagtagcaacacatccttgggtatatcaccataaaattgtgataatattacctgtcttatatagttgctatgaggcttaactggaattacttacaaaaataattgaacacagtgtctggcacatggaaattaatgaatgaatgatagctcttattactctttggaacttctatagtatctagagagatatgtttggtctgtgccatacctgatggtatgcaaaaacaagccactgtgcctcaggatttgcggtaattgtgggctgagtcagctcaggtcctcctagaagatgggattagatgtaaaatgacttattgggagaggctcattttgatggataaatgggcagtaagcaagagtaggcagagagaaccttcagagtgggaggcaggtctgactcctgtggaaagagagaggaaggaaggaagggtgggtagggagagactctgatggcagtgcagctctgagaaagtctcacccaggctgatggggagccccagagcacagactgcacataggagaggttccctgtcaggcaggaatagcccagctctagttctctcactgtactttgccactggcctggggtaagcacaaccttggcatgggtgccacggtggatctgaaggttttgcagctgtagactgtcagcaaatgatgctcctcctctgagcagggctcttgaaaggagatctgaatgccgtacctctatggccaccgaaaggtgccaagttaagcagcatcccagtcagaattatctttgttcatattagttagggctggtttgggccaagccctcataacagaccctttctaaatgtgaaattgaatagaattttttaaaaataagaaatactgcatggagtatttatagagaacaattgaggcacttaattgaaaaactatgatattatgaaaaattaacagttttcatttagagaaaagtaacacaggtgccaacttgtcctgtttgattcctggaaggaagacagaccctacatttcttttctatatgtaattgaaaaaaaaaactggagattttaagtgacatctttagttatgaagtttcaataattcattctggtgtctattcctaattgcactgatcagatttatttaaactttctgttttagagggatctcaggaatataatagtagaggtagagtggaggaatatagccagtctacatttacctcttatttctacttctacaaaacctttgtgttttccatgtgtcctttgtattttcctcatattttgtgatgtcagggagggaactcttttcctgtaccctgttaggtttagtgactggggccgatgaactaaactgacaagagacagataaggaagagaaaagacagtttttgatcaccaacatgcatgtgcatatgggagttcacaaagaaatacgactcaaagaggcagttcgaatttggagcttatacaccatcttaataggggaaggggagagagagaaaggatatttatcgaaaaacaaatgactttttcttggaaagataaataagcccttaggagaataaatgggagatatgagcgtttctctgacaatatctgtttagctgtggtgtggagacttctcaatctctgatgataagagtcagtcttccccagtttctcacaagaagaggatttatgacagttgagttcttctgagttctttgggaagctctacttttaggcagataagggattttagaaattcaaatgtcttctcaaaataattttttatgctacagagacatactctgaaccccttcagtgacatggatactgaaatattggtttgccacacaatttgagggcccagaacaaaggtagtgcgtaaagctcactaatactactggtattaccttgccagttcagtgtttacttactggaaataatttaatagtggtggaaaacaatccagaggagcccataagtggcatttgctgatggcataggtcctggaaacaccttattggaaagaaaaaaaattacaacttttctaatcagaatattaccataataaggaaaagaaattggaattgagggaatgggaaaggggagagaaagtatgaacagtatcagacaggaaatttcagagccaagaaataacaggtttgtggctggataaactgactgcttaagaaaagccaacaggggtgaaccaatgaaaatgtcacatgactagggaattgacagggctagtaaaatcagcagcaggcctgaagaaattaaaccttggcagtccaggcagagaccatgatcacagttgctatgacccattctgaattttctacctgagttgaaaatgaggtgagagtgaaaacaaaagttgatgtttacactgctggtatcctatggaatcattgtagagtttttgatgaaaaacaatgtaagttctgttgtttttattttttattttttaaaagatgagcatctctgaaaggcaagggcaacaggattacatactagataagtttgctgatataattttgcctttggccagagtaatgcaggactaaatagtggactcaaacttttgttaagagtgtgtttgaggttctgctagaggttggtaattacttgataccattgactaaacaatactcctatactatctgggaatcgatcctctttgaacaaatgggtatattcaatactattttttgcaccattgtttttaatgacaaaaaatctgtaaataatctgagcatatatcaatagagaaattattgaataaattgtattatatttatactatgcagctattaagaatgagttagatcaatacttactgaccttgagagatatctatgaagaaaaaaataccatgatgttaaaaaatattccaaaattacacctgagagactttgaaacttcttttgtttatgatttgaaccatatatgaatccatctggttgataataaaaagcaaattattaaattatagttctttcaatttagctagtagatagcacttatcttgtgtttggcacacttttctctgcctcaacatagctgaaataatcttgagaaaatagtattataatagtataataataaaattactactttttaaaagttaaaggagtaagtagatttggggtggtaaaaggtggagtaataaatgtgctaaattgtttgtttacagttaggtactttaaaaaatgtttaaattcgagacgaaaagcaaagatgttttatacttctttttgagtagtaggagaagagatagagaagcaaaagtgatcaatgtaaaaggtgtagaattgcctatatgacttcatattgatacggctcccatgaatggaggaacactagggttcttgatcctcatgccagtttagataaaatgacacggacacacatggagtggttttaaggagcggagagtttaataggcaagaaagaaggaagaagaaagaaggaagaactcccctccccccgtacagagacagagggaagggggctccaaagccgagagaggagatcccaagtgccacagataccagccagttttgtgagtaggctggaggaggtggtgtctgatttgcatagggctctggggattggtttgaccaggcatgtcattcacgtagccctcgaaaaagctggccctcccaccctagccttttaatatgcaaatacagggcaccaggatgttctacacacgtggggatatgtgggggctgtcatgttgccaggaacatgtggggcaaggacaagaaggcctggggggatcgccgtgattgagtggaccatttctaatggcttgcatttgcatatcaaaggttgctggcctggctctaagagctgctttaaaaaggaaaagtttccaaggaccacttttcctctctatctgcctaaaataatttcttaataactcctacaacaatatgtgtatagagcattgcagttttaaagacattttcacatctagctccctacgtgtcagagagctggatatatgcctgccatttcacagaaaaaaaaagcataatgtctctgagtgccggctaaattggacaattgataaaatctgtatgtggagtcagtcaagagaaaattaaggttttcttcattggagtttggaattgagatattcttcagtgtaaataaatacatgagctgcgctgtggatgaactcacagctctcctgtattttacagaggctctgagagatttggaagcagaatgaggatggagtagaagggataccatctgggttgtgatgcaagttaagaggaaagagcagaggacttggggtatagaggtcacagatgaattacagtgatgattatgatgagtctgggtacagaactcccacttctggtaaggttggactagttaattaagactagccctcctgctgaagacagctaagaaaagctgacacatatacatgaacacaaacatacacacacacacacatatttcgtattaaaatgatattctcaaaagtgccagataagttagctaaaatttaaaaaaaaaaaaatggagtggagaattactgggccagaaaccacaggaagatagattctcagggagtgaggcagggtttggggccagttttcccttgggatagctgtcatttccttagcaggtgactaagaacctaaaaggttgaatgctgcttttgatagcattataagtgtagagatacagggtttgacattcagggctctctgaggccttagtaccataggtctatatcctaggagtaagggtatacctgatacaagctttcacgaatactgtagttcaactcatgttcaatccctaagtggattgcagtgatactgaatgagcttaatcctccgataaaggcagaagcaaaggaaaatctactttggaggaggctaatagtttcttaggcctcacataatttctatgaatattttataaatacaatgtctggcaaacaaaatttagccagatgcataagagacaagatcacctaaaagaaaaccagcagaaacaacagataaggaataatcaaatacacagcttaaaatactttttactgtgctcagagacagaaattaaaattgagaaaataggcatataattggaaatatgtaaaagaatgaaaaataaagttcagaaatgaaaaacacaacaaaaaattaagaactggtggctggcaagatggccaaataggaacagctctggtctgcagctcccagtgagatcaatgcagaaagcaggtgatttctgcatttccaactgaggtacccagctcatctcattgggactgcttagacagtgggtgcagcccacagagggcaagccaaagcagggtggggtatcacctcacccaggaagcacaggggtcagaaaactccttcccctagccaagggaagccgtgaaggactgtgctgtgaggaacagtgcactctggcccagattctaaccttttcccatggacttcacaactcgcagatcaggagattccctcgggtgcctatgccaccatggacctgggtttcaagcacaaaactgggcagctatttgggcacacactgggctagctgcaggagtttttttttttttttcataccccagtggtgcctggaatgccagtgagacagaaccattcactcctctggaaagaaggctgaaggcaggcagccaagtgctctagttcaggagatcccacccctcggagcccagcaagctaagatccactggcttgaaattcgcgccaccagcacagcagtctgaagtttacctgggacactcaagcttggtgggggaggggcatctgccattactaaggcttcagtaggcagttttcccctcacagtgtaaacaaagccaccaggatgtttcaactgggcagagcccaccacagctcagcaaagccactgtagccaggctgcctctctagattccccctctctgggcagagcatctctgaaagaaaggcagcagctacagtcagaggtttatagataaaactcccatctccctgggacagagcacctgggggaaggggcagctgttgggtcagcttcagcagacttaaacattcctgcctgctggctctgaagagagcagcagatctcccagcagagcgctcaagctctgctaagggacagactgcctcctcaagtgggtcgctgacccccatgcctcctgagtgggagacacatcccagcaggggtcaacagacatctcatataggagagctccggctggcacctggtgggtgtccctctggaaagaagcttccagaggaaggatcaggcagcaatctttgctgttctgcaggctccactggtgatacccaggcaacactccagcaaactttggcagacctgcagcagaggggcctgactgttaggaggaaaactaacaaacagaaagaaatagcatcaacatcaacaaaaaggacgtccacacagaaaatccaactgaagatcaccaacatcaaagaccaaaggtagataaatccacgaagataagaaaaccagcacaaaaaggctgaaaattccaaaaaccagaaagcctcttctcctccaaaggatcacagctcctcaccagcaagagaacaaaacgggagagagaatgagtttcacaaattgacagaagtaggcttcagaaggtgggtaataacaaactcctccaagctaaaggagtatgttctagctcaatgcaatgaagctaagaaccttgaaaaatggttagaggaattgttaactagaataaccagtttagagaagaacatacatgacctaatggtgctgaaaaacacagcacaacaacttcgggaagcatacacaagtaacaatagctgaatcaatcaagcagaaaaaaggatatcagagataagatcaacttaatgaaataaagcatgaagacaagaatagagaacagagaatgaaaaggaatgaacaaagcctccaagaaatatgggactatgtgaaaagaccaaacctacatttgactggaatacctgaaagtaacagggaaaacagaaccatgttggaaaacactctgcaagatattatccaggagaacgtccccaacctagcaagacaggccaacattcaaattcaggaaatacagagaacaccacaaagatactccttgagaagagcaacctcaagacacataattctcagattcaccaaagttgaaatggaggaaaaaatgttaagggcagccagagagaaaggtcaggttaccacaaagggaagcccatcagactaacagcagatctctctgcagaaaccctacaagccagaaagagagtgggggccaatattgaacattcttaaagaaaagaattttcaacccagaatttcatatccagccaaactaagcttcataagcaaaggagaaaaaataaatcctttacagacaagcaaatgctgagagattttctcaccaccaggcctgcattacaagagctcctgaaggaagcactaaatatggtaaggaaaaatcagtaccagccattgcaaaaccaaaccaaaatgtaaagaccatcaacactatgaagaaattacatcaactaatgggcaaaataaccaactagcaacataatgacaggatcaaattcacatataacaatattaagcttaaatataaatgagacaaaagtcccaaataaaagacacagactggcaaattagataaacagtgtgcatcagtgtgctgtattcaggagacccatctcacatacatagacacacatagtctcagaataaagggatggaggaatatttaccaagaaaacagaaagcaaaaaaaaaaaaaaaaaaaaaggcaggggttgcaatcctagtctctaataaaacagactttaaaccaacaaagatcaaaaaagacaaagaagggcattacttaatggtaaagggatccatgcaacaagaagagataactatcctaaatatatatgcacccaatacaggagcacccagattcataaagcaagttcttagagacttacagagagacttagactcccacacaataatagtgggagactttaacaccccactgtcaatattagacagatcaaagagacagaaaattaaaaaggatattcaggacttgaactcagctctggaccaagtggacctaatagacatctacagaactctccaccccaaatcaacagaatatacattcttctcagcaccacattgcacttattctaaaatcaaccacaaaattgggagtaaaacactcctcagcaaatgcaaaagaacagaaatcataacaaacagtctctcagaccacagtgcaatcaaattagaactcaggattaagaaactcactcaaaaccacacaactacgtggaaactgaacaacctgctcctaagtgactactgggtaaataacgaaattaaggcagaaataaacaatttattcaaaaccaatgagaacaaagacaaattgtaccataatctctgggacacagctaaagcagtgtttagaggaaaatttatagcactaaatgcccacaggagaaagcaggaaatatttaaagtcaacattctaacatcacaattaaaagaactagagaagcaagagcaaacaaattcaaaatctagcagaagacaagaaataactaagatcagagcagaactgaaggagatagagacacgaaaaacccttcaaaaaatcaatgaatccaagagttggtttttttgaaaagatcaacaaaatagatagaccactagctagactaataaagaagaaaagagagaagaaggaaatagacacaataaaaaaatgataaagcggagataactactgatcccaaagtaatgcgtactaccatcagagaatactgtaaacacctctatgcaaataaactagaaaatctggaagaaatggataaattcctggacacatacaccctcccaagaataaaccaggaagaagtcgaatccctgaatagaacaatagcaagttctgaaattgaggcagtaattaataggctaccaaccaaaaaaagcttaggaccagacagcttcatagctgaattctaccagaggtacaaagaggagctggtaccattttttctaaaactattccaggcaatagaaaaagaggaactcctccttaactcactttatgaggccagtatcatcctgataccaaaacctggtggagacacaacaaaaaattgaaaattttaggccaatatccctgataacatcgatgtaaaaatcctcagtaaaatacaggcaaaccaaatccagcagcacatcaaatagcttatccatgacgatcatccctgggatgcaaggctggttcagcatatgcaaataaataaacataatccatcacataaacagaaccaacaacaaaaaccccatgattatcacaatagatgcagaaaaggcctttgacaaattcaataccccttcatgctaaaaactctcaataaactaggtcttgatggaatgtatctcaaaataataagagccatttatgacaaacccaccatcaatatcatactgaatgggcaaaagctggaagcattcccttagaaacctggcacaagacaaagatgccctctctcaccactcctattcaacgtagtattggaagttctggccagggaaatcagccaagagaaagaagtaaagagtattcaaacaggaagagaggatgtctaattgtctctgtttgcagatgacgtgattgtatatttaggaaaccccatcatctcagcccaaagtctctttaagctaaaaagcaacttcagcattctcaggatacaaaatcaatgtgcaaaaatcacaagcattcctatacgccaataatagagagccaaatcatgagtgaactcccattcgtaattgctacaaagagaataaaatacctaggaatacaacttccaagggatgttaaggaccttttccaggagaactacaaaccatagctcaaggaaataagagaggacacaaacaaatggaaaaagcactccatgctcatggataggaagaatcaatatagtgaaaatggccatactgctcaaagtaatttatagattcaatgccatccccatcaagctaccattgactttcttcacataattataatgaactactctaaatttcatatggaatcaaaaaagagcctgtatagccaagacagtcctaagcaaaaagaacaaagctggaggcatcacagtacctgacttcaaactatactataaggctacagtaaccaaaacagtatggtactagtaccaaaacagatatatagaccaatggaacagaacagaggcctcaaaaataacaccacacatctacaaccatctgatctttgacaaacctgacaaaaacaagcaatggggaaaggattccctatttaataaatggtgttgggaaaactgactagccatatgcacaaaactgaaactggactccttccttacatcttatacaaaaattaactcaagatggattaaagacttaaacataaaacctaaaaccataaaaaccctagaagaaaacctaggcaataccattcaggacataggcatggacaaagacttcatggctaaaacaccaaaagcaatggcaacaaaagccaaaattgacaaatgggatctaattaaactaaagcgtttctgcacagcaaaagaaactatcataagagtgaataggcaacctacaaaatgggagaaaatttttgcaatctatccatctgacaaagaggtaatatccagaatctacaaagaacttaaatttacaagaaaaaaacaaacaaccccatcaaaaagtgggtgaaggatatgaacagacacttctcaaaagaaggcatttatatggccaacaaacatatgaaaaaaagctcatcatcactggtcattagagaaatgcaaatcaaaaccacaatgtgatacaatctcataccagttagaatggtgatcattaaaaagtcaggaaacaacagatgctggagaggatgtggagaaataggaaccacttttacactgttggtgggagtgtaaattagttcaaccattgtgtaagacagcatggcgatttctcaaggatgtagaaccagaaataccatttgacccagtaatcccattactgtgtatatacccaaagttttataaatcattctactataaagacacatgcacgcatatgtttactgcaccactgttcacaatagcaaagacttggaaccaacccaaatgcccatcaacgttagactggatgaagaaaatgtggcacatatacaccatggaatactatgcagccataaaaaaggatgagttcatgtcctttgcagggacatggatgaagctggaaactatcattcccagttaactaacgcaggaacggaaaaccaaacactgtgtgttctcactcataagtgggagctgaacaatcagaacacatggacacagggaggggaacatcacacaccggggcctgtcagggggtcgggaggggtagggaaggaatagcattaggagaaatacctaatgtagatgatgggttgatgggtgcagcaaaccaccatggcatgtgtatacctatgttacaaacctgcacgttctgcacatgtatcccagaacttaaagcataataaaaaagttaaaataaaaataaataaaacataaaaataaaaaattaagaacttacggtttacagcaaattagacagagttaaggtgattaatgaatgggaagatagttcagaagaaaatatctagaattaagctgggtaagttagaaagatcaaacatacagaagatacagtaaaacgtatggtaagatgatctagcacatatgtaattggaatctcagaaacagaacaaaagagagattggaacagaacagcatctgaataaaatggctgagactatttcaaaaatagataaaagatatcaagaagccctattgattccaagcaagatatataaaatggaattattacctaggcacatcacagtaaaactactgaacactcaaaataacaatcttgaaaaatgttaaaagcagctagaataaaaatatcaattactttcgaagaagcaacaaatgcaatgaccactgacttctcaatagaaacatcacaaacccaataccttggaatgacatctttaaaatgttgaaagaaaacatgcaccaccctagaattctacactaagtgataattttcttcagtagtaaagatgacacaaacacgttgttttagttatttgttgttgcataacaatattacacaaacatagcagcttaaaataatgcatatttattatttcacagttcatgtgggttgagagactgggcataggttagctgagccctctgcaaagctgcaatcaaggtgttgtccagaacttggttttcatttgaggctctaccagggaagactttgtttccaaactcacgtggttgtttgcagcattcatttcttttcaggctgtcagactaagggcctcagcttcttgctggctttcagctggaggctggaggttttaaacccacgtatgataagaggaaggctaaaaatcaataagctaagcattcatataaataaattaggaaaaggaagccaaattaaaatcagaggaagtagaggaaaataaaaaagcatcaataaggatacttattgacactttttattactttaaatcaatggataaaatttttaaaagtcataaaatatcactgtgcatcctagacataaaaatatattaagaagctatcatatacaactttatgccaataaacttgaaaaatttagatgaactagagaaatttatagaaaaatacaagtttataagcctgacacaagaagaaatagacgacctgaagaatagaaaaacatttgcaaatgaaatttataagcttttctacatgtaagggagaaaatctgtatttttacctcataggttcttagttgagacactcccctgaaaataaaagtcagattaacaagagaaaaaccagtagaagtttattgacaaatgctatacacatcacacaggagaggcctcagttcaaaagcacttttctttcaagacagtggcctagtggttttacttagatagtattttaaccaagagccataaattctacagtgaaaagacaaaaaggagagcatcttcaggcttccaaaaggtgggaaaatgtgagaagttaagtttgtgggaagagtaaaatctgcttctagatcctcaggcaccactgtctctgagctgataagcaagcattgtaaaggggcctatctttaggtaggaaaaggcagagggaagaaaaaccttgtctatggaaattgtcctgccatcaggcaagcagagggaggagcagagtgtcctcctgctatttaatattcttcagctcaataattcccagtattttaaacagcaatattttggttttctttatacacagaaaattcccaaacgacttcactagtacattttaccaaacatttaatgaaaatagaatggcaatctgttaaaaacgatgtgacacatgaagaaaaggagaacattccccaactcattttgtaggccagcataatcagggatactaaaaatctaagtaggatataacaagagacatttcaggtcaatattactcaagaacatgcatgaaaaatcccaaataatataatagctattcaaaactagcaatatgttaaaaatatgatagatctgaaccaagttgagtttactccagaaaggcaaggttggtttaacaatacaaagttgagcaatgtaattcatcacaacataattaagggcaaaaatgatgtgttcatctctatagatgctgaaaaaattgataaaattccatatccatttataggggtaaaaagctcctctaaacaaactagtaataaaagaactttcttaaactgataaaattatccacagaaaaaaagctacaacaaaaatcatactaaattatgaattgctagaagcttttcctttatgactgagaacaagacaagtttgcctgttatcacctcttctattcattgttgtactggaggaccttaacagagaaataaggtaagatagaaacttggaacggatatggaggagaatgaaaataactgaactctacaaatttgcttggccctgctttattttgggaagggtgtggctaggactattttgttctaagttttgtatatctttttttttttttaaacatttcttatatttggttctatgcaagtgaaatggcatattggggaaaaaatataaaacgatggttactggccatttgaattgacttctgaaggaaggagacattttgaatcagccttgctctagtcaatggggctttctgaggcttagtgaaaatttgtacttgtgccctattcaggccaaggttgctggaatatcttattttgattttactatggctgacaaaaggcagagtacagaaagagtattactttggaagatattttatctggggctatttttttagaacaaaatcaacggggtgctgatatgtgtttggatactggagcactgactgatcagtattgtgattcacctactcttaaagaaaatgacatacatctagctattgcacatgcagaaaaatgtctaagcctgatgctaatggatgagtaagcttagcttcaacaattggaatgaaaataaaacaatttattttaagacttgctattactagacaagttcaaacaacaaggatgatcataatagaattaataaagatctttgcatggtagactgacaggccatgcagatatgaaggaagcaatagatgtaacctacatagacatcaatggagctttgattatattaaaatgatattctcctccaaaagagatgaagatttctctgctattcttagatatctattgggagggtgataggaaggaaaaggtaattgagggagtcactgggtaggtgaaaagtatactcggcatgaatatacttgggagtggggtcataggttcttaagtgaatttaggatgtttccatagatggcgttagccttgtttgctttttagtctgactcaagtggttacaattaaacacggtgagtgttttccactgatttggctgctattgggctgcatatatgcaatgtcaaaacaacagaatactttggaaactttgccaacgtgggtgattgactcacacaagcagttacaaagaaatgtttaagggtcttccatatactgaagagctgatgtttaaattcatcttacttctcacaaacacataaagtgtgataaagcttgttgctcctgggtaggcaatgaaagatcagcagcacaccactgaaaagatgtgagtgtagccatatgttgagcatccctagcaattatggaatgctttaaaatggataggtattcacattttgaagctataagtttcagatatttatcttctttgatgcagccgtctgaaccaaatcttgagatttggtttttcctttttctttctttttgagacagggttttgctctgtcaccaggctggagtgcagtggcacaatctcagctcactacagccttgatctgccaggctcaagcaatcctcgcacattagcctcctgagtagctgggaccacaggcaagtgccactacacctggctatttttttttttttttttttttttggtagagacggggtttcgccctgttgctcaggctgatcttgaactctggtctcaaactctggtctcaagcaatcctcccacctcagcctcccaaagtgctgggattgcaggtgtaaggcaccatacccagccaaaatttggttttccgatgtgatttcaggattctagattgggtgctgtttctcctacactttccttccctcaatctccatgttaggttgttcagagtatgcactgtacagggtcaacacatctgaggaggcaccattcacattggggacacatacagaactaacttacctgggagcgctgcaggtgagtgtagacattccaggcctcttggctgagtcctgaagcagcaagagagcgccctctactccataaactttcactctctcaactggtcatgcacacctcagcagggcctgcactatcacatttacttggagatgaacatgtgcacatggctacgctttcttctggctgtactctgagtatctggattccaacatttcctcttacactgaacttctcatggtcacctcatctggggttggagtatgtgcgctccttacgttttatgtgctgggcaggaggtaagttcacaggaatgtatggttttgtgtgtgtgtgtgtgtgtgtgtgtgtgtgtgtgtgtgtgtgtgtgtgtacacaagcagctgccaccctcaggccctgggacgatcttcgtactcaagtggagtacattcaaataggctttatccaatccctaaaggtagtgttcccctgattccttttctctctctcctgcccttctctatttttttacacactggctacctctatggtcactgtgctaggctgaaaaaaatgacatctcttccgagatatagccacttcctaagccccagaacctgtaaatattttcttacatagtaaaaagtgaatattaccttatatggcaaagtatgtgattaagttaaagatattgacacgcagtgcttttcttgaattttctcggtggggcctaaatgcaatcacatgtgtaagagagaggcagagggagtttagagacaaatacagtcacctaatctggccagaggggtcaacagctggttgctgtgtatgattgttgggattacacatgaatatatatattagctttctattgctgcataacaaattgccacaaacttagtaacttacaacaacaaatatttattgtctcacggtttctgtgtgtcaggactctggccgtggcttagttaggtcctctgccaggctgcaatccaggtgtcagccagagctgagttctcatctagaggctcaactggcaatggatctgctaccaagctcttgtggtcgttggcagaattcatttccttgtgtttgtaagactgaggactctggcttcttcctggttattggctggaggccgccctcagctcctagaggcttccatagctccttgccacatagccctttccataggtccactcaacatggcggcttacctctccaaagccagcaaggaagaaagatagcaagttagctagtaagatggagttatataatgtaatgtgattataggagtgacatcccatcgcctttgccatattctgttggttacaaggaagtcacaggccccaccacactcaaagagagggaaccatacaaaggtatgaactccaggggttggggatcataaggccaccttaaagcctgtctactacaatacattcatttaagaaattatatggaaagatgttggtcaaagggtacaaagtttttgcaggataaataagttctggagagctaatatacagtctggtgacttaaattaacaatactgtattgtatacgtagaagttgctaagagggtagatcttgagtgttctcaccacacacacacacacacacacacacacacacacacacaaaagaaagaaaacggtaactatgtaagatgatgaacatgttaattagcttgattgtgattatttcacaatgtgtatgtatatcaaaacatcaaattgtacacctcaaatatatacaatttttatttgtcaattatacctcaataaagctgaaaataaattattaaagaatgagaaccttttcctaattcacacgaaagtatcacattggttagtagcagctttttgtccaccccagcactctttatttttttctgacaaaagtagtgctaaaatgataaatcaagggacagacatgtagttattagctgatggaaagtgataaaattggagaggatgtaatcatggtgtagttttacaagcgttctttccattttgataacttttattagaatgtgcctggttttggaaaacagaaatcttaataaataaaccaccacaacttaaaatatctcctattggctcaaattcttcttttttatcagacaaattatctcccaaacaggtcctataaatatgcatttattacaaagttgtgtgttcgtcttagtgaatttagaaagtaggggttgctcgttagtgttgatctagtttctctgggttcctgtaactagaaggtatgatgagctatagtgtgttgagtgaaaaatatttgaaaatattttcttcttctttgaaatcttgtccattctcattggcccaagcaggttttaggcctgagtcaccacttacctggactgttgccaaagactccagacttctcttattctagtctatgcctctctgatttgtgtttctcctcagcttacatactttgtatagtgcttcattcccctcaccttaaattctgagtccttttgactgttctcaaaggccccacatggtccccctacaggccagttccttcaggctcttcctatcagagtgaaggaaaaaaacatgctcttatatgccataggtctttgcacattgtttcttctacctgaaataccttcttccctttcttcaacttgtaaactccaactcatttctttagtgctttgttttatgtaattattaacttacattatgaaacctttcaaacataaacaaaatagaataacataataaacaaacatatccctaccatctgttttaaaaatattggtatcttgccatatttacctcagatgtatatttctccaacttctatagtaaacattttctaacatacagaaagttgaaagaatggtactataaacactcatatacctggcactgagttttgacaattgctaatattttgcttattcattctccttctctcatttcatttattttatttattactacctcctccaacaccacatacacgtggaacatttaaaactaagttaggtcattgcaggcatcatcacttcaccccaaaatatttccacatacctctcctaagagtaaggtgttctcctacgtaatgttcacatcattgctgcacctacaaaaattaacaagcattcccttacttcatgtaatactctgtcaatataaatttttccccaaagtatctttttataactattttttctatgcaacatccattcaaatttcactcattatgtttggttttgtttctttaaactatttcattctagaacggtcatacctacaattttttcttatgatactgactttttgaagtcatcaggacaattgactaagtggcataatgcataatctggacttctcagaatctttccccatgttttcatttaacatttactttagaacatatgtctcctgataactgaacattttcctctttcccatgactcttttacctaatggttttagcataccttgacgcctgaatcaatgatataattagtgattctaagatgatggtaattttctaattctttcaattattctacatttattagttgccattcagctaaaaagaagagcatttatcactgatcaactgggagtgaactccagtttttcctctagggtgattacttcattcttttcctttaattagcaatttttaaagtaagtcatctcaattgatggcagatgagtggggttttccttcttttctttcttttgaggattattgtgggctatcttagtgtgggtttccccagaaacagacccagagacagaactcaagcgaaggtagttatttagaaagtgattccaaagacactggtagaggagtagggaaatgagacagggaagagatggaagataatcagggagtgttacttagtggctcaccactgcaattaactagagcttaatcctgatgcagaaaagagccacgtaacacatgtgccacagagctgtctcatttgagaggtatttattcaccaatttctgtcagtcattctttgaagactgctcctaggagcattaattagttggtattatcaactggccatgtgggcaggcaaaagggctccaatatccagagaaagccctccagcaaagaaacacaagtgctggcaggtactggcactcagaagtctactgattaaggggtatgagcaaggcaccaacagttaaggtcagctacactgattcatgagtttttatttattaagggtgttaccatcacttattaaaatctcccaaatttggccagtgggaaccttttcaagcctactggccttggattcttttggtacactttgattagctttgggcactttctaactttctgacacatgatgaaccagactcacttcatacttcctctgtcccagacctggaattaaccatttctccaagaaattctgattcatattatgaaggaaactaggatctgagagctaaaaatactcactgttactgagtgtgggattgcttcttggccctttgtgtgacctagtttcacaagttcacattgacattctcaattcaaatttatacagaattctttatttttaacttttcttttctcttacactgaatatactgtttctagtaacactattatttaaaaattagtataccaatattactactgagtaaatattattataatttctttgcaattctttttgttcttaccatatcctaataagtatatacagagtactgtgctctacaattacctgaaataattttctctgtctttcttttgtgctttctttttaaacattttgatacagttatgatgatttcttgtcattttagaggtttcttttatttttgaatatagtaaaacatttacacagtgcatatatcaaaacacatataagaaaatactcagaaaaatctgcctttttagtttcctggtctgcctttcctgtgcttgtttttgcatatgtatttatatttcccgtactttcttaccaagatggtagactagtgtatatactgttatgtactttgccttttccttttaacagtatatcctggaattgagtttacttcaattcatagagatcttcctcatcaccttttaaagttgcatagcactccattttgtggcagtaacacagctcataccactgctgttgaatgacatttgggttgcttccaaatctttgctttctcaaataaagttgtaatggataatattgtgtgtgtgtgtgtgtgtgtgtgtgtgtgtgtgtatgcatttataaatgtgcaactttagagtagattctctgacattcatagcctcatcagtagtttgttgttattaatgcacttgtttattcccattgtactcatattatttacactgttgcacttttccttctaaagccatttgcctccaagtttccttttgtctaattgctttggctaatacctccaatacaatattaagagtaggggacatagtgagatccttgcactgtttctaactataatgtgagtggcctgcactgattccctattaagtaagatgctggctttattcaatcttattttatcacgacaaaggaccaatgcctattttattaagtgttttaaaagaatggacttcgactattaccagatgccttatttttaacatgtatggatatgtaattttaaagatatattaatataaagcattacattaatagattttttaaaatattgcaactttcttacattcttggaataaaccctttttgttcatgatatgtgaggagttctgtggacccgctccccagttaaactgctataaattataaaaaacaaacaagcgtttaaagtctctgggaacagccctaagggcaaaatgaaaatgaagaaacatttattcaagatgatttagtaaatcagttactaaaactcaagaagaactctaagagtctgtagtatttgtaccctccctcccttctctccgttcggtaactcagaaactccactcaatactggtatagccaagaatacagggctcctttttctcccagctcccaattgagggcttacttactggaagaggcacaaaatcaccatttctcatcctgccctcagctgtctgtttctgaatctaagctctgggcaagtacaggtgagagggaggggctcccttcttctgcccagccctcacgtatggaatggagtctctctaccttgggtgtgttgccactgagaatactagggccccattcatctttaacccagctcaaggcacatgagttccatgctgcaacaggcaagcagagaagacctggtttcatctaggtttctgaacataattataacgactacttgtagtctttaatctgtcaaatctgacatttggtcactcacaatttctgctgcttgatgtttgtttgtttggtcagttggttggtttgcagtatacgggttttaccttcttgtctttttgcatgtcttgtaatttttttgttgaaatcaaaaaatttagataatatattgtagcaactctgggaagtagttactccttttcagggctcattatttgcttgtttacttgtttaattaccagcaaaattatttcagtgaaatctatttacctctgcagtgtgaatcccctgatgctgcttttcatggagtgcagacttagatgtacccacagtcatgctgggatgacaatggttttggcagggctctcttactgtctctttccctgaccccatccagcagttgagcttcactaattgctgcctgattgctgtatatttcaaacaatgacttaggatagaaattgcttccccataaatccagtgaaatctgggctcctttgaaaggatagttcccaaagatactatttgaaattagttattacttcagaagggctcttcaactttgtctttccctatttctctctggaaaactagccagcctacaatttagcttgttgttccacctatcagactcctcttgagtctgggttgcctctgtgactttctttgatcaacaggatgccatggaagtgatataagaaatatgagatcaccgtactgtgagcaagcccaggttatccatgtggagatagagagttcacataaaggagcatcaaggcaccacataattgagttaatatttcttggacattccagccagctcagtcaccaattaaatgcagctgagtgtattatcctagccaccacataaaacagaaaacattccagctgatccctgcctgaattcttgacccacagaatcatgagaaataacaaattgttgttttcagactcagtgtaccttgtcagaaatggaaaactgaaatgcccatactgttataaagaaaatccttgtaactttttctaaaagttctaaagttttacattttgcattgaagtcattattcaggtgtatggagtcacctggagcttaatgagctgcatccaggtatcacagacaatggccaagaacaaatcaagagaacagggctggctgagtgcagtggctcacacctgtaatcccagcactttgggaggccaaggcaggaggatcacttgagcccaggagtttgagaccagccatctctgcaaaaaagtgagaccccctgtctctgcaaaaaaaaaaaaaaattaatttttaaattagccaagtgtggtggcatgggcctgtggttccagctacttgagaggctgaggtggcaggatcacttgagccaggaggtgggaggttgaggctgcaatgagccttgatgttgccactgcactccagcctttgtgacagaaggaggatttgtctcaggaaaaaaaaaaaaaaagagggcggaagtccagaaatgtattttacatagccagccaagggaaaaaaaaaaaaaaaaacctttaaggctaaaaacaaagcaaaaccagttactactaatattaagaggataaatattatgaatgatgaaaaagttaacaaagtgaataaagcttttgtaagtatacaaaaggagcttgcatgcttctcaaagggcctttcttttgaatctctgcagaatgaactgattcctcagcaggtcatgaaagaaaaccagctaatattgatgaagctacagaattaatggctcacttgtaatacagtagtgatgcatctaattcccccaaaagaccaataaataaatgttttatacaacaaaagtctttcttcaacctagaatgcattcacatattatgagggttagaaatctgaggttgttttattataccatttgttgtataatccacattttcccccactgatttgtaagatcacatctgtcataagcaagtggagcaaattgtccagaaataaacttatgcgtatatggaaagaccatatttatctagccatatgctagtaccatgcagtattaactactataattttacaatggttataatatttgatatggcaaacaatgctgcccctgtatccagttattcataatttttttactattgtcatatgactcttgggattagtttgtcaaggtttatgtaaaatcctgtttggattttaatcgaaattgcggtgaaattattctctagagatgtcttgtacatatttgctaagcttatttctagatacctaatgactattgttccttgtaaatggagtgttttttcaatagcatttaaaaattagttaataatatataggaatgctgttgatgtttgtatgttaatgatatattgaacaagcttgccaaatcttaaatccaattattttattcaaaattctcttttattttctatgtaaacagcaatagatagaaaggataaagtttataagtaaaaaacaaaaaaaaaaagaaatgagaatagatacgctaaaatatgaaatggtgttactttgtgttttaacttgcgttttcttgcttattaatgaagatgaacgtctcttcatttgtttgttggtcatttgggtttcttattaattcttcctttcctgggaattcctattcctacttcctagtctgcccattcaggaatcctattcctgttctgacctgaatagaattcaacacagaattattttatttaaaaaaatctgtactgttatgtaggattttgcatacttaatattgcatttatgtacattttccgcttgtaattatctcagaatatggctttatttggagataggggctttattgtttcttgaaacaaccttcttttcagtgtgttgatctgctctattttttttgttttctatttcactacatttctctcatatttattatttttttctcttcatactttaggtttaattatattttttctaacttctccattgaatgcttacctttagtttgaatccatttaatattttaaacaatgaatttaagctactgattttctctaactgccattttagctgtagctcccaaattttgatgtaattcttttgttaaagtttactttctaaacatttaaaaatttctcttgtggtttctctttaacctgaaattcttagcccttgagtttcgaaagtatacacacttaaaagattcttcaattatattttatttttaaccctgaaaaaaatcccatcattttattacatatgatccacaggtccagctaatagaatataattggaaattaagtgaattaggttttgtttattagaattcttagtggctgcaggcagaatacttctatttgcttcagtcttcctactgatttaactgggacaataataaaatataacctttttttctagcaataacctcaaacaatcaaatctttctggcaatcagactgactgtcagtgtgcaaaagcaataatatactgcccataactttacaaggtaattatctgtgttagcatcctaaaatgttttaagctttggtgggaattgcgtctaactttgaggagaataatccccaaaagactcgaggtagagccaaccgactattttaggacgaactgtgaagctatgcaaagaaatagaactacttttgatttttaagtttttttttaatttaattgcattgtggtcataaaatatgatatataagatatcaattcctcatactttttgagattatttttgtgacacagtgtttggtcaacttttgtaattgtttcaagtgtacttaaactatggtctctgttgggttcatgccattctctttctgtatataaatatatgtatgtaagtatatatatatgtatatatacatatatatatacttacaaaccgtttttcaagtctcaaacctatgctcttactttagttgcttgatctatcaatttatgatagaattatgtttaatattcatctaatactgggcttaacaatttttccttgtaacacatcttgctttatgtgttttgaggctatattatttggtgcacttaaatttatgatttataatactgatggttatatttttttacactgactctttgttttaatgtaacattcctacttatccttaataatgcttttcacttaaatctgttttgtttaatgttaatgtgactataccagttttcttttgtttaatgtcttcctggtatagttttcccatctttttattttaaaactttctctatggttttgtttgagaagtcttttttatatgaagtatatagatggaggttttttttagtattcactatctttttgcataaaaaggaagttagtacgtggattgatacatttttctctatatttctattctttacttattttgacagtagatgcttttaatttttttttactagttatccttaacactttgacatatatatttatgtctttttttaatactgtacagaatcatttcctaattttggtcttttccctaacttactaaagactttatcatgcttttactacccgtaaaatagcacccatcttattattgatggctagagatttagttttaccatttgtaagaaaaatattttttacgaaaaataatgaattatactttatgttttcttgttattttttaacctactctttcctccagtatttattttttcttcctaaagaacatcctataatatctcttttagtaaggatctatgagtggtaaaccttcttaatatttgtatatctgaaaattttgttattctctccatctaccttaactaataaataatacttaatctgggtataaaattataggttgatagtttatttttagcaccacaaagatatgatcttacattgatttctagcatttattgctgatatgaattctgctgacagtctaattattattctttagtaggcaatcttccctttttgcatgataactcttttatagcattttttcttccatatttttattcaccacatttattatgtacttgagtaaggatttatatttatttattcaacatgtttcttggaaagcacttttgattttaggcttcttctcttccttcaactttaaagttattctgttctctctataggtctcagtacagcctcaaactcaccaaagatctcactgcttcccaatcaccaaatcccttccaataggtcttggagctcatagcctatcatcagtaatgtccattatatccacagactcttctctgtatttctcttttctatatctacttaatcttggttcattctgctttgtaattaaacactttgtctctgtatattttccaatctgctcactcctcccttccacttgggtcccagacccccagtgcagaatcagctcagtgctttctgccctggtgatgttggtgatgtggcaaatacattctctatgctaactgtcagcttggcctagttcctacatctgcctcttctctctttgctagcttgaagctgtctgtcattaactacaggcacagctgtgtttttcagcctctttctaggagttggggaggtatatcccagcctgttgcttcagttgataggccaggctctgtttcctcactttatatgaggtgtttttagtccctttaccctatagaaggtaaactgccagtcaccaaaggctgctgtagtctcagagcccagcaagcctaccaggcccatggcctcagtacttcaccattatgtgtttctgttccatttcagatctaatatgtatttggtttgcaagcctgcttatgactatttttggttgttatagtttgtcagtcatgcaatatattggagcagatgcaatgccttacaatatgggcttgcttccacattgtgtcgagaggttcactgttcattcttaaaatcccaacttagacaatacctcttgcagaatgccaccgttggtcacccacagcccattctacccccaaccaaagttgataattttctcctttttgttttgtctgcacatggttcatcgctacacccataacactgtaagatatgctgtatttggtattttcttccacttgtagtgaatctcccctccccacaaatgatggagtcctgatatgttgagtaatcctcaagtttcagaatccagctcattagaatttgctatgttgattacagtatgctttcagcatttagatcactgtggcagacattgttggtgctaaaatcttctcagatcccttttatcctttttagatccccctcttttggccttggtatgctttagctttgaaaacctaacacctgacattcttctttggaggcttgcccttgggctactggaggctctgcctgcatgtctgggagctgggagtgcttgcgtgtacaagttagcccatggctgccctcaatcaatgactaataagtatgggagtataaaagctcagctcacttacttttggcagcagtgactctgaggcataactcagactatagagttagtttccttgcaggataaggcagaagctaccctctataggattttgcttgtaattgtacccttgcttggtttcttcccctttcccaacctatttcttccactcccttagtgttttttcctgggaaaaatatccttaataaattgcttgcatatgacttctgattttatggtccacttttaaggatcttgacttaatataccaacagttaagaaagcccaagatctagaggtagagagaagtaaatactctcaccactgatgcacccagatgtcttcaccccagagcatttcctcttgtatgtatctatggtttttcttctttgttctttatctatctgtcttacctgttaattgctctgtccctcctttgagtggagggtctatttgtcttttcctccctttcttttaaaatttccttcctcttctcactttgcctgaggctaatgattactcctagtccccaggaacatatgtctcaactattccccttgttcatattaattggaagcctcatatactaacaaacttgtggtgcaattttgagctgaaagatagaaggaaccatggggtccccttttaatataggggttctgggtgtccctggattactgggcattttaagactatgtgttgtaatatatttttggtatgttttccccatgtgctagacttgaagggcacagattaacttctttatttttgcatccaaagctcctagaaaaagagcctagggaagtggttttcaaatcatctgcagatggggagatggggaatttagtgtgctgggccccaccccagatacactgaaagcagaatctctaagggataaggcctataatactacttcttaaataaaatcaccagggaattcttacacggtttgaaaattcctggcctaaaacttagatccctcaaaaaacatttattgaattaaatgggcctgcttacttaaatgacaaatataagaaataaagcatattacagacattagattactgcagatttgataacactttttaaattataaaagaattctggaagcattctatccccctgactgatggaagttcaaataggtaacttctaaaacacaaatcaacttgaaacaaaattatgaaaagaggcactaggcaattacctatagatagatgctgcagctaaaagtttgggtcagcaatcattaggtaatactcttttcctcagataactagtccttggttttggttgtgaaaaaacacctgtaatggcagaaattagttggactttcatatctgttgatgttagagaaatttagtcgcagcagataccagcttgaactcaccaaaattgataagctatctctgacgtttttactgcagggtgcagtgacagcctgtttccatggaaacagacaccagcttgctgaaaacagaggaaggaactttagcattaattactgtttcaatttgaattcaattgatttcagagtaaatctagagacaacttggcagtattattgtgagagtgctgtaggcatgccccacactatattaaaatagtttaacaaatataacaaagtgttgtggcttataagagaattaaagctcaactgttgaagtaagcagaagaaaagtatacaccaaagtctcaaaagtcagtagtttttaattcctttttttttttttttaaattcagaggatacatgtgcaggtttgttatatgggtatattgtgtgatgctgaggtttgggcttctaatgatcccgctgccaatgtagtgaagagagtacctgataggtagttttccaaccgttgttaccctcccttcctcctcgcttttggaagccccagtgtttatcggaacccccagtgtttattattttcatctttgtgtccatgtgtacccaatatttagctcctacttgtaaatgagaagacgtggtatttggttttctgtttctgtgttaatttgcttaggataatgacctccagctgtatccatgtcactgcaaaggacatgctttcattcttttttatgactatgtagtatttcatggtgtatatgtaccacactttctttatgcaattcaccattgatgggcacctgggttgattccatgtctttgttattgtgaatggtgttttgataaacatacaagggcatgtctttttggtagattgatgggatgggattgctggatccaatggtaattctatttttagttctttgaggaatcttcaaactgctttccacagtggatgaactaatttgcattcctaccaacagtgtataagtgttcccttttctctgcaacttccccagcatctgttattttctgactttttaataatcacccattctaactggtatgtggtatctcattgtggttttgatttgcacctctctgatgattagtgatgttggacgtttttcatagtttattggccaaaaaactcactttttgaactgtgtagatgaaagattgacttgcttttaattaatctaattcccttcaaaaaagccacatcattataggattgctcttgatgtcccttccaccaacaccgaggaagaaaatgcaaaaagaagtaaatttttaaaaagtctaattttggagtactctatgtttggctctatgaggtttgaggatgagaatgctgggttccttaaattatttatcctattggccattggattgcttagcctcatttcctggcttccttggggtgcatgtgtgtgtgtgtgtgtgtgtgtatacactaaaatcttaggaagcttttgtcaattttggtgcactcaagcttggactggttaggactgaatttctctccaacaccgacagatatgagagtctgactaatttttagaatagtttcagtatatatttatatgtatatgtacacacacatatatatacacatgcagtatatacacatagacatacacatatatatacacacacacacatatatatacatacatatatacacacacacacacacacacattcaagagtttctattttgaaagtccttggaaggagttatacagtagaacattatttgccctggaaagtaataggttgggtttagtagttagttagaagttggcacagaactagaagtgaatacaacaaataattggtgagaagtcaggatgaggagtccaaaggacagaaaaacaccaacaaatcttgacaaaagtgaattttgtctattgaactatttcattgagactgtaaaattatatataatgtatatataatatttaaatgtaaatatataattagtatatattattaatatataaatatttattaaggtataataaatgtgtattacatattaaatatatactatgtatttatatataaatatgtaatatataatatatatttaagtatattatttaaaaccctagataagcaagatggagagcataatgactatcaagaagggcttcaagaaagtcacatttctctctagagaagtgtgtgcatttcttggtcacagttttaaagcagaagatcttaacaaagtcaaaagccaaatgttgcaagatagtatttaagaatggggattctagagtaggatataaccaaaagtagaaggaagttgttagggcctcacctagatttcctctgttccatttaccgaatctctgagcccagctcccagcttctgtgtgctatcagtagctattaataacatctgtgacctttctggtactatcttttcggttattggagctgtttcctttgcatagacagccagagcctggaagttcacaggccatgcctatatcttactgttgtaggaccacaaaagcctggatctttttttcttggagtgggacaaactttgagatgcaactaacacttcagagttcacagtaggatcagggtgaggcagggactttgcgtgaaatcttactcttgtttggcttctaccccttcttggcatatgtggtagccagcctccaaaatgacctccgacgacccttgttttctggttttcatgcctttgtagagtccccttccacaataaatagggcttacctgggtgaccaataggatattgtgaaaatgatatgtgtgacttccaaggctagatcataaaattcactgtggcttctaccttgctctgtattggtctgtcctccctgggggaagccatttgccttgtgaagcagacactcaagtagtcctatgaagaggttcatgtggcaaggaactgagccctctctccaatagccagtacaagtttgccatttacatgagggagccatcttggaagtggatcctccagcctcagtcaatccttcagatgactgcagccccagctgacaatgtgactacaacctcataagagaccctaagccagaaccacccagctaagctactccagatttctgacccacagaaaaatatgagaagataactatttgttgttattttaagtcactaggttttgaggtactttttagtgtagcaatgagaaaagtgataaatattctgtcccccacttcctttgttggtttcttctggtaccacatgcttaatgaataacttgcacctgaattttatctcaggctctgctactggtgagtttgacttaggacatttggattgaaatctgaactctgccatctctaagctgtgtgaccttgggcaaatcactaatctgtttattgtgcctcagtgaaatgtgaataatgatagtactgacctcttagagttgtgcgaagattaaaggggcaatgctcataaagttcatagcattgtggcaagcacattgctggagctcaaaaaatgttagtaatcactatgagggtagcagtacagggtggcagttgttagccttaagatctaaaccaagtggaatttttcttctagcctctgtggcccctgttatccaccatgctggcttttgaccataaggaagtatgaacaggaggctgtggatgcctcagcccaatttggtaaaaaacaaaacaaaaaaacacaaaacataaaaataattcaaggcacatgtgtttcttctccttgcggtaggtcaatagtgtcatctttataaatgaaactcaaaccattgcattattgtgataaaatctgccattttaccttaagtaaacaaaccttgctgcctgatccgtcactgttcctaccacaaaggaggtgtaaagctgaagcagttatttcaacagctaagtgacaatatttttctgctggaaacaacagaccagacagtgccatcctcccatagctttttacattcaggaaacagtgttataaggcaatgccccaattaagaatctttttaaaagagattcttttattctagtaaggctggtttaaaaaaaatcttcatgtaatattaacatatgcgtatgaatagatattggacaattgtaatagactggagaaaagatgatcatgttctgacaatgaggatataatgaagaaaaatcagaattctgcaagctgaacaggcagtggaagatgaggggattctggacatcggactccagttaagtagcaacaagagagaattctgccttaatgaggaatataagggaagaatctcaaccataaagctgccagatgaaatggcttaatgcacagagacccttagaagctttctcagtgccatttcttcctctacgatggctgagaaaaacaccttcagcagccccaataaattcttggagaatgttttctcctgaattttgttttagcatctatagtctaatcatcagctacaaagacttgttgattttttttttttttttgagacagagtctcgctgtgtcacccaggctggagtgcagtgtcgggaacttggcttactgcaaatttcgcctcccaggttcaagtgattctcctgcctcagcctcccaagtagctggtattgcaggtgtgcaccaccatgcctggctaattttttgtattttttagtagagatggggtttccccatgttgcccaggctggtctcgaactcctgagctcaggtgatctgtccaccttggcctcccaaagtgctaggattacaggcgtgagccaccacacccagcccccagaaacagttttgacactcaacactttgtgagtccattgcagtttgtcctatttccaggattctctgaggaatactccctaaaacaggcatggctagttatgttgcttattcagagcctttcttgagattcctgtggaatttgtgattaagccaacccatgaaactggcatctgataccaagagaaatgttccttttggctcagtaatagttctgcttcaatgcatgtgggctgagcctgccaatagtcatggaaatggtgcactgaggtttaaaaaagggacgtttgattgagaacaaaagtcacagagaacttttctgaaggtctttggtcagcacgagaattattctttaatggcacagggagaggggaatcttaagcagctctgaccttttatcaatcgtgaagaattggccatcattgtgtacatcattgaatttcaaagcatttaagctcttgcttatccagtactccccctagcagtctgcacgaagtgggttaactgggcactcacacactgttggtaggaggacaaatggctacagccttttagtaggcaatttaggaacgtgcatcaaaattcaaaatgcatggtatcagtcaaggtcctggcatgaaacagatggcactttcaaactgggtaattgagggcatgcgataaagggcttagggaagccaacaagggatggttggccagagcagcaaaccattactaccctaggtctgaggggtgagagtaaggagtggttagcagaacttggaactgtatggaagggtcagcttgccaggagctgtggcctttgacaaaatgatacagccaatctactccgatagcagggagggtattgagagaaacaaataacccagagtcactctcttcctttcttccaatctcttccctgtacctcccactagcaaaatccaaacagaagccagaggcaagggagcctatagttatagtccatatgggtcagtcttcttgggcaagaaagagggtgctaaagggtacgagtgggtctgcagtgacaggcagaaactatctggcatatgcatataccttttgattctgcaatcctatttttacaatccatcctgtagacatgttccttcaggctttcaaagatcatcagtatagaatgtatttgtaatagagaaaaactggaaagaacctaaatttccagtaataaaaaaaaaaaaggttaggctgagggtagtggctcatgcctgtaatcccagtgctttgggaggcccaggcaggaggatgccttgagcccaggagtctgagaccagtctgaaaaacatagtgaggccctgtctctaagaaaaataattttaaaaaattagccaggcatggtgacatttggctgtaggaggcaggaggactgcttgagcctagaaattcaaggctgcagtgagctaagatcctgcattccagtctgggtgacagagtgagacacagtctctaaataaataaataggaaaaaaggaaaaacattaaataaagacacatccatattatagaataccatgcagctattaggaagaataagatagactctctatgtgctaatatggaaatgtgtccaagatgcagagtcatgtcagaagatgcaaaaacagtaaacaaaaaagaaacacaaaacacaagtggcagatcagtatctagagtgtgatcctatttttgttagggaaacaacaacaaaaaaaatcataaacaatgacatgtgcatttaaatacttatactcaaacctgattggggatgagcaggtaaaaaggaacttttagtatttttcctagatgcatttttattgcttgaagtgcttatcagaacacatttgtatattacttgtgtaattagataaatctaagaaataagaaagtgcaactgtaaaacttggggtaggtaaaatggttaactcctgatgggcagaaatgaatcccctcctcaattcctttccttccttgtcgctctgcttctagtctgttttgtgggcattgatggcctttgatgttcagtctcagtcctgccacttgacaagacaatgcttggcaaacctagggaattaggcttcatgtttaattctccttcagcctgttgggcgtaggatgtgcttcctgagctgtttgctttcacttttcgatcttgctgtgttagttcctaaactcaaccatgttgtactaagacttaagcaaaatgtaggaaatgcacagtgacccatgcctgtagatcatgtgtagctggaatctttgaacttcctatctgagtctcacaccttctctattgcacattgtcctgttgcttcatctctgtcctactttctgattgctcaagtcctcccatttggtatccacaatgtttgagtatgctagcttgcccttgtaacttattattgttgtttcattctgtcatttttttttttggttgtacttctactagccttcccctttggctagatgaaggagccattgctatgccctgccttatctgacagccctgccgggcatggccccatttcttccctacactctgactctgacctaaaaagcccatgtctagagaagctcctgccttggtttccaaatgcactaaggtttcttcatttgtgcagtcttccctggacccaacttgcatggttgggacctgcccgtcttgtctaactcttactaacgttttctcaccaaagggatattcaccttgcttcctgtacatccaagttctttctgtcttgctctaaatcaaggagaccacatggaaccacttgctgcaaactcttgagtctttttgttattgagtggttctcaaagtatggtccctagcccagcagtattattatcacttggaaacttgtaagaaatgcaaatcctcattctcactcagacttattgaatccgaatctctggagctggggcccagcaaactgcttttaacctccaggaggttctgatgcatgttgatgttagaggaccactggcctagatactctgactatcccacaatggctcttaaatatgaagttctcagattttagtgtgtataggaatcagctgaggaacttgtttgtaaatgtagattacagcattctacccacagacagactgatttatagagtgaggttcaaagatttttattcaaaaatattctactcaagaagtctggggaaggtattttgaggaatattgtcttagtttttggatgagctccaagttctccagggagttgggccacttacaagtgacccaggccctcctttagagtagagttagatgtctatactccagtctatttctacccattaatcactttccccatttataaacttcttatagccaagatcttagaatgcctcacagctgggttcaatacaggaattacaatgacacagaattactatctggtaaaagattatcaattcaaatggacagctatttcttctccatgataggagtggaggtgtattgtgagacggatttttttagacctcctatctttttctatttcagtcaggaaagttttctggtgcccaggcaaactgcttgccatatgtttgcattgactcaaataatgcattcatagaagctgacacagtgattataacactacctggtaagtcttatcatttcagttaagcacatattttggagcatagtttatatggggcatagttattgacatatggttgtatcaattggcatacttaataaactatgccaagcaaatatgtgtctcttgactggtttcccttttctattgtgaaaaggtgctctatcatatctccactattggaagtagccttctgattttcagagcaaatatcctgccaaatttgcccttaatagcaaccttcaagaccaaatttgttcctgtctggaggttgtaacctaagtctgaactgcttgtcttaaactctttcagctgattcagttcattcaactcaggattcaaatcttgtttggccttcaccaaacaattcagcctgaaggtctaggatcattcctggtcttacctcaagtctgactcatcatccaagtccagggtccaatgacacctgctttgtcaagcctaccttaacaggtcccctccctatcagtgttcctcttaaacctctgtatttataccaatcatcatttttgttcacaagaaactgaaaaaggccatttgaaattaagtaccagtgtgactatctctctatactgcatgtttcttgaaagtaagaattatattttcatacacccttgtataccttgtagcatatcaagcagtgctctgcatatatgtgttcggaatgtcacctggattggatagaagaatgaaagactactttattgtctgaagggcacctgggaatcaagttatccatagcacagtccacagggattagccatcttggtccatgttgatgaagtggatatgactattctccatgccaagaaataagaaatagtaatacatagtaaagcatttaaggcagccctgggtgtgctaatgtggggtatagatggtagaactatttacagtacttttcttgttcatttacacatctcttcaacttgtatctatcgagcatccactacatcaaatgcactgtgctgagtactaaggaggatacataagagaataatatgaggtacccacccctgactcttttgacttcaaggagcttcaggaataactttttgggagatgagaaatgtacataaaaacagatggcaatgcaagatagtacttaagtacaatatgaagattgttgaagctcagaggcagaagtgatcatagtggactggaatggtctggagaaagtgtgctccactttctccagtggaaggctagaaagattaagattacaaggtgttggatattctagccaggagaactgttgatggaatatgcatgtgtgtctatggaacaatagataaactacagtttttaaagcatggaacctagcaaccttgagctctcggatctcagtcagtgggatcatggacatcgctagtgctcaatcataatctggttcctacagcactcaaatctcttggttactagatatccacacactaactaacctgagccacttggttatctccctcatgggtcatctctgctggaaagatgcttacctttcaaatagtatttttctctcttttctcataaagttgcctctttggggtttagttatgtatgtcttcagagacagcactaagggagactcaagctcagttcactttactacctatctgttgcacaatttgaagcatgtggcatgcattggttgtccactcctaggattgcagtgtgtgtagttaaaccataagctccaaaattctatacacagtccctcctatggggcctgggaatttctctacttattgagccccagggcctgcctgactaccccagggcttcctgaggaatgcatgcaaattagacccaaacagtgacaccagatgacacttaatttttatttgtgcttgaatacctcttaaaaaatgcacataacatctagaaccaccctcaagggacttattttgactatctcttcatggaaataactaatatgggttcaagctgaatatattatggaactatttcaaggatgatttcttgggtttgttttccctttctcaaggatatcactgtgctcttcataattggcaaattagatattgtgaaagggaaggaaaaatgagcaatgagagcagtaacatgccaagagggcagcaatagaagcagctaatggtgagggttgcttcacaggcttgcactgtgcaggtgcagctccctaaggagaagagccaatgtattatgccgtagaaagacaaaagaagcaagtgagacaaaagaagcatttgggtgttggtgactgctttgcaaatattttaagagctgcgtttttgacttgttttcctttctagagatattaccttggtactatcatttatatgacattgccaggaagctctcttgaccagtgatgccttgttagcatgggcctccatgccaagaacagacattcaggcttccatgagcattttcagccaggggtaattgagataatctggaggctaaagtcagaatgagacccactgtgtgttcagccagtactgtacagcttcctaaagcttccatggcaggatttgtgtttctcatggcacagcttctactcaaccaacgtggctcctttcaagaaaatcgtaaattttttttgtaaagaaaaagaggcaaaagaggctggaaggggttagagcaagatggcagaatagaagtccccattgattattccccccaatagggacaccacattcaacaaccagctacacgaaaaagcaccttcataagaaccaaaaatcagttaagcactcacattaccggtttttaacttcatatcactgaaagagacactgaagaggataggaatgacagtcgtattaccaacactacccctctgccatttctccacaacagctgcatggcatggagaaatctgtgcacgtgggagagggagagtgcagtgattgagacttcatactgaattcagggctgccctgtcacagaagaaagcaaaaactgggctgaactcagctgatgcctgtttatggaggaagcatttaggtgagccttagccagaggggaatagcccatctcagcggtaggaacctgagtttagcaacccttgccactgtgcgctgaagtactctgaaaggcaatctaggccacaaggactgcaagtcctagggctgagctgagctcagagccagtggactgggtgggggacagatacatgacttactggaacaccagcaagacaacttagagattgcttgtgctacacctttccaaaccctaggcagcacagctcacagcttcaaaagagaccctttccttctacttgaggaaagaagaggaaagagtaaagaggacttttgtcttgcatcttggataatagctcagccatagcaggatacggtactgatcagagttgtgaggcccccatttcaggccctagctcctggatgacattactagacacattctgggccataagggaacctgctgccttgaagggaagaaacaagtcctggcaggatgcatcacctgtcgattaaagaaactttgggccctgaataaccagcagtgatacccaggtagtatgccatgggccttgggtgagactctgagacatgctggcttcaggtgagacccagcaattcctggctgtgatggctatggagacagacacctcttgtttgagaaaagcagagggaaaaacaaagggaactaggtttagcaccttaggtaccagcttggccatagtggggtagagcaccaagcaggctcttggggtccccagcttcaggctttggctcttggacagcatttctggagctgtcctgggccagaggagagcctagtgccctgaagggtgagtcccaggcctggcaaaattcaccacaggctgactgaggagcccttgagaattcagtgaacatcagtagtagcctagaagtacagcctgtgggccttttagtggtgatggccacagagagaggctcctctgcctgtggaaaggggagggagagaagagttagaaggactatgctttgtaatttgagggccagctaagccacagtagaatagtacaccaggtagaattctaaggtttttgattccagtccctagctcccaagtagcgtctctggacctgcttagggcctgtgggagtttgccaccctgaatagaagaatgcaaacctggatagccttgtcacctcctgattgtggagccctagggtcttcagcaaacatagacaatagccaggtagtggttacagtggtcgctgggtgagacccagtgctatgctggctacaggtctgacccagacagtcccagtggtggtggccacagaggtgcttgtgtcactccacagcactatttactcaatattttcacttcaatatcacctcaaggtcaacatgtccaagactgaatttataaaattaaacttatggtcacttctcactatcttccaataaaagaaaaataaatgccacttatccctgttttagaattccatattttagtgaatgtcacctttatcaacagtgtctcaagaaaaaacagaggtatagatgatgcctccctttttacatgccagtttcttatctatcaccaagtcctgttgattttacttcttaacatttcacaaccctgtccacttcttttcatttccccagcaccaccattttcctagaccaaaccatcagtatgttttgagtgaactgctgcgaaagctcacaaactagtctccagagatccatctttcagtcagaatggacacaagtgatatcatgtgtattttcattcatttctctatccccagcgctagaatagcacctagcaatagtaagcatgctaagtatatgctgattatttaaataaatgactttcctcaagacattaaagagcaatatctttgacatggccaataggatgctgcattatttgtccctgcctagcacttcagtatcatctgtcatcagtgtccttcccaaggtcttactttctgtgcctcaaccaaactgggattctttaagcttctagaacaaatcctgcttcttatatcagcagggcctttgcacatacagtccgcttggcctgggttgtagtcctccttcaactaatgagctacccttcattcaactcttaggccacatgctgcctccccaagaaagcctaccctccccgttctcccagacctcacagatttcttagtaatttcttagtaatcctaagaggcccaaaaccctttcttttacaacacttttctccatttgtaatgatgtattcattattgtggtcaattgactagtttctgtttccttatttaaactggaatttccacaagagcaagggaaatgtcttcttttgctaactagcacctagcaccttgcctggactataactggtacactatgaatgtttactaagtgaaggcaaatactttattgagaaattaattaattataactaaatatttgattatgttgtgacatttctagatgtcactgcaaataaagtaacaatttgagcacacttatggtattgtctgtcttttctattactttcccttcagtagagtgtagtctactataggtgtgtagtttttaaaaattgagtcgttcatcaccttagggaagacagtaatgaaagtattcatttagaatacaagctgtgacagaaaaccaaacaccgcatgttctcactcataagaacattgaaaacacatggacacagagaggggaacaacacacaccagggcctgttgaggggtgggaggtgaggggagggaacttagaggatgggtcaataggtgcagcaaaccaccatggcacacatgtatctacgtaacaaacctgcacgttctgcacatgtatcccatttttgttttagaagaaataaagaaaaaaaaaaagaatacaagctgtaaacagacagaatcctaacttctatgtttatgaagttaaaagtttagaagtttatcatttgttactgccatcaggtagcaagacacttttaactggtgtttcaggacctaagaggaaatgaactgggtaaaaacaaatagagtcagccataaaattaaatggcttgattctttactctgccaagtgtctgagggggaattatttaatttagccagtgagtcaacaagtcagtctaattctctaaatctggttattttccttagcaaaatgtatttgttctcttcaccacaaaagcatatttgcagaagatgttgactatgaaattccttttgccacagttattgaaaaagaatataaagagccacataataattagacaattgatgttctcaaaacaagattaagattctcattcccactcaaagtaattctttgtcaactgagctatgaaaactctctctgcccaaaagggaaccaaatttaagcacttaaatgtctctaatataaatcctgaaaacttatgacacttttagtcatttggtggtagcgtctttcttaaaatatttggaagtattaaatattattttacctatttcagaattgtaagccccaactgtttttccaagtctacatatgtatcaaattaaaaatatttttaaaaagttaatgaaaacaactatgtatttttcttggtggatattccaagtaaatcactatgctctgtaacagtatcctcttgtagtttacagcatgcgttgcttaatttgatccacagaataatcctatgaaaaaagcatttttatcctcccctgctattcccaaatggcaaaactgagtgttcccctcatcatcaaatagtaaatagtgaagcttataattcattaatatcttcagattccaagtcccataatggtttgctctacacaagtctgaagagaagaactatcaataagtttaaatcactgggagaataagccagaacaaattgtcaaagtttccagtatccccaaacttcaataagagaagtctgaggcgggtgatagtgattatcaaatttctgcagggttactaagatctgttcttgtccctcctaactccagaataaaaagaaatggactcacctaaagacaagttctgttcatttattgagctcccaatatataccaagcactgtccaaggttctggaaatacaaagatggctaaaacatggccccaataccctagggcttcatggtcctttggagaagatgaacacataaacaggtagtcatgagtcaatgtggcaaatgcagtgaaagatgtgcagaagggcttttggaacacagagaaagccatctacattggcctacagtatgtcagagaagtatccttactgaagatagccccaaaggccaactggacatcatgatgcatttgggatacaagttctgtgagaataagaggactaattttacttatttttgtattccccagtacctaatacatgactagtgctcaatgcattagtgtatttaaccaaactgaactgccagatcagagattctgaagaggctcatgaaatgcttgtcctctttcttggaaagaaatatggccctcaggcatgtgtgaggccattcttgcattgctgtaaataaatacctgagactggttaatttataagtaaagaggtttaattggctcctggttctgcaggctgtactggaagcatagcagcacctgcttctggtggggccttaagaagcttacaatcatggcagaacacaaagggggagcaggtatataacatggcaagaatggagcaagagagaaggaggatgtgccacatacatttaagcagccagatctcatgaggaactcactcactgtctcaaggacagcaccaaagggatgacactaaactcttcatgagaaaacttcccccatgatctaatcacttcctaccaggccccacctccaatactgggtattgtaattcaacatgagatttgggtggggacaaatatacaaactatgttattctgcccatggtcccttccaaatctcatgtccttcttacatttcaaaatacaatcatgccttctcaatagtcccccaaagtcttaactcattccagcattaactcaaaactccaaagtctcatttgagatgaggcaagtcccattcacctatgagcctgtaaaataaaaaataaattatttacttccaagatccaatgggggtataggtattgggtaaacattctcattcctaaagggataaattgtctaaaaaaggggctacaggccccatgcaagtttgaaacctagcagggcagtcattaaatcttaaagctccaaaataatctcttttgactacatttcccacatccagggcacactggtgcaagtggtgggctcccaaggccttgggcagctctactcctgtggctttgcagggtgcagcctctgaggctgctctcacaggttgttgagtgcctacagcttttccaggcacagggtgcaagatgccagtggatctgtcattctggagtctgaaggatggtggtccccttcccacagctccactagacagtgtcccaatggagactctgtatggggtctccaaccccacatttcctcttggtattgttctagtagaggttctctgtgaaggctccgcccctgcagcagccttctgcctgggcacacaggcttttttataattcctctgaaacctaggcagagggtgccaagcctcatttactcttgcactctgtgcacccacaggcttaacactacatggaaactgccaaggctacagtagcttgcactctccaaagtgatggcccaagcagtacatggggctctttgagccagtgttggggacagagtggtcaggatgtggagagcagtatcctgaggctgcatagggcagcagggctctgggcctggcccacgaagccattcaatcctcctaggcctcagggcttgtgatgggaggggctgtctcttagatatctggaatgcctttgagacctttttcccaatgtctcagttattagcacttggctccattttatttatgccagtatttctagcaagtggtttcttgatagcctgattgaactcctctcctgaaaaagcctcttctttctctgccacatggccaggctgcaattttccaaacctttatgctctgattcctgtttaaatataaataccaagtttagatcatttctttgctcctacattgagcatagtctgttaaaagcagccaggcaaaatattaaatgctttgctgcttagaaatttcttccaccagataccctaaatcatcactctcaaattcaaacttccgcacatccttagatcatgaacagaaagaatgcagccaactctttgctaaggcataacatgtgtgacctttgccccagtttccaataagttccccgttttcatctgagacttcatcatcagcctggacttcactgtccatgtcactataagcattttagtcacagctattcttgtctataagaagttgcacactttgggaggccgaggcaggtggatcacgaggccaggagatcaagaccatcctggctagcaaagtgaaaccctgtctctactaaaaatatgaaaaaattagcagggcatagtggcaggcgccgtggtgggcgcctgtagtcccagctactcgggaggctgaggcaggagaatggtgtgaacttgggaggcagagcttgcagtgagctgagatcccgccactgcaccccagcctgggcgacaaagcaagactcagtctcaaaaaaaaaaaaaaaaaaaaaagaaagttgcaatcattccctcatcttcctgtcttcttctgagtccttcaaactcttccaacctctgcttgctacccagttccaaagttgcttccacatttttaggtatctttataataatgccccattcccaagtaccaattttctgtgttaggctgttattgcattgctataaagacattcctgagactgggtaacttataagcaaagaggtttaattgtcccatggttctgtaggctgtacaggaagcatagtgctggtatctgcttctggggaggcctcaggaagcttataatcttggaggaaggcaaaggggagctggcagcacatcacatgatgagaatggagcaaggcagtgggggtggaatgtgccacacatgtttaaacagccagatcgcatgagaactcactcactattgcaaggacagcaccaagaagatggcactaaactattcatgagaaatccacccccatgatctaataacctcccccaaggcccatctccaatatactagggattacagttcaatgatatttggaaagggacaaacatacaaactgtagcaggccacatgatgaatgtcttttcagttcctcagttaacctgatttttcctatcaagaaatattttcaaatctgtggaatttccttctattagaactctgggcaataaatttaatcttttttttttaacagtggttctatctgagagagaaacacaaaaggtttcctccagcccagtgatctttgactcttgccctggatttttcttacttaaaagaaaaagtggttttgtatgctaatcagtgcctattgcattaaatggcctcatatattaacattgcatttgataaaaccataaatttaacagtctcttatttattcagttatcaagttctattaattctacctcaaaactgactcttgaatctctccttttttcttattttttaaaattgtatactgccttgtcatcatctcttgcctagacttttgcattaacattctaatcccatgtttacaaagcttccaaagttatctggagactatttttcaaaaacctttgatgggtctccatcactaatgtgataaattcaacaccctttagcatggtttactaggtctttatgtcctgaaaagtgaattgggttgaagtgaattacattgtgttatttgtaaacagaatggtcacagcccatgatcagtgagttattttaataagttgaagtcaatctttaaaacactgtcttgtgatatactaatttcttatcctaccaaatatatttacaaaacagggctacaaagcagagtcacaaaattgccatgcctagatgctgaaaagactgcctgtttgacaaaaatattgctctcttggagcatgcggaagctaagaaaataagttttccactgatggaaggcccctgctgtactctctgatgatgattgggaaatatttattttaccagaagtgggattataaccattttcatgcatcgacggaggttcaggagtcagcccctcaaattctgttgtcaattctcctgtcaattcagctctgcatttagactctctccagggtctgctggaactttaactgctgaaaactttaaagattttgcctccttcaaaaatattatagagagcttgctgtgttgacttaacttgtgtgtgtgtgtgtgtgtgtgaatcttgttcttcatactctactaacacaccactacctccaacaataggggagacatttttgaattgatgtctcagcaattgtggcacatcatactgaatcattcaccttttcctgcccagcctgctttactttcagatactaaagagaatgttttaatgagcaggggaaaattatggacagtcagaaaaaataaactgattgaattcaagcatcttgtttttgaagttgaagtctgtctggcacaacagctggagcttaattcagaggggataccacagtagcttttggtcttgaaaagtgagttaccaatgttttcttctaaagaatatctgccatttccttttatttctgtgccttgactcctgtttctttactgtaccaaggtaatagaaaaaaaactagtgaaaggtacaatctgttaatatagctctgggaagtgtaaaaatgaatgagatctctgtctactgtgcttggaatgtctgagaagcacccctggctggatgattgatatttgggtttaaatcctgatttattcaagacttactataaagttgattcacttataggatgaaggggttgtcctggttgatttatgaatatgtatgtgtgagggggtgggaggaaacgtctttttgtatctagcattccctgactctgtgatctatacccataattctaataaggatctctctgtgtgtaattaaggggtttcctggccttttgcagaagtatgtagaacagagaggacaaaagaaggaggagaaaatatagaaatgcaacttgggccaataatgctactccccaaatcttctcatctgtttctctatgggtggctccaatcatgtttcctccatgactcagtacaatttcaggcctaggtctgactctgtacttctaagagaagtaaactgcatctttagtttagaggtaggggaagagtgagcataatggtggtaaaaggaggcagatgcttgtgtcagatgataggtatgctcgaactagagcacatgattgtcatgtaaggtaaagcagagcttgaggtggtcacggatggaaaacatgcctgtgctgacaataatagatacaatgtactgaatacttactatgtgctagggactactctagatgctttatatgtgttgactgattgactctttcaataactctgtgagttaagtattaccaaccacatagtacatatgatgaaactgagactatcagagattaaatatcttgcctaaggcctcataactcgtaagcaataaaaacaggattcaaactacgagctggctatattcttaaccattctacctcagtggtcttacatagccataatctgatttttctctttattcaaaattttgagagtaatagatgttgcttaaaacaaatggggtttgaaaataatccatttgagaccaggcacggtggctcacacctgtagtcccagcactttgggagtctgaggcggatggatcacctgaggtcaggaattcaaaaataatccattagcacctttttaaaaaaatcttttaagatcttgttttaaaattatacttaaattctgggatacatgtgcagaacgtataggtttgttacataagtatacatgtgccatggtgatttgctgcatccatcaacctgtcatctacattagctatttctcctaaagctatccttgccccctctcccatccgccgacaggccttagtgtgtgatattcccctccctgtgcccatgtgttcacgctgttaaactcccacttatgagtgagaacatgcggtgtttggcattttgttcctgcattagtttgctgagaaggatggtttccagcttcacccatgtccctgcaaaggacatgaacccattcttttttatggctgcatagtattccatgggagatatgcgccacattttctttatccagtctaacattgatgggcgtttgggttggttccaagtctttgctattgtgaattttgctgcaataaatatacgtgcacatgtgtctttacagtagaatgatttataatcctttgggtatatacccagtaatgggattgctgagtcaaatggtatttctggttctagatccttgaggaatcgccacactgtcttccacaatggttgaactaatttacagtcccaccaacagtgtaaaagcattcctatttctccacatcctctccagcatctgttgtttcttgactttttttttttttttttttttttgagacagactcttgctctgtcacccaggctggagtgcagtggtgtgatctcggctgactgcaacctccacctcctaggttcaagcaattctctgcctcagtctcccaagtagccaggattacaggcacctgccaccatgcctggctaatttttgtatttttagtagagatgctgattcaccaacttggccaggctggtcttgaactgctgacctcgtgatccacctgcctcgacctccaaaagtggtttcctgactttttaatgatagccattctaactggtgtgagatggtatcgcactgtggttttgatttgcatttctctaatgaccagtgatgatgagctttttttcatatgtttgttggccacattctttgaaaagtgtctgttcatatccttctcccactttttgatggggttgtttttttcttgtaaatttgttgaagtcctttgcagattctggatattagccctttgtcagatggatagattgcaaaaatgttctcccattctgtaggttgcctgttcaccctgatgatagcttcttttgttctggagaagctctttagtttaattagatcccatttgtcaatcttggcttttgttgccattgcttttggtgttttagtcatgaagtctttgcccatgcctatgtcctgaacggtattgcctaggttttcttctagggtttttatggttttagatcttacatttaaatctttaattgatcttgagttgatttttgtataaggtgtaaggaaggggtccagtttcagttttctgcatgtggctagccagttttcccaataccatttattaaatagggaatcctttccccattgcttgtttttgtcaggtttgtcaaagatcagatggttgtagatgtgtgatgttatttctgaggtatctgttctgttccattgttctatatatctgttttggtaccagtaccatgctgtttggttactgtagtcttttagtatagtttgaagtcaagtagcatggtgcctccagctttgttctttttgcttacgattgttttggctatatgggctcctttttggttccatatgaaatttaaagtagttttttctaattatgtgaagaaagtcaatggtagcttgatgggaatagcattgaatctatgaattactttgggcagtgtggccattttgatgatattgattcttcctatccatgagcatggaatgtttttccatttgtttatatcctctcttatttccttgagcagtggtttgtagttctccttgaagaggtccttcacatcccttgtaagttatattcctaggtatttcattctctttgtagcagttgtgaatgggagtttgctcattatttggctctctgtttgtctattatttgtgtataggaatgcctgtgatttttgcacattgattttgtatcctgagactgctgaagttgtttaacagcttaaggagattttgggctgagatgacggggttttctaaatatacaatcatgtcatctgcaaacagagataatttgacttcctctcttcctatttgaatgctctttatttctttctcttgcctgattgccctggccagaacttccaatactatattgaatagagtagtgagagagggcatctttgtcttgtgccagttttcaaagggaatgcttccagcttttgcccatgcagtatgatattggctgtgggcttgtcataaataggtcttattattttgagatatgttccatcaatacttagttcatgaagtgcttttagcatgaaggggtgttgaattttatcgaaggccttttctgcatctattgagataatcatgtagtttttgtcattggttctgtttatgtgatggattacatttattgatttgcacatgttgcaccagccttgcatcccagggatgaagctgacttgatcgtggtggataagctttttgatgtgctgctggatttggtttgccagtattttattgaggattttcacattgatgttcgtcagggatattggcctgaaatgttctttttttgttttgtctttgttatgatttccgttctttttcatttgctgaggagtgctttacttccaattaagtggtcaattttagaataagtgctatgttttgctgagaagaatgtatactctgttgatttggagtggagagttctgtagatgtctattaggtccacttggtccagagctgagtccaagtcctgaatatccttgttaattttctgtttcattgatctgtctaatattgacagtggggtgttaaagtctcccactattattgtgtgggagtctaagtctctttgtaggtctctaagaacttgcttcatgaatctgggtgctcctgtattgggtacatatatatttaggatagttatctcttcttgttgcatggatccctttatcattatgtaatgcccttctttgtctttttttatctttgttgtttcaaaatctgttttatcagattgcaacccctacttttttatgctttccattttcttggtaaatattcctccatccctttattttgagcctatgcgtgtctttgcatgtgagatgggtctcctgaatacaccacactgatgggtcttgactctttatccaatttgccagtctgtgccttttaattggggcatttagcctgtttacatttaaggttaatattgttatgtatgaatttgatcctgtcattatgatgctagttggttagtttgcccattaattgatgcagtttcttcatagtgttgatggtctttacattttggtttggttttgcaatggctgacaccagtttttcctttccatatttagtgctaccttcaagagctctcataaggcaggcctggtggtgacaaaatctctcagcatttgtttgtctgtaaaggattttatttctcctttgcttatgaagcttagtttggctggatattaaattctgggttgaaaattcttttctttaagaatgttgaatattggcccccattctcttctggcttgtagggtttctgcagagagatctgctgttagtctgatgggcttccatttgtgcataacccgacctttctctctggctgcccttaacattttttccttcatttcaaccttggtgaatctgacggttatgtgtcttcgggttgcttttctcgaggagtatctttgtaataaaaccttttgttttttgccactggagatatagatatgcagagattgatgataactaagaaacaatctacagagtatgcttgtaagcatggttatgaacagagactgtggaagctcctaggagtgatttgccaaggtctattactctctcagatcacagtgcaataaaaatagaaatcaaaactaagacaattgctcaaaaccatacaattacatggaaattgaacaacctggtcctgattgacttttgggtaaataatgaaattaaggcagaaatcaagaatttctttgaaactaatgagagcaaagattataatataccagaatctctgggacacagctaaggcagtgttaagagggaaatttatagccttaacacccacatccaaaagttagaaagatttcaaattaacaacttaacatcacaactaaaagaactagagaaccaagagcaaaccaatgccaaagatagcagaagacaacaaataaccaaaattgcagctgggctgaaggaaactgagaccccaaaaaacattcaaaagattcaggagcttttttgtttttaaaaataatattacaaagtagatagactgctagctaggctaataaagaggaaaagagagaagatccgaatgaacacaatttttaagtggcatatggggtattacccctgaccccacagaaataaaaacaaatatcagaaattactattaacacctctatgcaaacaaactagaaaagctagaagaaatagataaattcctggacatttagcccctcccaagattgaaacaggaagaaattgaatctctgaacagaccaataatgatctccaacattgaatcagtaataaatagcctatcaaccaaaaagaaaaaaaaagtccaggaccagatagatggattcacagccgaattctgccagatgtacaaagaagagctggaatcatttctactgaaactactccaaaagctaagaaagagggtctcctctccaactcatcctatgaggccagcatcatcccgataccaaaacctggcagagacacaacataaaaagagaaaatttcaggtcaatatccttgatgaacattgatgcaaaaatcctcagcaatactagcgaactgaatctagcagcacatcaaaaaacatatccaccacgatcaagtagacttttctctaagattcaaggttggttcaacatatacaaatcaataaatgtgattcacacataaacagaactaaagacaaaagccacatgattacctcaatagatgcagaaaaggctttcaacaaaattcattatctcctccagttaaaaactctcaacaaactaggtattgaaggaacatacctcaaaataataagagccatctgcgacaaacccacagccaacatcatgttgaatgagcaaaagctggaagcattctctttgaaaaccatcacaagagaaggatggcctctctcaccactcctgttcaacttagtattggaagtcctgactagagaaattaggcaagagaaagatataaagggcatccaaataggaagagaggaagtgaatctatccttgtttgtagatgacatgatcctatatgtagaaaaccccatcatctcagcccaaaatcttcttaagctgatcagcaacttcggcaaagtctcaggatacaaaatcaatgcacaaaaatcactagcattcctatacaccaacaacagtcaagccaagagccaaatcaggaacaaactcccatttaaaattgccacaaaaagaataaaatacctaggaatacagctaactagggaggtgaaagatctctacaaggagaactaaactgctcaaacaaatcagagatgacacaaatttcccatgctcatggatggcaagaatcaatatcataaaatggccatactgcccaaaataatttatcaattcaatgatgttcctattaaactactaatgagattcttctcagaactagaaaaaaagctattttaaaattgatatggaaccaagaaagagcccccaaatttcaaggcaatcctaagcaaaatgagcaaagctggaggcatcacactacccagcttggtaatgcattttcttacatttgctctccctcctttcctgtctcacttctccttttccttacaagtgaataccttgaatttcatacccctagaagtgttagcatgtacctcaggctctgttttctaggcaacccaagctaaaatgataaaatattggtgcagttagtaacatgatgagttggtagttgaagggctttgaaaattgtgcttaagaatttggatttgggctttatccacaggttgtggataaggagaagggtatttagatagagttcctggcataatacttgggtgatgatataatctgtacaacaaacccccatgacacatatttacctatttaacaaccctacacatcctgcacatgtaccactgaacttaaaagtgaaaaaaaagttgcttagaagctttgttacttatgattttgagattagagagaaaaaatatccatagtgtcctcaaaaaagaaatgtaatgaatgatgtctttaacatttatatagtaaatacaataacatatttaataacataatttcttatagcttctttcttataagtaggccaagggcaagatagcatagaagcaatgtactctatatttgcataatgtatatagaaattggcccactcaagcggcttcttaaaacagcctagacacagtcgaaaacttacctagtggaatgaccatgccaaaggaaactcattgcacctgggtggttcagaccaatgtctgatggccgctctataaaccacagataaaagatctgattcactctactggcccttcttcaaaaaagaacaggagtcctgagagatctgtaagctcaggactattttcagcttgtaaagggctctctccagtccttgcacatagtaccctacatctcagaaccagcaatagggtgttgaatgtttctcatgatgccatgtctccaacccttcttttgtcacatctttttctgaccaagctgggaaagattctctgcttttcaggattttgtgattagacttagtcaacccaggtcttacagccaattgccccatctcaaggtcagtatccttaatcacatctgcaaaatcccttctgccatgtaaggtaacatattcataggttccgggcattagggtgtggatataatgggaatgcggggcattattttatgtaccacaatgcctgttttgatcaaggtgtagtagtggagataaagaaaagcaggagattccgaatatgttttttaaggtagaaacaatgggatttgtctgttttgctgagattacaaatgaaagagaaaattcaaggatgactctaagttgcttggcctgagtaatgggaattattgaattgccattaattgagatgaggaagactgtatgaataggcttgcagggtctatatgtcaggataggttaggttatgttgtagtagctaacaattataaaagctcagtggttttacaaaggacatgacagccaatttttaaaaatttttatagatttagggggtacaagtgccattttcttacatgggtatattgcatagtggtaaactctgggctcgacagccacctgttttatttggtccttgcctcaaggtatagttttaaaagcccttgtgattcaaagaatttgtcagttttatatttgatagttggtggcaaaaaccacttacatcttacaatcctgcaagtccctggagttttgaattctatttcctctcactcctgtttcaaattggcagagctcatctctttcttgaagtacagtgtcaaatacagtcaatagtagcagacataatactaacattctgttttgcaacattttaagccataaagcaacaaacttattaagaacattatttatctttgaacttattgcaggcaaacttttcagcactgcatactgtagatcaccataccttccatactctggtaacattttttttttcttctcactacctggccctgaaaccaatgccatgtttttttctattatagcagaactgacttctggcaccaatttcactatcagctaggatagactaggtcatgtagcaccatcacacaccataaaattctaatggcttataaccacaaacgcttatttcttactcacacatctcattcatgtcatcttcactctggaacacacaatgataaaatacctactatctggattattgccagtcttctgagaggggaaaaagagagaacatgaaaaccgtgtattgactcttaaagctatgcctaaaaatgacacatgtcacttctgtttatacttcttttgcccagaataaggcaagtagccaactcgatatcatcaggacaaggagtatcatcctctgccagactgggttagtaaatacttacaggcaataaaatagtctaatataggagaccagctcaagtgtttggttttggatgtattatatttgaactatctcttagatgtccaagtggagatacgaagtaagaatttgcatttgaaagtttggagctcagaagagatagaaactttaggaatcgagatcatatataaagtagttaaaatcaggagagtggagtgattatgatcattaaagaaatgagtacatctagagaagagaagagatctaccatcacttagaagtgaagcaaaaagaaagtaaaaatttaaaaataaatgggggagcagttgtcaataagttagaggaaaaactggggatgtatgatgtcctgaaagccaagcaaagaaattatttcagtgaagaggcagtgatcatctttgttatgttgccaataggtcaagtaagataaagactgaaaattgaccattggctacatttgcgtggataccattggtgatcttgagacagttttttgtggggcagtgggtatggaagtctgattagactatacttaaagagagggtgagagaaaaggaattaatgatagttaaaaatgggataatagaggggtaaatagggccaagagagggttttttttttttaaagaaatgtgaatggtatcagcatgtttatgtgttaagtaaaaagttctactctaaaaagatcttactctaaaaagagttagagatgttagtgatgatacagcacagatagaggagaatcgctggaacaaggtttttgagtaagtgagagaatatgggacccagttacaagttgaagctttggtcttagctagaatcatagacagtccattcttagtaacagtagaaaatattgagcatacgatacaaatgctaatacacagataaatgtgttggtggcagcttattgaagttctctattgatttcttctatgtaatcaatgaaacaagcaacaaagtcatctgagaccaagaggaagaaagtgttggaaggctggaaatagtggaaaatgtatgaaattgtcctatgagagaacagtggagagaagaaactagggaaatataatttagtgatcaggtagcattaagaacccttctgaggccaataatcataaatttaaagaccagtcagtatggatgtatgttttgctccagtcacattcagatatagaagtaaagccatggaataggtgaaaaactgaatttaactatggttggagtcttgccatgtgagaatgatgatttgagagaggagaaacagtatttgtgttatatgcatggcggtggttataattgcccatgggctttttaaactggataataagggaagtagtatcattcagagggctacagacagtgaaaaaatgataggctcaatacatggtaaatctaagtgggattgaagaattatgggattcaagttactccaggaagtgaactgtaaagagagcagcaatggctggaggctgggatgcatgaaattgaaattatgaaaagattatacatatacgtaatgacaggatctatgcatcatcatctttgttctctcttttgtcagaaaaggcactgctatttcctctggccagaaagaaatgtatgtttgtagcactagaaacccatgggttgggacttatgggtgaccttaaattatctgggtctctgttatctcatctctaaatgggattgataatattgccttttctttggattaatgcaaggattagacataatatatgtttgaacccaggagttcaaagttgcaatgagctatgctcaccccacagtacactagcccaggtgacagggtgagatcctgtctctaaataataacaataataataataataataataataataataaatgtaaagtgcttgaaacataccatttctgaatgcctgttattattgttgttattgctattatccttatctcaaacagaactggcgcttggcatttcttacttagagattactttcgatggttttggagtgaggggagagatgagacttaccaagaatcagaaaagcctgtgaggtcatgaagagaaatagcattttcttttcccagccttcatgtcctcattctactctttacctcacactatgtttatgacattaaactgacatggttgaaagtcagaaggtacatcaacactgtgttctataagaactgatcttttgataaagtttgtgcataaattgttgacattgtgacaaatgtaaaagcctgtctcagccaaaaaccccatcccaggtagtttaacatattccttataattattatacatttatccccaagaactgataatgccaagggctgagagcctgggaaacttggacataacctgctccaagctcaattccagttatccttaaaagaggggtgtggtaatgttgtcccagagtgacagcttcagccagtttcctgtcccactcttctgccccagagtttctttcttgtggtgaagagaaggaggaagacagcaggatgttggtggaaaccctgctggctgaagtggacagaatggtgttcagacactgttcatctccaaaccttctgctttacttttatgacaacattcccatgggtaaggcactctggccatctggcacactgatcccccatctcctgcaccccagactgcttcaggacctttgttttgagttcttggactgctcggtgaacaggaccaggaggggacataaattttggattgttagtaccagctaactaagtgaccatgtcatttcctcttgttgggcttcagtttgggagtaggggtaggcaagataccaagggaattctatgatctcatgggaacccaagaacccagtggtgcaaataatgtaatcatttgaaaaaaaagtttgaaaacaagtattgagaaactaccatgttggtcaatttcaatttaaatggctgcctcagaataatgtggataaaatgcacagcattgactttacctgggttctctgagccctaacattcttaatttagacaacacattgctattgttcttgagaaatactagattataaaaaaattcaaattcaatgaaaaaaataaataatttaaaacatattttatattgttcccagtaacttcttcattttctgattaaaaactattacccttgagagattatatttctcctcactgatgatttgaaggagttatttggcttattttttggtcagagttgctgtaatgttgaacttttttgtggggcaaagggtgcgtctaaaaacttccaaaagttgtttactaggcatttttgtttgatcaaagtattaagaaatcacaataatggatgataaaaatcttagtttaaaagcaatggaccacctgcacacgtcagctgtggtgaatgtcaaatgactgccccatgtgagaataagcataagaagcctaaccagaggtctggaacctgtagcatctgttttaagtttccttcctggacttagaccctacgtggtataacagacaacccttatgtagatcctttcagcttcatctatctccagggccacctattctgccctagtcactcagtgttgatggacttcatgggagacccttaccaccaggaatctctggcttcttccaccacttttttttttcttttttttttttattatactttaagttttagggtacatgtgcacattgtgcaggttagttacatatgtatacatgtgccatgctggtgcgctgcacccactaattcgtcatctagcattaggtatatctcccaatgctatccctcccccgtccccccaccccacaacagtccccagagtgtgatattccccttcctgtgtccatgtgatctcattgttcaattcccacctatgagtgagaatatgcggtgtttggttttttgttcttgcgttttcaggacataggcatgggcaaggtcttccaccacttttagacttaaatatggcttcacatagtcatgcataggatctacgttccccagctgtggctgaaggggccttgcgatgcaactcagaactgggaggctgttaattccctatgaaattagggtgtgaactttaacaagttgggttagaagataagagaaaactggttgatgaatttccagtctggcaccccatcactctgtttagagatagtagcttcataaatctctctaaacatccaacatgagtgagcaattgactgtatttttacaaagctttggctagcttgttaatgcatgctcttacatttgctctccctcctttcctgtcttactccttcttttccttacaagtgattaccttgaattgcatacccctaaaagtgttagcatgtacctcagactctgttttctaggcaacacaagctaaaacagataaaatattggtgcaattagtaacatgatgagttggtagttgaagggctttgaatattgtgcttgggaatttggatttgggatttatccacatgttgtggataccgaagagggtttttagatagggttcctggctgcaagcagcagaaaccagctctgactaaagcaaaaaaggagatttatttgagaaatattatagaaatcctcaggatggaaggtaggacttgggagggataggtgtgaagatagtactggaaaactcggtggtggaactcctgggccctctctttaaaaactatcatcaaatcaacttcctgcaaattagaagtggaccaggtatgaaccaatcattgtcaagattcgagagtgaaataaaggggaaatgaagtgtaaaaagaagattgaagatgttggagaaaagaggaactggtgaaggagttcttccttaggcagttgggagaggtggtaactgagactgtgaagcctgtagaaagaagtaggatatgttgtcttcctaaataggagagaaagaagattatgattttaaacacaaaaattatctgagatggtgagaagtagtaggtgagggaatgaagtctggatagaacttcccagaggatgaattcacatttgttcatgtgctccctctgcagtgtgattatgttatttacttcacttctgtgattcagtttcttcatattttaaaacagggtttcagacccaaaagtccttttctacctaaataagctataattctctatctcctttggtggtagaaagggtgaagagtaggttggggggactctttggtctatcttggatagatagagctctttaggtttctccatttgcaccaacatttctcagacattttcctccaaagttatgccatcttagacaatatttgtgtaaatggatggattaggctgtgattcttacatatcaccaagaagagatattttcactatcaaagtcacttgatttctcttcaatttgcctctccctacaggaagatgctctcctggtacctgaccatcttaccaaggatgaaatacactgacgcatggtatagaaagctgggagatgtcatagcagaatacctcccctttgtattgtcaggattagccatatgacttgccttaacaattaattgttagcagaaatgatgtgaatcacctttggcagaaactttaggagcccgtttgaagctcttttttccttctgccatggtgactggaaacattctccaacagtggttgctccttcggcctgagacttaaagtgacaataatggcaatgcagggaatagcccaagccaaccttctagaattgttacaaaagcgagaaatcaacctttaggctacaaggacttgaggattgtttattagtgtggtgttccctagattgtcctaattgacacaaggcctcaatactcttctattgagtgtagaattgtttaggccaccaaaaaccaaagaaatgctggtagtgcacacccccttgacttctttaattgcaatatagcatgatacagttacaaaaactaattatgcctttagcttcatttctccctccccttccattgttctttttctgtcttgctactgttcctctttataatgttgggggtgttaagactctttcttttcttttgtaggaaagaagtcacccatgcttggcccaaagatccacatattatctctttgattgtaggcatcgagacattttttaagcacatattattcaacaaatgatattctcagtttcagtagataataaaaaataaaaagcccaatgtacattctattcctgtagaaacagacaaccagtgatttattttatcataataaaaagtatttatgccatgactcatatctttaatgcagtgtcattattctgtggctgtgctaactgtagaggaagagttgtttatagtcacagacagagcgtcagactgagacccaagagttattccaagaatggtgacaagaacagagtgtgttagaaggagctgcccagctgagaggaggattgtgtgaagtagaagtaacctaaatattctattatcttctgtgcttttcttctctccagggagaatttctttgttctgatctttattggagcccctagttccttcacattccattctttaatgatgatttttttgaacatccaagttcgtaatggaatctctctccacaaatttcgctgggatttccacagaaaaaggtgtacacatagctagcttaagaatacatgcgccagtatgggctggtccagaccaatcacagagcgctagtgcacagtgtatagtcagaccatttaactaatactaacaaagccttctttttctcttttcctgagacagaacaattataactctgggataatgctagggaacttgattttcttttagaaagttatactttttcaaatgataacataaggaaacacccatatactcatgttccagatttaaaaactcttaataatttttatatttccttgtagcctttgtgtgtatgcttttttaaaaaaagaccacaagttatatagatgtattcttttttcaggtttaaaggtttttttaacttttattttgggttcagggatacatgtgcaagtttgttatataggtaaattgcatgttgtgggagtttggtgtattgattatttcatcacccagctaataagcatagtactcaataggtagttttttgatcctcaccctgctgccaccctccacacaccctccaccctccaccctcaagttggccccagtgtctgttgctcccttctttgtgtccttatgtactcaatgtttggctcccacttgtaagtgagaatatacagtatttgtttttctgttcctgtgttagtccacttaggataatggcctccagctccatccatgctcctgcaaaggacatgatctcattttgtttacggctgcatagtattccatggtgtatatgtaccacattttctttatccagtctaccatagatgggcatttaggttgattccatgtctttggtattgtgagtagagctgcaatgaacatacacctgcctgtgtctttatgatggaatgatatatagtcctttgggcatatacccattaatgggattgctgagtctaatggtagctcaattttaagctctttgagaaatctccagatggctttccacaatggttgaactaatttacactctctccaacagtatgtaagtgtttccttttttccgtagcctcactgccatctgttgttttttgaccttttaatagtagccatgcagacgggtgtgagatgctatcttattgtgattttgatttgcatttctctaatgatcattgatactgagcttttttttatatgcttgttggttacatgtattccttcttttaaaaactgtctgttcatgtcctctgcccactttttaatgcggctgtttgtttttctctcgtaaatttaagttccttatagattctggacattagacttttgtcagatgcatagtttgcaaaaattttctcccattctgcatgtttactcttttgatagtttcttttgctgtgcataaggtctttagtttaattaggtcgtatttctcaattttagtttttattacagttgcttttggtgttttcatcatgaagtctttgccagttttttttttaatatataagatgtaatactcctctttgactgtatttccagaccattgctctctccctgttcctcagagacaaccactatgatgggtttgatattcatccttttaatacttttacatatagcaatagaaatttagaaacaagatataatatttctaagttttgaaaaactatatgtatggaattgttccatgcatttcattctgcaatttgtttgttttttaaatttaacgttgttttagggctattcttactgattgatatagctctgatctctttcttttagctggatagcaatccatttcattaaaattccgtattttatctattcctttaatgatggatgtttggattattcttaattttttttttttgctattcctgacaatgctgtaataaacatccatttatgtgtcttcttgtatacatagtcaaatatttctctagggtgtacacccagaaggggaaatgttaggttgtaggtttgacatctttctcattttactaaatactgttacattcctctcccaagtggctgtttcaatttacacaccgaaaagcatggtatgagattatctgtttattcatcctccttctctatactgatgattgtcacactttttaattatggttagtctgatgagtaaaagatgctctctcattgtagttttaatttacatttccctgattactggtgagattgaatttcttttcatatgtttattgaccatttatgtttcctctggatccattatatgcttacattatctctgctgattttttcctacatacagaaaaagtacactcaaaagcatttatgcataaaaagaagctggaggaagagggaaaaccattttcagtattgtttactagagcagttttctttaatctacctgaataagatgacttcattgtgcaatttcattttaggaagaagagactacggtatcacattcatttactgcatagatgttatctaatcacaaagcaccttcaaaaccgatacaaattctatgcaacttccttcaaaattaacacattagcatgctttaagtaaacatcagtgtgtaatagctaaaacatgggttttggagtcagaaggagttggcttcctatttcagttctgccagtttcttcctagaaggaacttggggagtccatttagtgtctcagagtcattagtatattttcttggactctttttcagcaccagactcagcgttcacctctccatccacttccttgttataattcctggcattttcatgataattatacagcctggcttcacagtctagaatttttcattcggacactgtctccttgctacttctgttgacctattagtatggtctcacatagaaccaggttattacttatgatccacctccaagaaccccaacttcaaactttttctttctggccatcgtgctccttcatttctgatccttcacttttcttgttatattatcttccatcccactagctctaccctatcttcacaggtcctcagccccttttctctttaccagcttgtctagcagtctaaagccttgttcgacaatgccttctctctccagggctcccctggtccttccattgcctccacctggtaagtcctcagtcccaaacacacctgctgtgagttttctctgctcttcccatcatgagctagtcagcaccaggataattcgattacatacagcagtggttctccaaacatgggtcctggaccagcagcatccacatcacctaagaacttattaaaagtgtacattcttgaaccccaccccagacctactgatttagaaattgtggggctgggacccagtaatctgtgttcaacatgccctccaggtgacgtactacaccttcttgacctcagctgaggtttcttgacaaatctattaactcttcagttgaatgcctgccaaaattttcaaactaaagtgcagattccccaatgttaacaattctaatttagtatatcttagtgcaactcaggaatctgcatttctaatatgcattccatgagttctgattcaggagtgtctgtggaccacaccgtggcaaacattggggaaaaaagaaccctcatggtagtcttctaataccactaacctcaacccatctctcgaaaaagacatggcctctcttttgagctcaaggagttgaaagctcaatccgattctttcctccctcctctgataactcattcaattacttcccacttatgttcccccacatacggaaatctgttttatgtttaaaaacgtttccatgacattgctacacctttggattctaattttattttattccatttcttctttaagtatttgcaagagtgaagtaaccacacaacttacatatcttcacgctcacactcactcacttctaccaccgtcaacacttcactgaaattattctcttgacgtttcctaaagacttcaaaattgtccaatcaaatgaccttgtcagtttacttcctcctctcccattctaaaattttattctgatgaccaccctctcttattaaaactctcccttcgactggcttcccatgacaacaacttctctcggtttcccttctatggctcagatttccccttctctttctctgttttgtggcttccatccctccaattctctcagtgaagagtatgttttccttgctcttctcttttctttttcacatatgttaatcatttttttcactttcaattgagctgtaattgacatacgataaaattcagcatttaaaaaatgcaattcaatagattttgttatattcacagagttgtgcaaccaccatcacggtgtactttcagaatatttttatcacctccctcctgccccctcaaagaacccaccctgtacccattaacagccactccctattcctccctccctgctgcctctggcaaccactaaccttttgtctctacggatttgcttatttgagacatttcgtataaatggaatcatacaatatgtggccttttgtgtctggcttccttcacttagcatgatgctctcaagagagatccatgttgtatcatgcatcagaatttcattctttttatgtccaaacaatatttcattgtatagttatatcatattttatcctttcattagttgatggaaatttgatttgtttccaccttttcactatcataaatattgctaccatgaaattttgtgtacaagtttctgtgtggacatatattttcaatccttttgtatatatacctaggagttcagttgctaggttatattttagctcaatgtttaagtttttaaggaactgccaaaccattttccaaagcagctgcatcattttgcattcctaccagcagtgtatgaggattctggtttctccacatccttaccaacacttgttactgtttttatattttaattatagccaccctaatgggtgagaagtggtataatttcatgattttagtttgcatttccttaatgactaatgacgttggtaatcttttcatgtgcttattggctatttgtatatcttctttgaaaaatatctattcttacttttgcccattttaaaattggactatttttctttctttcctttttttttttttttttttttttttgagctgtcaaagctctttgtgtattctggatactactccagtatcagatttatgtgatttgcaaatatattctctcttcttctatgggttgtctttttactttcttgatagtatcctttgtgtataaatgtttttaattttgatgaggtctaagttatctattttttctttccatgtttatgcttttgatgtcatatctaagattccactggcaaattgaggtcattctctagaaggctgtgtatgctctgaatcagcatctaatatatggtagtgtttctcccgtatccaggattcatgtgtccaggaatcaaggggtagaaggggaagtggcaccactcaccaccaaccctagtgacccactaggaaaatttttgcttcctgttcctgcgacattatgttctgctggcctagaggtcttagttccagagggaggccaccaggagacacaacaatgattccattaaactggaagttaaggtgactacctggccactttgagctcctcctgcctctaagtcaacaggctaagaagggagttacagtgctggttggggtgattgacctggactatcaagatgaaatcagactactactacacaatggaggtaaggaagagtatgtgtggaatacaggagataccttagggtgtctcttagtattaccataccctgtgattaagatcaatgagaaactacaacaacccaatccaggcaggactacaggtggtccagacccttcaggaatgaaggtttgggtcactccaccaggtgaaaaaccatgaccagctgaggtgcttgctgaaagcaaggaaatacagaatgggtagtagaataaggtagtcatcagtacaagctatgaccatgagaccaattgcaaaaacaaagactgtaattgtcatgagtatgtatacacctgtactaagaaaatatccttgttttatctcctttctttttcctttatcatgtgacataagatttattgacttcatattagcatttaaatgttgttaactttctgtattagcatttaggttaagtattaatatgcttccagttgtacaaagggtagctgtactatgttaggtataattatgaccttattattgtctttatttggagattaagtatgatttcaggagatgcgtatgggttcaagttgacaaggggtagacttgtgatggttaatattaggtgtcaacttgattggattgaaggatgcctagatagttggtaaagtattgtttctgggtgtgtctgtgagggtgttgccagaggagattgacgtttgagtcagtggactgggagaggaagacccaccctcagtgtgggtgggcaccatccaataggctgccagcactggtagaacaaagcaagtgggagaaggtgggctaagctggcttgctgagtcttctggctttcatctttttcctgtgctggatgcttccttccatttctcctgcccttgaacatcagaccccaggctcttcagcttttggactcttagacttacacctgtggtttgcagggggctcttgggcctttggccacagactgaaggttgcactattggcttccctgcttttgaggctttttggactccaactgggcaactactggcttctttcttcccctgcttgtggaaggcctatcgtgggacttggacttgtgatagtgtgagccaattctccccaataaattccctgataggatatatatagcctattagttctgtccctctagagaaccctaatacagttttacccctatattttcttctaagagtattaaagctgtagcttacagctaggtctcttatccattttgaattaatttttgtctatgatgtgaagggctcaatttcactttttgtttttgcatctagatatccaattgtaccagcactatttgttgaaaagactattctttcctcattaaactgttctggaaactttgttgaaaatcaattgatcataaatgtaagagtttatttattgacttttaattctatttcatctgtatctctattcttatgctagtaccatgctgtcttgattactagtagctttctagttgattttgaaatagaaatgtgtgagttctcaaacttcatctttttcaaaattgttttggctattctggatcccttgtaattccataaaaacattaacattaacttctcaatctctgtaaaatatccaagtggaattttgttagggattgcattgaatctgtggatcaattttgggagtagtgccattttaataatattatgttttctaatcaatgaacatggaatgtctttcaatttatttacatctttaatttctttaaataatgctttgtacttttcagtgcaaagtcttgtacttctatggttaaagctatttctaaatattttgttctttttgatgctcttataaatggaattatcttaattttgtttcccagttgttcattgctactgtatagaaatacagttgacttttttagactttgctataactattttttggatattgatcttgtattttgcaacatagctgaattcatttattagttcaaataggttttgttgtgaattgcttaggatcttctatgtgcaagatcatgtcatatgtaaatacatacagttttacctcttttttaaaatctgtattgcttttattttttttctgtctaattgacctgtctaaaatctccagtacaatattatatataagtggcaagatcagacatccttgtcttgttcttgatcttagggagaaaactttcaattttttgccattaagtatgtgttagctgtgtgtttttcctaggtgccctttatcaagtcgagtaaattcccttctatttctagtttgctcagtgattttatcttgaagttgtgtttaattttgtcaaatgcattttctgtatcttttgagacaatcatgtgggtttttaaaaatcctttattctattaatacagtgtatcacattgattgctttttgtatgttgaagtaaccttacatttatagaataaatcccacttggccatggtgtataatcccttttatatgttgttggtttccatttgctaggattttgttgagacttttgcatctataatcataaagtgtgttaatctgtagttttcctgtcatgactgcctggtttgagtatctgggtaatactgacaatatataataaaatggaaaatattccctccttttctattgctttagaagagcttgtgaagtttggtgttaatttttctttaaatgtttggtgcaattcaccagtaaagccatgtaggacagggcttttctttgtgggaagtttatttttattaatagctcaatttctttatttattatagatatactcaaattttgtatttctttttgagtcaattttgtagtttgtttctttctcagaatttgtccatttcatttatgtaatttattgacatgctattgtttatagtattcccatataattctttttattttggcaatgtaagttccccctttccttcctgattttaagaatttgcgtctcctctcttttatctttggtcagtatagctaacggtttattaattttgttaattgtttcaaagagccaagtttgatttgtttgattttattcattgtttttctattatgtatttcattaatttttgctctaatcattattatttccttccttttctttgctctgggtttaagttgcttttccttttctagtgtcttaaggtagaagtttaggtaacagatttgctatcttttttcatttttaataaaaatatttacagctgtaaattttcctataagcactgttttcactgtatttcatatgttttggtgtatgtatttttgttttcattcatctcaaagtatatttgaatttccctgtgatttcttctttgacccatttgttatttaagagttggtctccatatagttgtaattttcccaaatttcctattactttctaatttcattccactatgcttgaaatacatactttgtataattttaattcgcttaaatttactaagatttattttatgacctaatatatggtctaacctggataacgtttcatgtgtacttgaggagaatgtgtattctgctgctgttggatgaagtgtactagagatgtcttttaggtctagttgatttatagtgttgctcaagtcttctatttcgttgtggattttctgattcctgttctgtttttgaaagtggatattgaagtctccaaatttaattgttatattatctatttcttcaatgctgtgaagttttccttcatacattttaggactctgttgttagatgcatacctgcttggaattattttgtcttcttgatgaattaacccttttatccttatataatgtccttgcttgtctttagtgacaaatttgtcatcttaactctatttttgtctgatattagtatagccatttcatctctcatttagttactgtttgcatggtatgtttttttttccatctatttactttcaacttttttatatctttaaatctaaagtgtgtttgtaaagcatggacataattggccatctcaacagaggccatgaatagagatgggactattcagcagaaacactgccatgtgagactaaagaaaacaaagaaaatgtcataaaatgaaggaagactgttggacttcttagaccttataggactggaccataaagctatttctatctcttttgatattctctgtttggtcagacctcattctcatatttcctttagttctttagaagtggtttcctttggttctttgaacatgtttaaaatagtttatttaaaattttgtctaacaagtctaatgtctggtttccttaagtatagtttctattcactgcttcttttcttgcatatgagctacaatttcatatttcttctcatgtcacatatttttggttgaaaactggacactttaataaattgtggtaactctcaaaataagattatgccctctccctagggtttcttgttgctgctacttgttgtagctgttattatatctttccttagtgacttttatgaattgattctgtaaagtttgtattctttgacatgtttggccataagtttctgttctgttagcttagcggtcagctaattattggactgagatttccttaaatatctgaaatcagtaattctcccagtctttgcagaaaggccctgtatgtgttttggcccatgccagcaacactcaggaaatttacagccctatcatagcctttacttcctgcttacgcaaaacctcaatgtcagctaaaggtgagtgcttagagccttctcaggctctttcctgtatgtaaacatagccttgggaatgcacacagccctatgtatgtgcatggccttcttggattactaggaatgtagtggatctttccaaagtcctctgtgaacatctcattctctaacaatttcttttgttttttttggcctggttcttgtatgctccaattgctatcactacttcaggcagctgccttgttgaacaattgctgctgattgttttcacaaatgcctccaggaatttttctatactgtctgcactgagtgaagtctgggtcaggtcaaataaaggcaagtcttgcgaatgagggtttacagataactgctagatacatcaactaatgacagttctctaagaatggtgtatttaggagactccaaaaacattctgtcctttcaacttctgctaggctattgggatgggaatagggaaagttaaaatgttccaaagcttactgcccttaatgagatttagtaatttttctttaataaatgctcctcatattgttgcaaccttttggttaatttccagacttctgaaaatgttgattttgacagtttttgccagtgttctctttgcttttatgggggaactggcattacggagatccttactctgcttttcctgttgatgtcatcactgttaatttaatattggctgctacatctgtgttcccatttcacttgacctccacctgaatttcccttgatacatacctcaaatttaataagttgtaaatagaactaatagtctctttcctcaaatttgctcctgcttccaatgttcctgttaaaggctttactgcaaggccagagaaaattaagctggcaaagcagatggaggagtcatcaaaatggcagtaaaatttaattataattatctgtgttaatctggtgctgctgggtgtgaaaggaatgaaaagattatgaattggaaatttaggaatttgattcacaagattgacaccaaaattcccactgcctctgtactctcagactcaattgaataattatttgtgctgtgcaattaattgcttgctccacagaccagctgaattataacccacttcactgaatttcctacacgtagtaggtgctcaataaatgactaatagcataaaacttaagtaaataacataaataggtttcttttattctctcactcactctgtttctctgcctcataaaccagggatcttgtctctttcccagctggaaatttctctaaaaagtcatgaatataattactttttaaagtatttcattgacatgtcaacctgaattatatatcaaagagagtccaaatgagagtttggtatgagatataagacctaatatgatttcatgcctccttgtgggcatttaataaatattaattgtgctgggagccaatctagcaaatgatggctgaatctgttattgcccatcttttacatttcatacctgtatacttgacacagaacactggaaatcaaggactggcattcaccacaatgaaataaacaacaaaattattagcagggaccatggcccatggagctgacctaaaatagtaaagtccttcatttaggcctttaaggaaaaaatggcactgaaagtctcaggacaggcccacatgacataagtatatctaaactattttttacagtggaagatttttactttactgtttccatgtgcatgaatgtgtgcatgcgtatgagagagagaaaaaaaagagacagagggaattgtgtagacatatctgaatgttatattcactgttcctcaagctgaaagctttatacagtaagacaatggaatgtaaaaatgaaataaaaattcattaatagatgcctacatgaaatatttcaaacatttaaacattatgtataattattttccttaaaattaaataaaaaataaatatatgtatttatctgagtaaatacattcttggacaatagtgagttctcatcatttgctatgtgaatgaatgaatgaacaatgaatgaaaacagtttctcttaaaaattaaatggaaatacaatgttgcatgtaggtatttaagtaaataatgtttgtgtcttttgcaaaaacataatcaagtccactgtctagtgtgttacttaatgtcccttattaaaggaaagatattttttatcagtctcttataaaaactgaggctagggtattatgttaactgtctaaagatacagtattatgttaactgtctaaagatgtctggcccaggttcaagtactttttaaaaaattttttaacaagggatagtttacatatagtaaggtgcgtgtatctaaagggtacacaacttgatgaatttttacccactttgagaaatgaaacatttacgtatcagtagactccctcatgccccctctcagtcaatacccttgcccaaaggcaactactttcctgactttttacaacaaaaataaatattgtctggttttgaactttacataaatggaattatataacatgtattcctttctgtatgaatcctatcacaccacataatctacattgttgcgtgtagcactagtttattctttttcattgttgtgtagtattccattgtatcaacataacacatgttatttattcagcctactgctaatggacatttgacatggtctccggtttttggctattttgaatactactctatgaacattcttttgtgaccataaacacatttctttgttgggaataaaactctgtgtcatatgatatgggtaaatttaactttagtagatactactaaagagttttccaaggtgagtctaccaattttcattactactagcaatgtatgagagctccagttgctttacatcacgcgcattattttttaatatatcattcaggatcataggtcctctttgttcatttgcattttattagaagttttttcttctaattctaaaatgatttcagttggtggtggagggttctcccaagtatacattttttttttccaactgagaaacagtttcctttttcaatggaaatgaaggtacagacttctacaaaatatttctttgctctgcaggtctatcaatgagaagaaagtgccaactgaaaacttttagaaaatacccagtttactcaaggaaaataacatgcattgaaggtgattgctcaatagagagaagttgaaacagcagactaattgcctgtttgtgacacccatgtaatcaacttggtaagtaaaaactcaagaataatgttcaatgttctctaaaatgggccagaagcccttcagtgcagattcaggctctctctctttctctctctcacgcactctctctctctctctttcgtttacatcttatggcagatctttcttagggtcagtagagcacatgcagatttcacactatgcactctctctagctgatatctgatatcgagtctcatgggagtgattggagaagaaaaccaagcacagactctattatgctgagatcctcatttttagttgtggtaatttctattatattttatagtgccaaacactacttttaatctggaactttaggtcattatttccattgtggctccctacagtctagctccaactatgaacaagtactagttgttactgttagctcaatcattatttttgctttgtttaaacaacatatactatactcaggagtatattcagttaatggtttgaagtgcatcagaaaaattagatgacattaaagtacagttacttctgaagaaagcttgtggtactatataatagtggagaggtaaaactgtttaacagattaaacattttttcatgcttcagggaaaatttgaaaaacaattctaaattcagagctatttcttagacttttatgttgctcccctaatctgtttattctaattgtaagttagacacttatattctcccttataaattatatcttgacatataggatgatcaatccatgcacatgtggacagtaaaaatggcctgaaattatattttgtgttttgtttcactcagtcatttaacatttgttcatctatcaaatgtcactcagtcatgtcccttagcattggctctgtcaatataatgtggaaaatctagcaagagatcctttatttttcctcgggagcctggtttttaaacagagttatatcttcccagtgaccaccagagtcacatactatccagcagtactcaagtaagaatgctttaagcggtatattatctttaatacctataagtaataaattatgactttggaaatagtaacattttttaaagatacatacaatttgggcttcaaaatgcccagcttgcctatgtcccataaagatcccattaacagtttatctcattaacagccatttgtactcatcagttcaggctgtgttttcccactgagacatcatttacagtgctctaaacatattttcacaacattcacctgacaacatcagctgagagaaaaattttcagactgccgagaaacatcaggaggccatgaattcttaatcaacacaccaaattatgaaaatggtatgtatatctctttgaaaatatccttggcaatagttaatcgggaaaagaaacagtagatagtccaaagactttggctcagtaccctgctccccagttgttaagaggagatttcaaggcgtttgtgtggtggcaaaggttcatgacttctgtctcccttggggattgccactagagaacatgtggaaagaaaaactggttttagttttttgaagttcacaaagaagcagaaacaggctaaccaagaatcacctggtgaaaggtctcctttaatgagcaaataaaaatgatttataattagtacatatacataattttaaaatgagaccacaccaaaaagaaatctattcccttaaccggtaaataaataattcttcttctaatgtcctttagcacatttatttgtacaataatttacttttacatttccttataaagtgacccttaaacttaaaccagagtttctgtattgtatttcactcagattgcatttcactgtgctgggaacctggagatgcctgatatgataacttagggtgtgaattaaatctacagccacatcccttggtgatgtggttggtacccatactggacttccttggaaagcctttcattgtggtctaggtccttgctactcaagcctactcagagtatggtcttcaaaccatcagcattagtatcacttgggaagttgttagaaattctggatctcctaaccagattttataaatcacaatcttggggtgcagtggaggaccagtaattgctgttttaacaaacattccaggagattctcctacatgcaaaatgtgggaagcacttgtctaggatatcgtgttcataaaatcaaaacgatttattttgccacattgcctcacatgtcattgcctttggatgggctgtagcctctatcataaatttacttttctttttctttttttttttttttcactgtagcactccatgagcctttttgtgggctggttcttacttgtcgtttgtgactttctttaaggaattatctccagaccccaaaatgcacttattcttccctccagattaaagtagacacttttctgcttcctcccttggcataccacacacatcacagcaaccatataagcccattgacaattataacacagtataaggtctttccctctactgtggtcaactcctggaaggcagagctgcaactttaaaaaatccctgataataaaaatagagcttgatttttagtagaatattttgttgataaaaggtagaaggaccctcattgccttcagaatcgtcctcagaatacttcatttttgttactgactgaattgctttgctttttatattccctctccatctcctcatgggacagctctctctcctactccaactccaccatgtatttgtttctcccatctgcctagccaaactggtcaaattaatgtgcatcctttgatttgtccagccccttccctgaggcctgctccaagcctccattgtcttttgtcaataggtacagagtggtgggttagaaagaggttggtaaaggagactgcaggtggccatttatcctgctgattaagagatctcgactggtttgatgaagaagcaccattaaaaacaatagactcaacttccatttcaggaaagagtaggtagacgtgcttttctttttaacttttactatatacaactagaaattctgaacattatatagaaaacaaatataagaatactctgggccaagcacggtggctcacggctataatcccagcactttgggaggctgaggcgggtggatcacctgaggtcaggagtttgagaccagctttgccaacatggtgaaaccccatctctactaaaaatacaaaaaattagccaggcgtggtggtgggcacctgtaatcccagctactcgggaggctgaggcaggagaatcacttgaacctgggaggcagaggttgcagtgagctgagatcacaccattgcactccagcctgggcaacaagagcgaaactccatcttaaaaaaaaagaaagaaaaagaagaaaagaatgctctgcaatgtggagagaagaagacagtccggcaatgcagaaatgcccatgagtacagaaaaataaaatccccaataaaagccttctctctctagccaaagtattagagaaaaggcagcacatgaagagagaaaatttttgatactatttcactctagacaaacatcacagataaaactaaggccccaccctcaccagccacagcaaagggtgactggagagccaggactttcatcaccactgagaagtaatgaggtcttccccacattgtcagtggtggccatgtgagaaacactaatgaactacccctgcctctcccagccagggtggtatcagcagagccctactgggcagccagaagtcccacctccacccagcagtaatgaggaaccccttccttctgggtgccaatggaagctgagtgggtaatgtagacataaaacccatctggaagtagcaaggtggtacctgtacttctctttttaaatagtgtgagaggaagcttgctaaaacataagacttaaataagatccagagactcaagacaatgcctaaatgtctaggtttcaatcaaaaacaattcctcatacaatgaaccaagagaatctcactgaaatgagaaaagacaatcaaaggataccaatgctgagatgatacagatgttagaattatctgatgaaaacttttaaatagccatcataaaaatgcttcaatgggcaattacaaacatggttgaagtaagtgaaaaaataaaaagttataagaaagaaccaaatgaaaattttagaactgaaaaataatttttaaaaaactcgatggatggactcagcatgataatggaaggaatagaggaaagaatcagtaaacttgaaaacagggcaatagaaattaccgaatcagaacaagagtgagaaaatagactgcaaaaattaatagaactccagggacatgtgggattataacaaaagattttgtgtcatcagaatcctaggagaggagaaagagagtgaggctgaaaagtactggaagaaatagtggctaaaaactcctcaaatttgtcaagaaacataaatccgcagaatcagaagctgaacaaatcccaaacaggataaactcaaagaaatccatgccaagacacatcataaataaacttctgaaaactaaagacaaggaaaaaaatcttaaaaatagagaaaaaccatatcttacttatgggggaaaacaattagaataatggcaaatttgtcatcaaagctgtggacaccagaaggaaatgacacaatattttttcaggtggtgaaaaagaactgtgagtcagtacatatttatagcagttttatttgtaatagccaaaaactggaaacacccaaaatatcctataataggtgaatagataaacaaaagatggtacattccataatttgaaatattactcagcaataaaatggaatgaactactgatatactcaacaactggatggctctcaagggcattatgttgtgtttttaaaagccaatctcaagaggatacatgcttcatgatcttatttacataagatacttcatgtgacaaaatgatagagataaagaacagattagtggttgccagaggttaggtatagtggggaggagggctaggtatgactaaaaaggtagcactagggagatcattgtggtgggataatagttctgtatcctgattgctgtggtggttacacaaatctgcacatctgactaaatggcatagaagtatgcacgtacattgtatcaatgtcaatttcctgcttttgatcttataatttcattatctgtaaccaccgtgggaaactaggtcagtgtgtgtggaacttctctgtactattcttcacaatgttctgtgaatctttaattctttaaaaataaaaaaaattaaaaaacaataggcttactatttggcattagacaaagagataggaaatggtattggaggtgacagtaagacttcaggcatttcagtgccagagccagagagaactcaagaaagaatatatgctggttgaaaggaatcctggagagagttggaaactttttcttttgtaagcactaggatgcaaagaagccccacattggactgtgaaatccctaacagccatgatcatgatgtgatgtatgtgaccactgcacagaacaaataaaaatatttgtggactgaacaaatgaaaaaatgagagtgtcaggtcctagggagtggcttgttggtggcaggcagaaagaaaagctagaaataggctttgagaggaccaagaattacatccagtctcatgcaggtgcctgtccgaagctatcctaagttaaccttctagttttcagaatgtgtggattctagtgtttcaaagtaggagggagaaaaggaaaaggcttaaaacctcagttaatgtcaaagcagtcaatctctggccagacttgtggtgtcaggatcaggattctgtgcgcttaggcatttattctacttttgtaacttcttcatttccttttagattcttggtgaagttccttataaatttttaatttatcatgactatcgtaagtcagaatgacctgcttatgcccagaagaactcagaagacaagcattgaggccaggccatagcagcgggagtttttcaagctagacatcagggaagaatctaagggagatgatgctgttaatgaggtggaccctcctaaagagagatgtcagagaaagctgtgacctctgctttcattccaagaggactggtcatttttatgggccctggatattgctcagtgtgtagatatattagtccaatctgattttcttgggcctgtctgcaatataaaagtacataacaatagagtaaaatacacgtacagtattgctgctctcatccagtagggatcagcatgcaattcagagagaataagagataacaagaatgtctcataaaatagtcaacaacctattcaatgacttcatggagagtaacaaatacttgatttcaaaaccacaaagctgaagtggccacttgagttttaaaactaatgcaaaatgcattaagaatccatcctaaaacatttttgaagtgaagatcaaatctacatattttcagtcaatgcttttgtaactgtcatgtgaactttaggacatcaaacagtcagatatttattgaatacctactgaagcaaagaattttatgtattaggatcatagaaagaagtaattttgctggaggttttaaaaagtgtgtgtgtgtgtgtgtgtgtgtgtgtgagagagagagagagagacagagagaaagggagagagaaagggagagagagaaagagatgttctttccttcaccttagacatctactcccacagccttaaaagttgcatatgacttcagtccatttatttattcattcattctacaaaattgtctccagaactaactatatatcagatattgtgaaaggataaatggctcctaaatgacatgaaagaaagattcaagaagaaaaatacatgtgagcaggtggaggaaaattcaaaccagggaacaggaggctagaggatggaaggataaaaggggaacaacagaaaaatgtaaccatttctggagatacttaacagaaaggggttctgacatcttgaaagaagttgtacaggcaccagcaaacatgaataatccagtgaccatccaaaaggacagtcagctccttagattgggggttaagtcctccttatttccctttcattaacctatgcccagtatagaattttatccatagtaagcattcaataaatattagttcagtgaaggaatgaataaggaaagttggtacttcttttctgagaaacacagaaatgctatgtacaaatctgacacaacacatttaggggtacactgccttcctacagaatctttcaggacttatcaaaaccacaggctgatgcccaagcaagaaagtcaaagaagtgatggaaacatcctggaaccccaaggtccttcactttttctttacaggatttgacttcaaagtctttagagaaattcttcagttttcttccaggttaggtaaagattacaattttcaaaaagaaaactactgtagcccattgttttctgtctttaagtatttggaagactactatgaataatggaaatgtatagtaggtgttaatatacataggattggggctttggagaagctgatcccaccaaaatacaaaagatcctcaaaaagtattatgaacacctgtatgcacataaactagaaaagtctagaggaaatgaataaattcttggaagcacacaatctcctaagtttgagtcaggaagaaattgaaaccctgaccaaaccaatatcagattccaaaattgaataagtaataaaaaaacttcaccaaaaaattccccacaccagatggattcacagttgaatcagatgtacaaaaagatctagtagtaccaattccactgaaaactattccaaaaaatcaaagaggaaggattcctccatcactctgataccaaaacctagcaaggacgcaatgagaaaagaaaactacaggcctgcatttctgatgaacatattcataaatctccaacaaaataccagcaaaccaaatccaagagcacattaaaaagttaattcaccataataaaatagatgtcattcctgggatgcaaagttggttcaacatacacaaatcaatgtgtgattcaccacataaacagaattaaaagcaaaggctatctgataatctcaatagatgcagaaaaatcttttgataaaatccaacatcgcttcatgattaaaaaaaaaaacctgaagaaactaagcatcaaaggaacctacctcaaaataataagagtcaactatgacaaacctgcagccaacatcatactgaatggacaaaaactggaagcattccccttgaaaaatggaacaaggcgggggctggagccaagatggccgaataggaagagctccggtctacagcagaagacgggtgatttctgcatttccatctgaggtatcaggttcatctcactagggagtgccagacagtgggcgcaggtcagtgggtgcgcacaccgtgcgcaagccgaagcagggcaaggcattgcctcactcgggaagcacaaggggtcagggagttccctttcctagtcaaagaaaggggtaacacatggcacttggaaaaatgggtcactctcaccccaacttttctgatgggcttaaaaaatggcacaccaggagattatatcccgcacctggctcggagggtcctacgcccacggagtctcgctgattgctagcacagcactctgagatcaaactgcaaggcggcagcgaggctggggaaggggtgcccgctattgcccaggcttgctgaggtaaacaaagcagccgggaagctcaaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagctggagatctgagaatgggcagactgcctcctcaagtgggtccctgaccccgacccccgagcaggctaactgggaggcacccccaagtaggggcagactgacacctcacacggccaggtactcctctgagacaaaactttcagaggaacgatcagacagcagcatttgcggttcacaaaaatctgctgctctgcagccaccgctgctggtacccaggcaaacagggtctggagtggacctctagcaaactccaacaaacctgcagctgagggtcctgtctgttagaaggaaaactaacagaaaggagatccacaccaaaaacccatctgtacctcaccatcatcaaagaccaaaggtagataaaaccacaaagatgggggaaaaaacagagcagaaaaactggaaactctaaaaagcagagcgcctctcctcctacaaaggaacgcagcttctcaccagcaacagaacaaagctggatggagaatgactttgacgagttgagagaagaaggcttcagacgatcaaactactccgagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactacatgaagaatgcagaagcctcaggagccgatgcaatcaactggaagaaagggtatcagtgatggaagatcaaatgaatgaaatgaagcgagaagggaagtttagagaaaaaagaataaaaagaaacaaacaaagcctccaagaaatgtgggactatgtgaaaagaccaaatctacgtctgattggtgtacctgaaagtgatgcggagaatggaaccaagttggaaaacactctgcaggatattatccaggagaacttccccaattgagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcaggttacccacaaagggaagcccatcagactaacagcgtatctcttggcagaaactctacaagccagaagagagtaggggccaatattcaacattcttaaagaaaagaattttcaacccataatttcatatccagccaaactaagcttcataagtgaaggagaaataaaatactttacagacaagcagatgctgagggattttgtcaccaccaggcctgccctaaaagagctcctgaaggaagcactaaacatggaaaggaacaaccggtaccagccactgcaaaatcatgccaaattgcaaagaccatcaaggctaggaagaaactgcatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacatgcagagtcacacataggctcaaaataaaaggatggaggaagatctaccaagcaaatagaaaacaaaaaaaggcaggggttgcaatcctagtctctgataaaacagactttaaaccaacaaagatcaaaagagacaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtaaacattagacagatcaatgagacagaaagttaacaaggatatccaggaatggaactcagctctgcaccaagcggacataatagacatctacagaactcttcaccccaaatcaacagaatatacatttttttcagcaccacaccacacctattccaaaattgaccacatacttggaagtaaagctctcctcagcaaatgtaaaagatcagaaattataacaaactgtctctcagaccacagtgcaatcaaactagaactcaggattaagaaactcactcaaaaccgctcaactgcatggaaactgaacaacctgctcctgaatgactactgggtacataacgaaatgaaggcagaaataaagatgttctttgaaaccaatgagaacaaagacacaacataccagaatctctggggcacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaatgaaatagagacacaaaatacccttcaaaaaattaatgaatccaggagcttgttttttgaaaagatcaacaaaattgatagaccgctagcaagactaataaagaagaaaagagagaagaatcaaatagacgcaataaaaaatgataaagggaatatcaccactgatcccacagaaatacaaactaccatcagagaatactacaaacacctctacacaaataaactagaaaatctaaaagaaatggataaattcctcgacacatacaccctcccaagactaaaccaggaagaagttgactctctgaatagaccaataacaggctctgaaattgtggcaataatcaatagcttaccaaccaaaaagagtccaggaccagatggactcacagccaaattctaccagaggtacaaggaggaactggtaccattccttctgaaactattccaatcaatagaaaaagagggaatcctccctaactcattttatgaggccagcatcatcctgataccaaagccgggcagagacacaacaaaaaaagagaattttagaccaatattcttgatgaacattgatgcaaaaatcctcaataaaatactggcaaaccaaatccagcagcacatcaaaaaaagcttatccaccatggtcaagtgggcttcatccttgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctcttatcactcctattcaacatagtgttggaagttctggccagggcaattaggcaggagaaggaaataaagggtattcaactaggaaaagaggaagtcaaattgtccctgtttgcagatgacatgatggtatatctagaaaaccccattgtctcagcccaaaatctccttaagctgataagcaacttcagcaaagtcttaggatacaaaatcaatgtacaaaaatcacaagcattcttatacaccaacaacagacaaacagagagccaaatcacgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacatcccatgctcgtgggtaggaagaatcaatatcatgaaaatggccatactgcccaaggtaatttatagattcaatgccatccccatcaagctacccatgactttctttacagaattggaaaaaactactttaaagttcatatggaaccaaaaaagagcctgcatcgccaagtcaatcctaagccaaaagaacaaagctggaggcatcacgctacgtgactgcaaactatactgcaaggctacagtaaccaaaacagcatggtactggtaccaaaacagagatatagatcaatggaacagaacagagccctcagaaataacaccgcatatctacaactatctgatctttgacaaacatgagaaaaacaagcaatgggaaaaggattccctatttaataaatggtgctgggaaaactggctagccatatgtagaaagctgaaactggatcccttccttacaccttatacaaaaagtaattcaagatggattaaagacttaaacgttagacctacaaccataaaaaccctagaagaaaacctgggcattaccattcaggacataggcatgggcaaggacttcatgtctaaaacatcaaagcaatggcaacgaaagccaaaattgacaaatgggatctaattaaactaaagagcttctgcacagcaaaagaaactaccatcagaatgaacaagcaacctacaaaatgggagaaaattttcccaaccgactcatctggcaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatggaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactggtgatgggactgtaaactagttcaacccttgtggaagtcagtgtggcgattcctcagggatctagaactagaaataccatttgacccagccatcccattactgggtatacacccaaaggactataaatcatgctgctataaagacacatgcacacgtatgtttattccggcgctattcacaatagcaaagatttggaaccaacccaaatgtccaacaatgatagactggattaagaaaatgtggcacatatacaccttggaatactatgcagccataaaaaatgatgagttcatgtcctttgtagggacatggatgaaattggaaatcatcattctcagtaaactattgcaagaacaaaaaaccaaacaccacctattctcactcataggtgggaattggacaatgagaacacatggacacaggaaagggatcatcatactctggggactgttgcggggtggggggaggggggagggatacctttaggagatatacctaatgctaaatgacgagttaatgggtgcagcacaccagcatggcacatgtatacatatgtaactaacctgcacattgtgcacatataccctaaaacttaaagtataataataataaaataaaaataaataaataaataaataaataaataaaatttgttgaataaaatatttatctcattgttaaaaaaaaaatggaacaaggcaaggatgctcactctcactactcctgcttaacatagtaatggaagtgctaatcagagcagttgggcaagagaaacaaatacaaaccatccaagtaggaaaagaaggtaaactatctcttctcatgaatgatgtgattatatacgtagaaatccctaaagattatgccaaaagtctcctaaaaatgataaacaactctagtaaagtttcaggatacaaaatcaattacaaaaatcagtagcatttttatacaccaataacattcaaactgagagtcaaatcacgaacgcaatctcatttgcaatagctagaaataaataaaatacttaggaatacatttaaccaaggaggtgaaaaatctctacaaaaagaactacaaaacaccactgaaagaaattgtacatgacccaaacatgtggaaaagcattccattctcatggattggaagaaacaatatcattaaaatgtccatactgcccaaagcaatctgcagattcaacactattcctatcatgctaccaatgtcatttttcacaaaactagaaaaaactattttcaaattcatatggaaccaagaaagagcctgaatagctaaagtgatcataagcaaaaagaacaaagtcggaagcatcacattacctgacttcaaactatactcaaaggctatggtaaccaaaacagcaatgtactggtacaaaaacaggcacatacaccaatgaaacaatatgtagaactcagaaataaagtcacacacctacagccatctgattttggacaaagtcaacaaaaataagcaatggggagatgactccctattcggttaattgtgctggagaggctggctagccatatgcaaaagaatgaaactggacccctacctttcactatatacaaaaattaagatgaattaaagatttaaatgtaagacttcaaactataagaattctagaagaaaacctaggaaacaccattctggatatcagccttagaaaagaatttacaactaagtcctcaaaagcaattgtaacaaaagtgaaaattgtcatgtgggacctaattgaactaaacagcttctgcacagcaaaagaaactatcaacagagtaaacagacaacctacagaatgggagaaaatattggcaaaccatgaatctgagaaacatctgtcatccagaatcgatatggaatttaaacaattgagcaagcaaaaagcaaatgaccctattaaaaaattggcaaaagtcatgaacagacacttctcaaaagaaaacatataaatggccaacaaacgtgaaaaaatgctcaatatcactaatcatcagagaaatgcaaatcaaaaccacaatgagataccagctcacatcagtcagcatggctgttattaaaaagtcaaaaaacaatagatgctggcaaggctatggagaaagggaaacacttacacactgttggtaggaatgtaaattagttcagccattgtggaaagcagtttggtgatttctcaaagaacttaaaacagaagtaccactcaacccagaaatcccattactgagtatatatcaaaaattctaccaaaaagacacacacattcacatgttcattgcagctctattcacaatagcaaagacatgaaatcgacctcggtgcccatcagcagtggattcgataaagaaaatgtggcacatttacaccatagaatcttacaagactgtaacaaagaatgaaatcatgtcttttgtagcaacatggatgcagctggaggctattatcctaagcagattaactcaggaacagaaaaccaaatgccacatgttctcactaaacactgggtattcacgaacataaagacagcaacaatagacactggagacttctagagggagagtcaggggagcaagggttgaaaaactattgggtactatgctcagtacctaggtgataggatcaattgtactctaaacctcagcatcatgcaatatatccaggtaacaaacctgcacatgtacccctgaatctaaagtcaaagttaaaattatgaaaataaaaaataaagtctttagcttaaaaaaatgaaaaaaaaaattctaaatatttcttgccttttctatatctttagcttttatatattttctggaagattgtattgactttatcttccatcttcaacatactttttagaaatttcagcaattatgttattcatttattttataaagctctttcttgttctttgttcattttcatggtctcctttttctatcaattaaataacattttaatctttcaaaatactttttttattattgtgcatttatttggatctctctgcttcatgatatacacttttaaaaaatacctggtgatatgtggtaaaaagaggtaaaaaagagaaagaaaaataaaaccagactgggagacttaggtaaattatcttctaggtagagggataattttttattcattattatgattttccctgaaaataattccaaccacagtcatcactggtcactggcttgtggcaatcgggcctcagtgggattttacctggaatgagagagtcccatttctgtgcaaatttttacttcctttcattgattctattaatgcctcatttaccaatgatcattagataattatactatttcaaaaatagccttgcttgctaaagagggactaaaagtgttttcacagtaagattagcttattttgcagagataatccaccttgtagtagtcatggaaaataaatgtaatgttagcggtgccagttgctttttttctgtattgtgaaactgaatcatcaattttgaataatgaaactttaagctacataagaaatatcaagcttgttcattcatgttcaaaacttacaaccaaatacctttgtttcctcttcacatttgctccctaattatatcactggcctctccaggtgtatgttttaactcctggtttctccaaaatggatatctgacattttctaaaaccctctatgaaggggcattcctgtggggatatatgttttttgtgactctagggccgtatgagaagagaaggcatttggggatccctagacgctgattctactccctctcatgaagatgagatgtcaccttgatgatgctgagtttgttttacaaattggctcttttggttagcattctagctgaataaaagggcctactcaaactgggcaatttgaggaaagtgtaataaagggaatatttttaaattcatgggcatagggataagaaaaccaacaaacgatagtgtaggtctccacatctagcaacagtggggacccataaccatcattagacctgaaagtgcaagaggagggcacagagacaggatctatattaagagggcagcctgacagcaacagctttccataaaaggaagcagccaatccatggtgatcctgtagagaggcagccagggaagtaaaatatcccagcctgattcttctttcatctttccgtctcagccagtgtctctcattggctgaagccaaccagaagccaggcaatgaagcctgttgacagagttcatacaggtcagtttcctggagtgcagagaagggtggggaaggccagagtggatttgagacagacgatggaaaatattcagcacaccatgaaaagctcatgcctgtaaacaatttcttaaacagagtagttggtgtcacttcttccagaatgataatgtaagtccatgaattcagaaggaagtagtatagtgagatctggattatttctcaattctggaggactacctgcatggagaatgacataggcagtttcatattctgtagaaaacccaggtatgaccggaaagccatgtgaagatatattacatctgctcatactctgcacggtcacctcattctatatacttggtaaaattattgaaaacttttatcctaagtgtatatatgtctgtctgtgtatttagttttttcttcccattaattcacaatgtacctgaaacactataccttcatatttctcaaacacataaatatttcacggtacacatatacttattctttaaccatagaaatagataccactggctgggcgcggtggctcacgcctgtaatcccagcactttgggaggccaaggcaggtggatcacgaggtcaggagatcgagaccatcctggctaacacagtgaaaccccgtctctactaaaaatacaaaaaattagccgggcgtggtggcgggcgcctgtagtcccagctactcgggaggctgaggcaggagaatggcatgaacccgggaggcggagcttgcagtgagccgagatcacgccactgcactccagcctgggcgacagagcgagactgtgtctcaaaaaaaaaaaaagaaaaaagaaaagaaatagataccacttaattctgctaaagattatactttatgaaacacggtggagtatgattcatttgattactgttgacactagtatttaatttccataattaacatccatactcattgataatgttaataaaagcatcctaagtgtctttggatggagagggaaccctgggtagtggccaagtgaaggtaggagagacagctgggagtaaaagaaacggatgaaaaaagggaaagtatttgaagtagagtgctgaatttctattgctgcagagtaaatcctgacatggctgcattaacttgggataaggattgttagccagaaacagatctaggttttgtgggacctgaagatgatacaatttgaaggatcctctttaagaaaaacaattcaaacttataaatgtgaagttctatatgaaagtaaaatgtcttgagaaattgcatcgaataaattttaagaaattaacatcacaaacctcaaagaatcttgaaacacaacataatattactataaattagctgccttacatatctctataatacttttctttttatattttggctgtgtactcctttatttcctcttcatatgcaacctttttataataccattttctataaagagaatagaaggtaattcagtctttcctctagtgtgtttttgttcctctatctttatatttcccatgctggacactatagtttgtgttcttatttcataaaaactttggcccttcattggcatagtagttctgggttagttggcacaatggatggcagaagtatttctggaacccattcttacccttgattggctaacaatagcttaactctacgcagtgactgtctcccgcataaatatatctcgctaactccaaattaaaattaagcccaactcaagttccctctgaaatgtctgtgcccactccattgctacctgacatgagtagaaatgtgacagaatggaaaattgtcataaaaatagtcagtggttttagcagagcatgattaaactatcttattttgccattattccaaaatacataatgttaatacattgcttatgcctcttctatggccttggaaaggaactgtgtgagttttacttgcttcatgataaatccaactttaggtaattgaaataaactgcacagtgcttcaccttcctcctgtggaggtgacaagaggaggattcagtgtggagtcaattctgctgcttctcccatagagtgaaggtagaattgggaaattaaagttctcatttttgcccattcatcactcatcctggcagggggcagggcatggggtttggcggggaggaatgcttgtaatactagctatgataacttattcatgtattcaatcattcaacatgtatttgatgattatgtgccaggcactatttgagataatagtgtcattcctatcacaatggtgagtaaaacagatgcaatctctgtcttcagtgatcttaaagtctaaaggaggacagacaacttacctttccatctttgagtaaaacaaatatgtgaaaagtaatagaataatttgtcttaccatcctgtccatatcttggcacaaagcactggtaatcccagaaaaataattctctaaagtcccattcatggccttggtatctgtggtctctttctgttcctaaaacatggcagaaagggaaggcaagaactccaaattggagtggagagtgtagaacctgagaaatcaacccatctccaagtttttgttctttgcagtcttgtgcttcattggattgtggacaatatagaaggggtataatttcctatattcaaccaatcagtgataaaagattaagagaataggtaccacatgaagcttctcttcttctagtctctcatgtcattcctatcacagtggctgtaaaacatttgttggcaatgtgaaggcttccgttattgaatagagaggaagataaaagatttccctctatgttcattcttgccacagactttcagaaaactatctaatttcttagcacctcagctgcataccagtgaaatgaggtcaactatacaaattccttacttatctaattgggatacaaactgctgcaagaattacagctgtgaagtagtgggttccagaggacttgtctgcggttacagaaaataggcagaactccgtgggccctcaagaaagaataaccatacaaagttgtacatacctaaagaggaataatttttttttaaagaaaatccttaggcagaaagggtttttaatcaacattgaatgttgaatcaatactaaaatcagtactctctatggccaaaccatgcatactgctctcattggtctctgattgacctttttgtcttgagatataccttcacaggaatgtcagtattctggaaatggtgatgggaattctactcccaggtaaaaactcaatgaggtaatgaatatgcaaatgacctattgtatccaccatgcacattacatttcttaaagtctgttaagctctccctaggccaagccatgtgatctttggatgagtcaaagctcaggaaaaaaacactgagtttgaatcctcgctctgcaactttctgggttcctgtgaccttgggcaagttatctaacagctgtgaacttgagtttccttggcctatgaaataaggatagcaataactcttgcagaattgcttaattatttaaaaaatttatactcatataaagcatgtgctataaagcaggtgctcaatgaattgtaagtattactaattataaacttcagcacaagaataagctttttaaaattattttttctttccagtatttaaactttgggctgggagagattttatcgtaagattattatgatgtgtaaacatgaaccaacttctctatagcaattattttgctgggaagtaaacaaggtcataaatcaataatgactcttgcaacctcaggacttattgatcttgctgtttgtcttctgtaatgttcctggaaaacccaattattttgggaagttatccaaactagtttacccagtattctatattagtgttattagtaacaagttatgaaagcgtttgattgattttcttggaaaacaatccctttatagtataatagagatatttattcaataaatgtcttagcatattacatttcttaaaaagaacaagttgagacaagcagctagagattctagaatcatgtgcttcttttaaattccacttttctgggcaccatggtcgagagtgcaaataagcactttaggaaaaattctagagatatgtgagtcctgtctatcttatggggctggccattggcagtaatttaaagtagaagtatcttttaatatgtctggtgttgttctccaatactcagtatagtgcttggtgtggagtaaatgcccagtaaatgttggttagatgaatgaataaatgagtgaatgaaagtataagcaaataaatcacaaatacataagtacttacccactgtaaatgcttgcgaaggtggctctactttccttctcagtacaaatgttttcttggatttatagtgatgtctaaaaggcctatttcattaacactgaactctattggcaaattcaactgcctctctgttccctttttcaatttagtctgtttgataagaagtagtcactaagatgcataagacttttctttatgatggtgaggtggcttgaatttgagcctaatatttggaaggccaaagggaactatttattaaaacaaaatggagtacagaagaagttaatggttccccaaatttgtctgatggaagaatcacttgatgtacttgttaaaaatacgaattcttaggtgtcagccaagaatctccaaaagcaatataccaagtgcttcttatgaccaggcaggttgggcaaagactgggatagggtatgactgttaccttgctatcagaagaccaatggagcttgcttgaggtaacaattttccttaacttctgttttctcagacttaatatagggatatcagtatctccccagaccacatcaaagcgattctaggagaatcgtaagaggattaattttcaaacctttatactgtatgcaaacttttgaaatctatcctgaagatagtaacaaacccatcagaattgcaatgtttctgtgagaagacaccttcatagtttgacaaatccttgtttggcaacctctcatgtgacctttccaaaatcactatggccaacccacactaactaggagctcccagcctaccttgtttgtcactatttccctggaaatgagctactatatttgtgcaataaataaatatttaaatgtagcaaaatatgtgtctttgccaaaggaaaacaagaacctagtctattagcaggttactattagaaattaatcatttatatttggctgattttcttgtctagactaatattctgtcattagcaaatgctcctacaggtatattgagaagaaaataaaaataacaaaaacagttgtcactacattaataaccattgtaatattaatacctttttaactcagtatgtgtccgggcattttcactagaattgggaatttgcattactggaataagacttctgcaatgtaaaaatgaaggtgataaatgtaatgttaacctagccaagaaagtacgcttggtcccttcatggttattgcctaataagatccaggcatgaagaaagattttccctttattttaacaataaaaattattattaataaaaatatgagaaaagctttgagctaagtgttttatatgctgtatttctcttaaacttcatgacatccttctggagcaagtattattattatcatcatcattttacaaatgaggacattgaggctaaaaaagttataacttgccagaggtcttgcagctaaatgacaaagtcagaatatgtattcatctctgtaaaactccagaagccaaattcttaattaccatcatttattgatttttaaccaaaaacaaatagaaacttaatagttcatattcctggtttttaagataatgtatcttcatttatttatatttcctgcctgattttctttaagatctcaagaaattggtaatggtacaattaccaattgctttaggctaaaactattttttatttaaatagccatttctaattattgttattaataaacaactatatatttatatatgtatatgtattaatatatgtatatttgtgtctgtgtatataaatatgtattcatattgtataaatatgtattcataatgatgtgaaaacaaaaaactcaaattgtaacatctgttatcttcattctgaagcctttcttcttctgggtcttcctagtttaaatatctatcctagttgctgctaggtactagtagttggtgaatgatcctaggtttgtgctcagatttgactgaacagctttctcaagagattacaaggtgactttatccgggtttaaatttcaatgttgatgcatgttggattttctggaagcataggggagatagaatttggcataagaagtatttattagggagagggaggaagcaggattaggcagagggagacgttgaacagcaaagcagacttggcaaagccttggcagaccccacagggggcttaggggaccatagggccaatcggggttgcctgatttagcaaataaaatacaggacacccagttaaatcaaatttttgataaaatcacaaatcactttttagtatgtgtatgtcccatgcaatatttatcccatgcaatattttgtctggcaaacctactcccattggaccaaaatgtctgggtgtttatatcccaattttgatcagtcattggatgtagccaaggccaggaaagatacaaccttgggagaggtggctttttgcagtggaggcagaccctgaaggagctgagagctaggcaacaaacccttccacaaaaggagatctgggaggcatgtgtctgtgttcaccactaatttatagccacgggaagtctcaaggcaactgaaagctccagaaaaagggttttaatgaagggattttagcagctctgaattttgctgcttagtggtggatttgcattgatactacagaggatttacctaacgagaaagctcttctcagtcaagtgtataagcagtgagactggacacatatccatggaagaaatatgacaaccgaaaagtttggagcagggccagctttatgggtgtgtgaccaatgcagtcacacagggcctgggctcggaagggccctgaacttgatttaatgctttgatgactctgtcttgaagttattggtaattttatctcttttattttgttagtgaattctgatggacaaaggaacatgcatgtgagcagggaagaagcacgcacgatatgtgtgtgtctgccattgctggtgtccctgttcacatgtagttttcatgatggcacatgagtccccgattcctgtggattagctatccatgggagttcagtgagactcagagtgaatacaagataagcaggctacatttacgaacaataggccaggacactgacagccccaggaggccatgttttctatttgaattagagctttccttgaatgcagaaggaaggacattgtattctaagaaatacaaatcaccaggaaaatctactatattctttcttattcacattatattctggtattagccaaccacttatgctgaaaatgatgacaaagaaggaaatgatgagcaacccatagttattttttcttttctctcagacctttctaactcactagtaagctgagggtagagagtgctggtagaatgtgtgtgtgtatgaagaagtgaaataaaaacagttaagttcatttttccagtgtttctactgttctggtaagaataaaatacatatgcatgtatgaactatgaaatatatattgggtgtttttagtgataccacatatgaattaaatgttcttatatttgcagttaaaactagcattgtacaatataaaagtgaacagtaaaattcatgcaatagtttaaaatttgaatttttctttgcttagaatcacattaaatggctgataaaaaatcttagcaaatcaagaaagaaactgcagaagaaaggaaaaggctttatcttttagtatctttatagacactttttgaacaggaggccctcattttcattttgtactggggctcaaaaattatgcagcttttaggtcagacaaataggattagcaagtataaatggagtggagtgaggcgaggattctgaaaaacagttttaggagagattctggtcttccaggatcatgactgtggatggatggacttgcactacttctaacaatttgttatttgtatcttgtgacctaacatgccagcaataaagaatgctctttattctgtgatcaattatcaaatatttattgagtctgtatggatatagcaacgtattaggatatatgaaagggaaaaactggtggtgagttacagggacaataaatatcagctaccctcaaggagcttgcattcaaataattgacttttctaattatttctagattccaatatgtacctacatcatagtgcttgtgcacataaacacatacaaacacacacccctgacattttccttctttccctcttaaccatattttgttccctttctctttcagctctctggacattgctaggatggtgatgatgacgataatagtgaacattattataagtactttacacatattaatccagttaatccacataatagtcctgtgagatctgtgccattttagtctccttattataaatgaagaaactgaagcccagaaaggttaagtaatgtgtgccccaaatcaaagagctagaaagtagatgagccagagtttgaaccaatatggtctccactatactaaactatgaaatttcctcaaaattttaggcaatagtgaccttgagcagtggtcttcaaatttacatatgtttattgcagcaggagagaggtactaaaaattccagcaaagttttaggaaattattatttccagatcctcagcctcattgagctcctttttaagtaagtggtctgccaagaacaaacctgaagttgaggctggttccctttcccacctcccctttcgcaatacccattatcccttcttagagaaaaaaggccctcatgctaaatgttattatagctcattgtccttgggtataacaacctcccctctgagtaccaactgaagggtaatttaaagtactggtaataaagttgagaaagtgaatgacttttaagactgtgtaacagtatcatttataatgcaggagtttcaaattctttattatcaataaattaaaggacataaacagagtactagctgataggttattaaaaataatttttgatgataaaacactatgtgaattttgttgtcatataacttagaatgagtttaagaactaggtgatggttttatgacaaatccattctcattcttttatttaagtgacaagttttctcagggtttatgtttatagaaacagatcagagaaagtgagttcttgttgaattatttcattctaagaataagtaccattcattcagagatacataaattaattgtataaatgtaatgccatccattcattaaaaagcacatttctgttaagattgtacttttgtttaacatattaaaaaaaactcaacatccctgatcattagagaaatgtaaatcaaaacaacaatgagataccatctcctgccagttagaatggctattattgaaaactcaagaaactacagatgctggcaaggctgtaaggctgtggaaaaatagcagcaattttacactgttggtgggaatgtaaattagttcaaccattgtggaagacagtgtggtgattcctcaaagatctagaaacagaaataccatttgacccagcaatcccattactgggtatatacccaaaggaatataaatcagtctattataaacatatgtgcatgcgtatgttcattgcagcactatttacaatagcaaagacatggaatcaacccgaatgcccatcagtgatagagtggataaagaaaatatggtacatatacaccacggaatactatgcagccataaaacgaaacgagatcatgacctttatagggacgtggatgaggctggaagccattatcctcagcaaactaatgcaggaacagaaaaccaaacattgcatattctaacttataagtgggagctgaacaatatgaacacatgggcacagggaggggaataaaacatactggggcctgtcaggggatgggggaagggagaacatcaggataaatagctaatgcatactgggcttaaattttctttaataattgtttatcaaaatctgtaatgtatttgttgtttctgatcattatttctaacaacaattgtaatgacaattcaaccctgaagaaaattttaatatgtaatgttgtttgatcaaatgaagtttttaaaaaatagatttcaatttaaatatgtatatttactgcatagaaaaaataggttattaaaagattttgaaaggtaaaatatggaaatagtataaaatttctgacagttaaaaaagagcttgttcacataatgatttttcaaataaatgatgagtaacactatagtaacagaatcgaatggatacctttaagaatgatgtgacagttcgtttaaaaatgtccaaatgtaaaagatattcttcatacttgcttaacattataatgaaacaatttaaaggtcaacttaaaaatatataaaggggtatttagtttaatgcaactttttataggtatactaacataaaagttcgaagacctcatgacctggggaaattatcttgtaacctaagtatgttatgttcaattcatctccattacagactacacactccttcagctctttttaatgcccaaagcattctttgaagtgatgaaagtcttgtgccaagaagaaagaaagtattagagaaaggggtgatagaaacccatcaattgtagtgtctccagaggggctgtttaaatgagcaatcaattttattcttctcttcatcgtgttcaggaaactttcagccttcttacttatttaatttgaaaattgcatctctcataattacttttggacatacatacagcattgataagtaaaaaagtatttaccttataacttcccactggtatagccctagggaaaaacaagaataagattttataagtgagaaaattaaacaggacaattgttttcaccttggaaatggaaagcaagatgaccaatagaggtgtaaccaagatagaatgaggaagcgaatcctttctgactagttgtgtgtgcctaaagttacttatttaacctctctgagacttagtttcttcaaatagggaacgaagtaatacctgtcttagaagtttctgtcaggtatgaatgagattaaatgtgaagagcttggcaaagtgtccaatatttttaaaatgttagaaatctgtggagttggctagggaaggaaagaaagaaatttcttgaaaaaaaagtaaggtcaggaattcactttaatatatcagcggtttcctattctaagtaatgccctttaaaggctatatgattatttcagagataatagtcattgctaagatatttttgtaatttctccttggggattgtcttccaaacagtagtttagaatatcctctcttaaaggtttaaaagaggatattctaaacttttaagaaacttttttagttagttgtagatttgtatgcagtcataagatagaatacagaaagatcctgtgtacctcctcccctaataacatgttccaaaactataatacaatatcacaacgagagagatgcaatccactggtctaattcagatatccccggtattatttgtgttcatgtgtggatatttgctagatgaaacctttcataattttcagttatcaggccctgccttcctaatgagaatctggatcagaatttgaggacccctaaaaaggaaaacagatgaaaatccagcaaaatcttacttcttggtaaaatgatgttattacaaagttgagaaaatcttcttcataaaatacgaaaaccacaaagctggaaagggaatgtttgatataatagagtatatcaaaactaaaactttctatacaagaaaataaaccattaacgaagtttaaatacaacatagaagctgggtgaaaatatttgctacagatataaaagacaaagctttagtattaagaatagacagaacgattctgtgaataaatatgaacaaaaacacaatagaaaaatggggactatatgctaacaattcatagaaacaggttcttttctctcagggtgttaaagccattattctactgtcttctggcctccatggtttttggtaaacaaacaaaacagacaaacaaaataaaataaaaaacccgaataagttttttctgttgtttttatttattttgtttttttaattttttatttccataggtttttgggaaataggtggtgtttggttacatgactaagttcttcagtgatgatttatgagattttggtgtacccatcacccaaacagtatacactatatccagtttgtagtctcttatccctcaccctcctcccacccttttccccaagtccccaaagtccattgtaccattcttatgcctttgtgtcctcatatcttagctctcacttatgagtgagaaaatacgatgtttggttttccattcctgagttacttcacttagaataacggtctccaattccatccaggttgttgctaataccattattttgtttctttttatggctgaatagtattccatggggtatttgtgtgtgtgtgtgtgtgtgtgtgtgtgtgtgtgtgtatgtatatagttggtagtattttgttaaagacttatgtgtctatattcatcagggatatcagtttgtagttttcttttttgttctgtcctttcctggttttggcattagggtgatgctgggttcatggaataatttaagatggattccctctttctccgtattgtggaatcatgtcaataggattggtatcaattcttcttggaatgtctaatataattcaggtgcgaattgtgtggtcctggacttttttttggtggcaagttttcattaccatttcaatcttgctgcttgttattggtctgttcagggcttctaattcttcctggtttaagctaggagggtcgtatctttccaggaccttatccatctcctccaggttttttagtttatgtgtgtaaagctgttcatagtagccttgaatgatcttttgtatttctgtggtgttggttgtaatatattccatttgatttctaattgagcttatttggattttctctcttcttttcttggttaatctcactaatggtctatcaattttatttatcttttcaaagaaccggctttgtgtttcatttatcttttgtatttttttgtttcaatctcatttagttctgctctgatcttggttatttcttttcttctgctgggtttgggtttgatttgttcttctttctctgtttccttgaggtgtgaccttagattgtctacttgtgctctttcagtctttttgatgtaggcatttagggccatgaactttcctcttagcaccacctttgctgtatcccacagattttggtaagttgtgtcactattattgtttggttcaaagaattttttaatttccatcttgatttcattgttgacccagtgatcattaaggaacagattatttaatttccattatttgcatggttttgaagtttccttttggagttgatttccaattttattccactgtgatcagagagaacacttgatagaattttaattttcttaaatttattgagaattgttttgtggcctatcatatagaatagcttgaggaatattctatgcgctgatgaatagaatgtatattctgcagatgttgggtagaatgttccataaatatctgtttgttaagtccatttgttctagggtatagtttaaatccattgtttctttgttgactttctgtcttgatggcctgtctagtgctgtcgatagagtattgaagtcccccactgttattgtgctgctatcatctcatttcttaggtttagtagtaattgttttgtaaatttgggagctccagtgttaggtgcatatatatttagggttatgatactttcctgttggatgaagtcttttatcattatataatgtccctctttgtctttttaaactgctgttgctttaaaagcttgttttgttcaatatatgaataactactcttgctctcttttggtgtccatttgcatgtaatgtctttttccacctctttaccttaggtttatgtaagtccttttgcgttaggtgagtcttgtaaagacagcagaaacgtgattggtgaattcttatccattctgccattctgtatcttttaagtggagcatttaagccatttacattcaatgttagcattgagatgtgaggtactattctattcatcatgctatttgttgaataccttggtgtgttttttttttttgtttttttaaatttactgtgttgttgttttataggtcctgtgagatttatgctttaagggggttcagttttgatatagtttgaggatttatttcaagatttacagctccttttagcagttcttgtagtgctggcttggtagtggtgttttctttcaacatttatttgcctgaaaaagactatttttccttcatttatgaagcttagtttttctgggtagaaaattattggatgataatttttttttttatggaggctagagatagggccccaatcccttttaacttgtagggtttctgctgaaaaatctgctattaatctgttaagtttttagttataggttacctggtgcttttgcctcacaggtcttagtattccttcctttgttttgactttagataacctgatgactatgtgcctcggcaatgatctttttgtgatgaatttcccaggtgctctttgagcttcttgaatttggatatctatatctctagcaaggctggggaagttttcctcaattattccctaaaatatgttttccaaacttttagatttctcttcttcctcaggaatgccaagtattcatagatttggtcatttaacacaatcgcaaacttcttggaggctttgttcatttttttaaaattcttttttctttgtctttgttggattgggttatttcaaaaaccttgtcttcgagctgtaaagttctttcttcttgttcgattctattgctgaggctttccagtgcattttccatttctgcaactgtgtccttgatttccagaagttgtgattgtttttcatttatgctatctatttcattgaagatttcacccttcatatcttgtatcttttttttaatttcattaaatcagacctcacctttctctggtgcctccttgattatcttaataataatcaatcttctgaattctttttctgtaaaatcagggatttctttttcatttggatttattgctggagagctactgtcattttttgagggtaataaacttgctttgtcatattaccagaattgtttttctggttccttctcatttgggtaggctatgtcagagggaagacctggggctcaagagctgctgttcagattattttgtcccatggggtgctcccttgatgtagtactccctcccttttcctagggatgtggcttcctgcaaggtgaactgtagtaattgtttttttctcttctaaatctagccacctagcgggactatcaggttccaggttggtaggcatctgcacagactggtgtgtctgcacagagtcctgtgatgtgacccatcttcaggtctctcagctgtggatagcagcacctggcctggtggaggtgttaggggagtaaaatggacactgtgagggtctttagttgtatcattgttgtttattacactagttttgtgctggttgacatcctgccaggaggtggcgctttcaagaaagcatcagctgtgatagtatagggaggatcagatggtgggtggggccctagaactcccaagacaatatgacctttgtcttcagctaccagggtgggtagagaaagacaatcaggtgggggcagggttaggtgtgtctgagctcagattcttcttgggtggggcttgccctagctgctttgggggatggggttgtggttcccaagtcaatgaagttatgttcccaggaggattatggcttcctctgctgtgtcatgcaggttgccagggaagtggggaaagccagcagtacaggcctcacctagctcccttggaatacaaaaggctggtctcattcccaccatgcccccgccaccaacagcacaaagtttgtttgcaggcagtgggtgagcaggaagcaagcagggcttcagatttcacacctccccacctgcccatgtttgcactccagatttacccccttcctcgagttctgtctaggaaactctgcatttggttggaattcttaacaaagttgagctggagatttctttctccctgtgatcttttcccagttcctctggcagcccttccaaaggaccactgtgatataaaatcaaaaatgacttccctggggacccagagagcccacaggaatcttcccactgcttcctctactcctgtattttgcttggctctctaaattatctcagccccaggtaaggtcgaatttttcttttgtgatctggaccttcagattccccagtgagggtgtgtgttcggaggcagacaatccccctttcccactttcacacttgggcactcacagtatttgggctgtctcccaggtcctgcaggagcaatccacttccttcaaagtagctgtggattctcttggctttcctggtatgtgcctgtaatagtttttggagcaaaagttcacaatgtgaatttccacaccctgctctgttcatttgagtgggagctgcaatttagtcctgcctcctgtctgcctttttcccctgcataagtcatttaaatctttgttcccctgtatgtcatttttctctagctactttcaagaatttttctttactttcattttcaaaagtttgattatggtgtgtctaggcatattcctatttgaatttgttttgtttggggtctgatgagcttcttaaatctacaaatgtctgtattttactaaatttgggaaaatttgtctcattatttattcatatagttgttgcatgtcaattgttttttgcttttattctggtactcccaatgacatatatgtcatgctatttggtattattctacaaataccagaagctctgttcaatattcattatttttttctctgttcctgagattgtatattttctattgctctatctttaaattaattgactcttccctgtcatatccattgtactactgaatccccatccaatgattttaaaatttcaggtattatagttttcaattctagaaggtctatttaattatattttatagcttatatttctgttgagaactttttcttcctatatacttcaaatatatttacctttacctcatggaacacagttaaaatatctggttgaaaattaatttttccccaatatttaggtcatctggtgattggcatctgatggtcatcatttttcttaagaattgatcacatttcctctggttctttgtatgttgggtaattttaaattgtattacgtacatgtgttctggtatacagactctgagccctgttatagtgttctgaagggttattttatttttgtttgttttgtatattaacccagttaggttcaaattgcagtttctgtgttacctgctacgtggtttcaatctcagttcagtcttctagctaggcctttgctgttctggttttggttgggtgcacacatgcatagcccaagaatgatcctaagattatgtgggtttatatacagaattaggaaatccctttctttgcttctcttctctccagggttctccttacactctataaccccaatgttctctttcctgatttctctagccagtaagatgagctttctatgggaatagtctacactattttatagttttaaaaacagcctactctcagggcaattctgtaagataaaagttatttttaaaactccgaaattcaaacccttgtgggttatttctctaaatttacttccctccacaatctgcctgccattatttattctttgaagtcctcaggtagttggttttctctgtgttttgtccagtttttagttgtaatcagcaggattttgacatagcaagacaaaacagacctcatttgtctttttttaaaaatcataatcatgttaaagtatttgtcaaactgtcccataatatgatatttgctaattatcaattatgttggttctctttattgctaaaagttttcctcagtattttggaattttgttttgtaaactcattatgagagagtagttttagttatctgtctttttctctctctcatttgattgatggaatctataacttaaagtctatgaactattcaatgaacattcacataagtgtagtacttctatactattaccaatagtaatattagctaacatttgtatatcttttactatctaccaggttctagttgaaatgctttacatcaaatttttgcattttagagtaatgttttatatatctgcaaaatattgtgctgggattttgatagaaattgcattaatctatagatcatttgggaaaactggcatctttactatgttcagtgtttagtgaacacagtatgtctcatcatttatttagatcacctttgatttgtttcaacagaattttatacttgccattgtacaagttctgcacattttttgctagatttatacctgagtatttcagtttttgagtgattataaataatgtcatgttttatcttttggtttccatgtgttaattgctagtatataaaaatacaattaattttggttatttgtaccttgtgaatgtgctgacctcagttatttgtaaaagttatttgggggagcatttttttttgttatgttttttgggattttcaatatagaccatcatgtcatctgcaaatagggatggttttatttctttcttttcaatgtatatgccttttattttattttcttgctttattccactggctagaacttccagtactatgttaagtaagagtggtgtttcaaggtatccttatttagttcctgatcttagggcaaaagcattcaatctttgattattaagtattgtggtggctggagggtttttgtagatgaactttatcaagtcgaagaagttctcctttatttctagtttgctcagtttttgtcatgagtggctgttaaatattgtcacatcctttttgccttgattgatatgatcatgtgatttttctacccattttaaaacacaatggtacatgaacatccaaatttggtgaagataaattagagaaaaatcatttgtttgaccaaacaattgaattctttagtaaaaaagtcttctagggcatttaaaatttgatgtttttattttatcctttttagcagcatatcgactatataaatccagctatacttattcattattactgcctacattttctggaattttctagaacatgtagaattttctagaacatgacttacaaaaggattttggattgcttctgaatgtaaaaacccatcacagatatataatttggagatcaaaattttgaacattgaaatgggttatggatttgccagaatagaatatttgaaataaaaccactccagaaaaatctatgacttatagggacatcattactaggacccacaagaaccaaatgacagacactaaggagtagctcttattctcactgcctttttatgaagattctgcctactcttgtggtatattaggttacccactggaaatggttgctacttgccctgcagtctgtaatgcaaccacatttttctttttaacatccaggctagaactagttctatcaatacaatgttagaactgagttttggcttttttttcttctgtatcctttttttttccttttctttttttaggttgagtgagtttctacttttcaggttagggtgataaataacccatgttcacaaaatagggcatagaaagcaatgccataatagttttgtgtcttataattcacctaaaatttacaacatatgaatgttttgtctttctagtgtaaatagacagcatatctctagacctgtggttatcaaaagagcgtgtgttagaatcaccggacagacttatgaacaaacgaaatgctgggccccatctccagtgttctgactctgtaggtctggagtggggctgaagatttgcctttccaacgagttccaagtgatgctgaggctgcttctctggggactatattttgagaactactgaactaccattctaggagggtgggaaaatgggttttcatcttggagcacaaattatttgcatgaatttaagcaagtcatgaatattctattcttcagtttcttcatctgataaataagatcaataataccagttcagcctactttgttgagttcttgggaggagccagtagaataatgtataagaaagtgcttttgaaaattaaaagaaacacttgtgtgaaattgttaatgttttcagagatgtaatgatgatgtaagaaatattcgctcaagaataccatggctcacacacaatatttgcaattttatttccttcatatttttccctctctttacacttttaaagcacattagtgcttgccttctggttattgacaagcagcaggtaagtggttggtgaatcaataaattctttggccttgagtctcaggctctgcttttttccacctatggtcgctgggtatccctctctttttttcctaatgcttattgtagaaatatttcacaggaaatggggtgacactaagcctcaagatattgtttctttttcctaaacaaacacttttatcactaggggacaatctttccttagttgatgacatattagttgatataaataaaggtgttcctgttaggctagccccttcagctattcaggtttcctgcctataaatcagtgaaagatgcaatttgaacttgattgcttagaaagacacaaaggcagagaggatgggttgcacttcaacaccgaaaattaaaggacaagcttgctgtcaaagccagaccactagcttcatttgatctattggttttaagctaaagggaggctcgaagaaggagtggttacctcataccaacagctaataaggaaacattttcagcattttttatttgtaccaaatgtaataatggagtggtggggttcttttggtacaacaatcatttctttcatttgaatgctaattacattctcaatgtatgaattaattataacttctattgactatgttgatattgtttagaaaaatcatctctcagatcagatgaaaagttttccctgtgtatgaaaggctcaagtgacttgttctgcatatggcattaatattccttgatgtaagctacataaaacattaaaacccaattaaactcagaaagggggccagccctgctgacttatttatttaaagccaagggagtggaaatcccttttcttgttgtatgtgtagataaagacatatgtcttccccactccccatgcctatttggagcatatttaaagatttcatcaaatttacctaaaattattatcttcaaagctagagcaagatttattaaaccctgaagtgtttgagcaaaggcagtaatttttgagagctttgactaaagctgttttgagcattccccgtgccagagagctcccaaaatgtaggaagaaaagctaagagtaaatgagaattgacactttctgcatagatcttgttcaaaaagctagaggattttcaggtgcttcattgctccttcttgctttctccccttggggactgaagtgtagtgtaaagcagcctatggtgtggggaactaaaatgtaaggaaatccatgatgaggccaggatgggaggattgcttgagcccaggtgttcgagaccagcctgggcaacaaaggaagaactccatctctacaaataattaaaaaattagctaggcatggtggcacacacgggtagtcccagctacttgggaggctgaggtgggaggatcacctgatcccaggaggtcaaggctgcagccatgatcacaccactacactacagcctggacaacagagcaaggccctgtctcaaaaaaaaaaaaacaaaaaagaaaaaatccatgatgataattaaccatgaatcatgcttctagaagaaagaccatagaatttagttatcatttgttatcattcctttatgggccaaagagattcctagcctgagaagaagagttgggacaaagtctatattctgattcctaaatgcatacatacataaatacacacacacacacacacacacacacacacatataatatcttattcatttattaattcatttgacaaatatttattaaatgcctaccatgtgtcaagcaatgttttaggtacagaatatacagtagtgggtaaaaaatccctaatcctaagaagcttacactagtggaaggaggtaaaaaataagcaaaaaagtaagtaaatttggaatgtgtcacatggtgtgatgtgcaaaggagaaaaaacatgcagggtgggagggacaggcaaacagggagaatgggaatacagttactgttttatttaaagtggtggggaaatgcctcacctatgaggagggaaaagggtgctcccagaacaatcttctggatgggagtgttcttggcatgaatgcaaataataaagaggtcagagaggctggagaaaagtgaatgagtgggagagtggaaggagatgagatcagagaagtagtgtgtatgtgtttgtgtgtgtgtgtgtgtgtgatgttaaaatgtccccactaaatataataataatgatagtaggtgcaattcttttaaaatacacttaattggcaaaataaaaagtcaatggctcttttttggccccatgcattgcctttttgttaattttcctctttaagacatgcaggtctggaaaccaccacttgaagcaatgcaagctgaataaggtgcagttgctgtcgctgagaatccaaaaaagtaatgtgaaggaataaaatcaggacacaaagttgaggcctgatatgagggacaatattggagaaatacaatgtgtcatgcatgggagtacatagaggacagggaagtggtgggtggctggtgaaccaagaaaatcttcatgaagtctgaattttgaaataggcatgaaagaagagagattttgagagttagggagaatattccagtcagaggacacacagcaataaatatgtaaggaggctggaaaatacgaattgaataaagaagccagcatctagaagtctagcttagttgtgtttttaagggatgcatacagaatgtactgagaaagaatggctgaaaggcaaattgaggtccaatggcaaaggactaaatgaatgatttcatggttttaaaacatggtcacaaaatctttaacattcctcctatcaagaggtgaagtttctgtctctttcccttcaattatgtgacaacatacagcaaaatttacaaggtcataaaaggtcatatagtttcctccatgtttgctcttggatctttaagatattatgtaagaatatcatgtaagaaatccaactactctgaggttaccataccctgaagaaactcaagccacatgaagaggctgcttgggggctttctgaccaacagtcctaacttaacccgggatttgaatcattccagcccaggtgccaggcttgtgagtaaacaaaccttcagatgattccaacccccagctgttaagtcacccccagccttcaagtcttctcagctgaggccaaagatatcataaagcagatataagccatcttcactatgccctcttcaaatccctgatccatggaatcagtggttgttttaaatcactgagtctgcagtaatttgttccacagtaatggatacttggaacaaatgggactgaagaatataactgggaagcagatatcatcctggaggctttagtgatggtatgtgtaagagacatctccacctctacggtatctagttcagggattgggacaccaggcagaaaatgtgatccatgggctcttgtaccatattttaagtgagcctcactcactttactggagtttggagttttactatttctttgaagtacgtggactagacaagggtgatgaaaaaattggctgcaaatatctttgtgacttaggaacagggattgatttctttaaaaaacacaaatcacatagcaagaacatcaaaatcaggaacattatggacaaagttattgtaagttaaaaaataagaaaaggtatttgtctaaaactaacataaaattaatatccagaacatataagcaattccagcaaataaacaaaaaggataataattctcatagaaaattgggcaaaaatatccataaaatttacagaataaaatattctaaaagccaagaagcatatgtgtgataaaaatcaagagtaatcagagaaatgaatatgaaaacaataatgagaatccactttgtacctggctgacaaaaattaggaaacttggtaatgttaagtgttgttggagatataagaatgcactattgctggtttgagtgagcaccagagcggccactatgttggagagcaatttggtactgcttaggataagtacgtttagtttaagtacactgcggcctggtaattttttttacctgcgattaatctgaaaacattctcacgcaattccacaagggaaaatatatgaggttgcttattagagtatcacagtcataatgagttgccgactacctgggtgtcaatcactgggagactggaggaaaagaatgtggtggatacttattgtggaatattatgggacaagtagaaataagaatttagaacatgtatggatcctaaaaacatagtgtaaagtgaaaaaaaaagtaacaaaagaatgagacatataacagagtattggtttcagaaatcaaaatttcatcaatacaaaatgatgatacccattttacaagagcattcaaaaacaattaagaaaatagttgctgatggatgggtagtgggggtgagtaagaaatgcaaaaagaataaataagtaaagaaaataaaagaagagccatacacaaaccagtaatgatgatgtgtcctgaactgaaaggtatgatgaatgtacccttctgcccctgagatccagatatcataaatacaaaccaataaactcagataaaagcttctggagtctctgactattctgaattgttttaaatacttcctggaatctggttcttttgtcctctctacgtttctctatgaacatacacaatcaagtcagactaacaggtgtgggttactcatgtgctatatatttttatcaggaaatgtcattacagctcatttggcaatttctgattctgtaccttgattcaagtgacttaaagttttttccttgattattaagataatccatattaactgtggaacatttagaaaatacaagaaaaaggccaaaaaaaaataattcaaaaaaatcaagaggaaaattatctttactataatctcaccactcagaaataattacagttaatatttgaatatatttattttcagctttttaaaaattatgtctatgtgagtattaatattaaatatgcatattaatatgcaaatgtatatgtatcttatatcttcaattgtaatataggtaaatttctctgttgtcagaattaggtagcatgtctttaaaaatctttgctttgtttacaggtgttaataataatctcatatttcagtttgtgtttatttgattaccagtgaagttgtatttcttatgttttttagctatttctattttcatttttgtgaatgatcttctcaaaaactgtgttcattattccataggattcttgttaaaaatcaatcttatattttccctatatgtgaatatcattaaacctttgctatgcttcttgttgtcatttgatttaatttatgcaaaaagtattagattttctttcataggtagtcaaacctatcatttattcttttctatgtttttctacatcattttaaatgttaaaatgtctttactcacctataatttcttctctcttgtctgtgtatctgtggtgtttatttatgtttttatagatcttattctttgatcaaaccaggaacttattttattagactgtattaaggagatgtctaagttgattttctcagtgcctgtcattacatagtcctttatttttctattaattctcatcgcttcccttatggtgaattaattcacacatacacttacatttgtttctgtctctactgatattaattaatttgtctctccttgtaccagaaatataatattttagttattattggtttataatatattttaataactgaacacagttatggcaattcctgcaatacttttttcaaaaataacattcttctttgcaaatgaaccttataattattttaagtttcaaaacaaactccaattggattttattggcaattattacatttaaacaacataatcatctggcgattatcagaatctttcaagcatttagaaattatatccaaaacaatgcatcccttcatcatgcttgagttatttttttaatctcttgatgaagttgtcatttttttcaaacgtatcactcacattgtcttgaataaggttattcttgtcttctaccagtcattgagcactatacagcgtggcccaccttaactgactgaatgcggaaagaagggtgtcaaggagactgaaagtcaggagacttctacctgctttaggaggaagtttcagtgcaagactgtggtggctctccaggtgtattttttttcacagaccctgcaatttctgggggaagacagtatgggtgggtcaaaggcccaactaacattctgtccttcaaaccctactgttatttcagaggagagattctcaacattttttataaatttagtcccactccaaccatattttgtgaaaattccttgcaggattcagcaaatggttaggtattactcctattgtcattgtgattatggctttgtatcttattttgctcttttatgagcattttaatggaaacatgggtgaattcaggatagtctaaggaatgctgcagtaacaatcgaccctcaaatttcagggactttataccagacaagtttatttttcattcctactgtttgtccagtctggttgtctgggggaatctgatcattgcaggcttgtgtaaattccatgttatcacaggcttacactatcactgcagcagggagaagaaacatggtaaatcatatactggctcttacagcttccatacaggaatatcacttcagcactctctcattggccaaagtaagtcacatggccttatctggtttcaaaatggggagagaattatactcctactatgttccagaaccagagcagactatttttggacaaccctaatgattagcatacattcacattctgaaagtctcacttcagcaacttttaaaaaatggcggtcgtttggcttcttaatcttttacaatacatagactaagtcacttatcagatgagcagtgctttagaagctagaagataatccttgtagaaaagcaatctatttctaaaggcaaagacaaaataagatagtaggcgttatgcctttgatactggaaggtcttaatttcagcatttggcgttcagatgcggattgaagggcataaacgtgtctctgctgttctatccatgggatgactgtaaagcacatgctttcagaactttctttcattgactgaatacattattatgtatattgacttctttctcttccttccaaaggcaaaaccttggagcatgagtgtgatcacttgaatgcagagtgtcatcttctactagtttttatgcattcactgtttctttttaacatcagaggagagggaagtcttgttgctataatatgctactttaaacaatcctggactgtgaggctgccaactctggcatcagttaagtcaagagcaggatacaatgggtagtgagggggtgggaagaatccacctaatacatatctcatattgattaaaataaatgaatgctctatttctaactggtgtcaaaagacatttacagtttccctagcctgtttcccacgtctgtttggcacagagactgccaggatcaatggtccaattttagttccactttcttcttccatcattccctgtattcagctcttcggaagtgagttaataatgtaaaatctggctgaattaaattcatttaactgtgctgccaattcccttcccttcatgcatttttaaaaagatctcaaaccggtgatggatttctaatgctctaggaaaagaaagcaaggatgagacagtaaacctgaatggagtggattgtttattataattactccaatgaattatctcactttgtacccagaaggaagaggaaatatcaacctatataggctttgcaagtggtaatatgcctggtggaaaaaaactgtagaaacggcctcttcagtcagtcaaacaagtgacacagtgcagcttcacatggaaagctgtgaacagtaaaatatgagttttgggggggctgtttctatagcaacccagcatattctagctaggactacgaatgcttttttttaaaaattaaacttacagttagaaacatattagaaaccaggcctcaaacagtgcctgtatgtgacactataactacgtgacctagacctacctggaaaaatggtctaatttgaatcctgttccttgttcccagacttgtctctggttctttccaaatcctcttggcttgttaaattgactgatgcaattagagtgtataatcttaaagtaatattcagaaaaagatagaaagatgaaatttttgtcaaatatataataacaaatggtaaagatttcagcagagatcttttaatgagagaatgttcctagaaattaaatacccatatgtctattagtttgggtgagtctgttagcattcaactgttaaagtcacctgcttccaaagcaagatgttagaacaagagattgttaatggctttttaaagattccttataagtactgaatagatttttcctatcatggcaaacaaaccacctggaatttggactgtgttttattacctacctccctgcttacagtctctggtcccatgaaggtgtcttgtttatcctaactataaagtggttctaatggcctaattggttaataacacagccagttccctagtttgtattctcatgacaaaccagagagcaaaagacttcacattctggttgcatgctcccatttttttgttccttaaatggaaccagggaccatcctgctactagatatgttcttcatcaccacaaacatctagagacttcatttgtgcagtatggacaaaagtttcaatggttccagaaaccatgctcccattaatttcatgtttagcaagatcactctggaaatccagaccatggcaatgacgaaaagttgagtggctcattcagtgtatcatctagcaaagctcagcatccaatagagctttaggagttcaggtgcttctaataaaatggaaaatgcctttcctattaataatgcagcacactcctctgtcctcttgtctctagatccttttgctgactcaaaacaacaacaacaacaaaacactgtgttgtgctttcacacaaataccaaacacctctggagagagcactatatttcagccaatgacagagggaagatttgaaattcgagatgcaggatttgagaagttttctattactctgaatttcctccttttttattttattatccaccaaccatcccccaccccaaccttgagagttaagattctgaaagtgtctcatgtaaactctgaataaattcttggtgtttagcatagccagcttcccttattgctttcagagtcaaacctctctggagccaaatggggctctttgctacatcagtgcaaagactgataaaaattaagtttggcaccacaatggcttctcctgacaagcaattcataactctgacagggccacatactaatgttttcacctatgattgggctattgacatcagttaaactgaccaagtcccccatcttgtcatcccaagccatcatatgtatatttgttctaatgtgttcctgtcccagtaaaatgatagtttttcctgtgctctcacttgctctctctcacttgccgccatgtaaaatgtgcctgcttccccttccaccacgattgtaagtttcctgaagcctccccagccatgcttaactgtgagtcaattaaacctcttttctttataaattatccagtcacaggcagttctttatagcagcatcagagcagactaataatacacttggtcttccttacaagcagggtatgtctcaggataaacagttttgttacagagtggatggcttttctcagagtgtcttccaagagactcaagtggaagccaggaggcttcttatagcccagcccagaacatcacttaggccgtattctattagccaagcaaatcattaaagcccactcaggttcaatggcagggaaattaaactccacctctcaatgggaagagtagcaaataaattttggccatgtataatctaccatatctcatatttcagagatcagagatgggttagccttctctcacctctcttttttcttacttccaactaactcctccatcccctccagtttgggccctggttccattccttccttcaaatacccctcccagttatggtaacatcttattctgaatcactacatctaatagaagttttcagtctcagcttattgatttcagcaacatttggcatgttgcccaatccctttttctttggtttccataacacaacattcctggttttctttttcctacatctgtggccatatcttattccctttgtaggctcagcctcctctaactggcccattacatattgaattccaggaagcagggtcacagggtctcttgtactttagatcaggagggatacaaattacaccccacaggctagcacctattttttgtaaataaagtttcagtggaacagaatcaggtccatttatgtatgcattgtctatggctgcttttaagctacagaggtaaaatggcagagactgtatggtctgttagcctataatatttactatttggccctgtactgcaaatgtttgcccacccctcctctagaaccagtggttttcaaggtgtggtccctggatcagcagcattcatgtcccctggaacacgtcagaaatgcaaattcttgagcccctcccaagacctgctgaatcagaaactctggctgtggggcccagctacctatgtgtttgtttacaaagccttccaggtgactccaatacatgctcatatttgagaatcactgctccaaatagtaagaaaatcaaggaaagagccagacatactgaaggttggaagcaaccaccacatctgccatatttgagttgaggtggtggaggctgagcacccctgtctactggtaggatctgcatcagcccagggctagaagcagcagctatggcaaaaccactggcctatgggtgtttccttttttctgtagagtgggtgaaggtttaggagctccgagcaggaccccagctctgtggcctaaggggattgttttttaacttaggattacttttgtaacttcaaatgtgacctaaaaaaataagcattataagtttttattttcctgttatgtgctaagcaccatgtaaagcactttgtatattttatatatacatgtttaaccattgtaacatactaacagagagcataagtcctaaactcaagcttctggcttccaattcaggccttgttgctttatagttacatactcctggccaagttacttacccactctctgtttctaacatgattaactataaaatatggtcaatggctgtatccaccttatagagttgttatgagaatcaatgcatctaaagtgcttagatcacttcctggcaaatagtaagtatttaatcaattagctatttgtattatcttatttaattttcgtatcagtaccccaaggtagatatcattgcccccagtttacaggtaatctctctgggcctttgattccttgggctaaatttttgaggtcacacatctgtaagtttcagaaccaggattcaaagacaggttgtttaaaagccaatgatcaagctcttaaccacaatagacacacacacatgcacacacatgcacacacacacaatttacatctttctggaaattagtttcttttggtagccatatttccacacagttgtgttaatatttaaaatattgatcaaatcttaaaaaaactagaaattctttaaaatgtcacatataatttaatttcttttatttcatttcaaatagcttgccaaacatattgaacatgttttgataatttggcattagttactgttacactgatcaatgtatattagctaatgtagaaattggtgatgcataacatatgagagtctgccattcaacccttaacagctcttttcttgacaaattcctttgtagcagttttttaaattattatttgcagttttctcacaaagtaaaacatatactcctgtgtggcccctttgcttacttttcacaaaatcagttagtaaaacaaagacgaggacatccttctccaaagtggttttcttaccttctagaaaatccttcaagttttttaatcttggtaacagcattctaattcttttcagtacagttaaaaataaaatttcatcactatggaaaatggaacatgttcagtcgctaacaatgttacctcacttgcatattgagagcatgaggcagggcaaggggcatctctggcattttggccattttagaaagtcatgctgtaaggttatatggaggacttggtttgaacttcatttgttttttatgtggagagaaagacacctaaactgaatggtacattggctgaaccagcatttgtgaagaaccaggcaatcagttaagtgtttgcaatacacagataaataagacacagttcttgcctaaagaaaattcgaatccagaggtaagacatcacagtggggtaaagtgaaggactggaggggacttcagatgcagatgaaagagaatcttctgcaggagcctcagtgaaggtattttggagatgagatttggatgagtgggaatagccataggaaaactggagggtaagaaatcaggtaaaggaggcagcacaagcaaaggtatgggtttaagaaatcccatgatataggtagagcaccatcattactggagccatctatatgaaaacgtgcgtgtggcaggagagagagcaggagaggtcggaagggacatccttgtcatggaggccctagtatgtagtggcaggcaaatgatgttcaatgtgtgagcttgatatttcttatctcacagatgtatctccattgccagtctgggaattgtcttgtccattctgagcagattttatttctactttgtatattggcttttattccttgatctctgtacttatttcttccaccatattcacttatctctgtatcttcccttttgcattctggcagaattattaagctttctatttacattagggattcgattttcttctgagtcatttttgatagctattttctccaatgcaggtttttaattccattactacctttttgattattttgtcatttatttcacataaaacatgctttctttttatctgatcccattgttttttcctgttgcaggtctgttctagattaacattgctatggtttgaatatgtcccctccaaaagttatgttgaaacttaatacccattgtggcggtattaagaggagggcctttggggaagtgattacgtcatgagggctctgccctcatgaatggattaaaatcctcatagaagaagcttcagagagagctttgtcatttttgccctttcacctttggccatgtgaggacgcagcaaagaagccctcgtcagataccgactgctggttccttgaccttggactttccagcctccagaactgtgagaaataaatttttgtggtttacaaattaccaagttttcggtatttcattacagaagcacattaagcacagaaggattaagacaaacattaacaaaaattttatgaattttattgagattaaagtagaaatttccttaacatgttctttcagtttctgcagtgatttcaccaagtgttttcctttcttctaaactaacagggaattaacttctctgtaagtagaatagaatgattcccaggccctgaattgtcaattgttttgtttctaatcataccaaatgaggagaaatctatactggcccctgtttataacaggtagaggcttgatcaccctaaagctaagagaacccccttcttggccataaaggcaggtgctagttttatctgcaaaatccaaagcttgaaattcattgctctgtgttaaatttttacagatttgctgagctggagtggaaactttttctcttcaactgtttcattttttgactctgtagaatgcatgagtgatgatggtgttgaagaaagagaaggaagatggcagaagtaaataatcttgactactctaccaggcacttttctaagatctttaattacttatctcattttattctcttaagaactctttgaagtagctactattcttgccccatgttacttataagggaactaaggtatggatagattaaataactcaaaatcttgcaacaagtagtaagaagaggtcagactactccaggtctgtctgattccaaagtccatgctcttgatctttatgcaatgctctattctatataggctctttcttgaataggttggtgcatgccaatctacccctgacctctgaatatagcttgcttagccccagaggacatttcaggattcaatgatccatcatttctactgctttcaactgctcatcatgttgcacatagaactctgtgtctactgtagctttgtgcttggagctagaggcagagagtccagtggccctaatctccttccactgacttcttaaatgtgttattctgtttagagtttgggcatgctttggctagtgcttgtggggtttttttttctttttaaaaaaatttttaaaatagagatgggatctcactgtgttgcccaggctggtctcgaactcctgggctcaagtgatgctcttgtttcgtcctcccaaaatgttgggattacaggtgtgagccaccatgcccggccatgattgtttcttaattcatacttatgtgatatagttaatgaaaatttcttcccgcttccacactgtactggactctcctccttggtttattttgttatcttattgtaattattaatctattgtgctaccacaatttttcccttttgttatcatatattttttaagggaatatgagaaaagatggaatccaaaacctttagctagctatcattttttgtttgtttgttttttgtttgcttgtttgttttgtgacagggtcttgctccgttgcccagactggagtgcagtgtgcagtcactcacagcagcctcaacctcccaggctcaagtgaccctcccaagtagctgggaccacaggcatgtgccattattatttgtaggacggggttttgccacgttgtccagattggtctcaaactcctgagttcaagtgatctgctggcctctgtctcccaaaatactgggatcacaggcatgagccaccatgcccagttgctagctatcatttttttatgccaaacctccactctcttttcaatgtttaatttaaaataatatcttagaagaaacattaagaattgctgtctttgatgctataggcatattgatattcattcaaattaacaaatgtttattaagtactaggaatgtgcaaagtgcagtgatcagcaatttggggatatagatacagagaaatcataattcttactttcaggtgcctcgtgagagaaacaggtatatctatgattcactatgtcttttttaatgtcctgtatgacactctaatgtaacaaaatgttatgggaacccaggaggagaaggaattatttgctgcagggttactggaaaaggacttccaggatatcttagcttgaattcccctggaagcatgtatcaagagtagtatttgggcacagggtttatttggaaggtgatttaggaagtcaagcagactgcactaataagcagcttactgttatgggcaacgggggctcattcctactggggacctcagggagatagttaagaataaacctgagtgttgttcttcttgaggtgggcagaggaaaatgaaatttttatttaccaaattttatgtatcgctgtttgagggctttgccagggatgttaactttccagtacttctcacctgtcccacatgtgggctgagtctgtgtttgtgcagccagtgaaaggcctcagacaaagagttataaacttgagtagtgcatggaaacaggatttggctgagacacagacagcatctgcttcactggaggaggtggcatttaaattgaaccttggatgatgagaaggtttttcagcaagtcgtgatatgggtgggggtaagcatttcagcatgtaagagtaggacggacaaggcagcatttgtgtggtccatggcaaataataataaagcaccaaagtttgaaaatgattcacatttttaaaattagagaaaattcaaggttatccctataaatattcattctcactcccttgctttgagtgggaaggaacgtagctctcaagagtttgctcagagggaatcgtgcttcaccagcagcctgtctcctttagttaatatctaggttgctttgacttattacgttgttttacttctcggcagaattttggggttctgtccaaatgtgggcatgactatgtgaattgtgttgttgtatatgggggatgtcattacttacatgcgtcacaatggggagaaggttaagaattgctgatacaaggcttggtgatgtggcaggcaggtataaggaagaaaaaataatccagtggttggagcataggttgtagtgtatggggatgggaactgagggtggatgaggaagggaaaggtgaggtggtatatccttatatatctatatatatttatctatatgtataaatatattcctaacttaatatttgggctaatatttggtgagtgttttaaattcagcatctctaaaataatgaagagaggctacacatcacaggagtgaaaatgagtcatgtgaattttccttttacttgcatgtagaatgaggagaaatatcgaaccatattatctacttcacaaggtgcaattgctccctgctaataaaatccatgtgaggtttcacttcaaccttagagaatattgaaatttttgacaaggcaggttattagtaggttgagagtctgcaacaaaatttgcacctgtttgaaaatgcttcattctggacaggcagctgacatctctggtaattcggtaattcacacctgtgagctcctgaagctttggaaaactgagtaaaagcaacaccacatcactgcagtacttatcccgcatttcccatggggcacaaggctatcaactgtgagcaggtgaggcttatttaaaacatcttcatttctagtttgcataacacggaatagagtattgcatgccatatgagtacatggaatactgaatacatagaatacttgtataagaactagccttgtttccatagactatcatagaagtagaaatgacattcttctgagggctgttaataaacagtgacagtgcatagaaattctgtttagagagaaagacaaaaaaaaaaggatgagctttgtttcaaaaataatgtcaaagatgaaggatagttcttaagactccatagtttgttttttgtactatttttttcttttctttcttttttttttttttttttttgagacatggtctcgctctgttacccaggctgaagtgcattggtgcgatcatagcttactgcagcctcaaactctactttcaaagttcagcatcttctgtggtaagaggaagttttatggcatttccattccagttgtctaccccacagtgctgctcttatcccactcctgcttggcagctccatggcttcaggttgaacatctcagccccctgagcattattcagctgtttctcctttatgaaagccagtggcaagtttgcactgggaccagccacacttccctttgataacctctctttctgttcatcactgtatctccacacaaggtaaaaaggatgggatacattttactgacggattgggaaaaaaaaattatgatggagaaaacttcaaaatcagtgctatagcatgatttttttcccacaagtttttgagacaaactggtaaattaaacctctcacagggaaattgccaattttatctctgtttctgacttgcttttccccattcagtctatcaaaaagagaaagagaagtatttttctattttctctgtaatttttaagttctgtcattcaaatgaaatattaattttccattagcattcaaagagtgctgaagtcatctcttttatccttcaccactgctccccacctcctccatgactgttggcaataataaataggccccttactgagtttttttgccctttattagctattttcttagctaccaatagagaaacttgagattatcaccttattagccaatgactttaattttctccacccattctcttgtttttgaggagagaagagggaggagagattatttgttaatttttttaaaaataagataatgtaaaggtcttttggagtgattttgaacaatactgttgttttctaaactttaaatattcagtgaactctattgtaaaaactggtcatagactcctacactaccccatccattttctctcaccttctgacacatattctactgtggctcttatttcattggcttagacatacctattcattggtctcctcctgggtgcaatgtcagagaccatagcacatttgttttggttcctctgaagtcctgtatcgagaaaggcaaataacaggtaataaataaatggttgttgaatatatttgtatccaatctgccaactcaccttctgaagcagttccatttaacaaattctaaaacaatgacattcatattttggaaagcttccagaaacctgtttcaatatttgctaccaaggagaaatgggaaaggagagaagaagatcaacatttatgaaatatcaactctgtatcacatataagtataacatacctcgtctcttttattctttaaaacagttctattaggtaagatctactaatctccatttttccaacaaggaaattggggtacataaaaattctggaggtcatgggttatcatgagacaaaaccaagatgcaaacctgagactgtctgtttccaaggcccagattctttccaccttacttcttaatcattgcctagcgaagaaagaaagtagacttgactcttgaacagcatggttttgaactgtgagtgtccacttagatgcagattttcttctgtctctgccatccctgagacagcaagactaacccttcctcttcctctttctcctcagccttctcaacataaagataaggatgaagacctttataatgaaccacttccacttaataaatgcttttttgttcttataataacatttcttaataacatttttttctctagcttatttcattgtcagaacacagcatataatacacataatatacaaaataacgaaatatgtatcaatcgactatttatgttatgggtaaggcttccagtgaacagtgggctatgagtagctatggtttggggagtcaaaagttatacatggatttttgacttcatgggggatcagtcccgctaacccctgagctgttcaagggtcaactgtattcgtttccacacctcattgacagatcaatttacttgatgctttatttttgcccaaatcctgtcagtcattcccctttgtctaacagagttcatacaacacagcctgaatagcaaggcagtacatcccagtggtaaacaagttatgtgggcttctgtgtcagtgataatgggaactctataatttcttacttgatctcataaaactattctgttaaatgggcataataatagtatctacttcacaacaaagttttttgaaaatcaagtgatataatacatatgaaatgctcagcacagtacacagtaaggacttgataaatataagctggtaccactatgtgttgtccttgttgttgttaatataactttaccatacccttccttactttttttttttttttgagatggtgttttgatctgccaccaagactggggtgcagtggcatgatcatggctcaccgcagcctcaacctcctggctcaagcaatcctcccacctcagccttccgagtagctaagaccacaggcatgcaccaccatgctcagctaattttttttatttttgtggagacagagtttcaccatgttgcccaagctggtctcaaactcctgggctcaagagacccacccacctaggcctcctcaagtgctagtattacaggcatgagccaccgggcccagcccatatccttcctttctaacctttggtttttcctataaaagtgctccatagcacaaacttgcctccagctgggctgggttccccaagctgtgccaaactctatgattatccttgcctttattctttggcttaaactaacacctcttcctctccatctgctcatgcaaatccaatcaattttctctctcaggcaaagctggtactccaaatagccatcctgtggatgttggcttctttcccaagctaccctgtgggagagtgctcaatgtgcaaagtggctatggcatcaggaatgggggttacacatgggcttcacaatgctgactttgcctgactaatgctagtccagctaccaccactattgaatgtctgcttgacaacatcagaaataaagttgagccctgttaggacattattttctgaggatgaagttgtgaggagtcgggtcaggggagcaggggagtccagccagcttcttggtggcatattgattgattacattcaacctcttccaacatggaggaagcagaaatttgtcctcactggaatatatattctaaatatggattggcatccctgcccatgatactattgccaggaccaccattcatagatttatggaattcattattcactatattattttgcatagcagtgcttctcaacaaatattgaatttttcaggcaaagaaatgtggcttggcttcatggtcatgaaattcattgcccttactatgtgctccactcttcagaagcaggtgaccccacagaatgttagaatagcctgttgaagatacagctatagtgtctattgcagtagaagactgtatctttgtggttggaaaactgtcctcagggatatgatatattttaaaccaatgaccaatattgtcaccattttcccatagccataatgcataggtctcagaaccaaagggtgaagtcaatagtgatttttctcatcattccacctaataatacattcactgaattttgccaaaagttccctctggaacttttattttgggccctgctggttgagaagtgttgattccccagggggcttgggaagacatttctactaatggacacaataatggttctgttgaacacgaagctgagagtgccatctgatcttgttggttcctcaggccactaaacttactgcaggcaaagaagggggttactctactagacagagtgcttgatcctgattatcaaggggaaattgaattattgtacataatgggagcagaaagaactttgactagaactcagcaggtttcataggacaccatttctttaattataaaagttaattgaagactacccagttaatgcaggatcactaaggactcagactctttacaatgaagatttgaatcatccaaccagctaaaagtttgaccaggtaaagtgaagggtaattataaaaaaagcatggaatatgcaatgaacaaaagaccttcaatttccactatggattcgtgtccagttacagaaacaagaactattacatactttgtgcagtgtgtatatttggttttttgcttgatttatatgcatgtgtgttttatcattcacttccccttttcgcactattttgtataagcagtgttggtaatacttaatttttaaatttagtcttcagatattaaatacctctgtgggctttttactgatctagaaaagaaattagcctttccagaaagggatatggtgactaataggatcctgtatttcacccttttgggaagagaataagtataccttaacttgtgcaagaaagagttgtagtggtgatgtcataaaaatggtggagtaggaaactccaaaaattggtttgttcattgaagcaagcattaagcaaaactaaaagaatcatttttttttggaactctggagtctaatcaaaatcttacagcaaccaggaaagtgtttaatgaaaacagacactgctaaattttgataagaaaatattgtggcattttcgcttgctcgcctaacatctcccactttccagctcgatagtggctgtgggaacagcagcttgtatacctggcatggtttgctggtgctgagatgggggacaatatggatctcattctcaatacattttggttttgatcaatctaatgtttccctgagggactggcacagagactgacctttgtttgccactacctccctgccctgaggctagagcgacgactttttaggtgacatctatcaaaagtatttcaaaacatactctacatgtctgcctgggacaagggacagaagatggggcaagcagcagacagacccaaaagtctgggaaggaaaagactaaggaggaaatttcttcagggaataagggctctgaaaggttaccacgtgtactgggaaatccagggtgcaacatgcatacccagggccagatgcatcctcacaaaaaacttgagaggattttaggcttgcacttctggttaatctttgggctttgcacaagtatgaggtaaaagctgaagcagagttttaggtggcctggcttagtgttgaaggagtgctccagcacagagccaatcttcaaaaactgggagagtagtttttttcttttcctttttggctccaagtatttaaagaaatttctggcaagtcgacgactgaatgctgagataacaacacagagacttcagagaccacatacaacaagaacctattgcaaaaaatagtttagaaaagtcattaaaccagtggacaattgcagccctcagtaatcaatagcaacaaacccagaggatggggagaatatgatttacatagttaccattttataatatttgcattttctggttttcaaaaacaattcagtgcatacaaagaaataggaaagtatggcccattcaaagtgataaaaaaaaaaaaaagaaatagacagaaagtattcctgggaaagcccataccttggacttaataaagactttaaattgattgtcttaaatatgctaaaagagttacaggaaaccatagacaaagaactaaaggaaacaaggagcaagatgtatggacgaatagagaatatcaacaaagagacaaattataaaaaggaacaaaatagaaattctagaggtgaaaggtacaattactgaaattgaaatttcactaaactaaataaaaaatttactctcagaacttccagaaggaataagtcctgctgacaccttaacttcagcctagtgaaactgattatggacttctgacccccacaactgtgaaacaataaatttatgttgtttcaagctactaaatttgtggtaacttgttatagcagcaataagcagttagtacaacacttttaaatcaattccaaccattaaattcctctgtcattaaaatacctagagtggtgtctgttttcctgtctgagtattgataagtaggtgttctatcaatatttgtggaataaactaatgtataaaatctgtaatgtccaaagctaaggtccaaagtcctccactctcttagtttgggttcctttagaagctgaccctgagctaagaagttggttgcaatgtttcctgggaaatattggtaagggagtgtagacatgagacagggaagggaacacaatcgaggtcaatgcagggaatgacatcaagcaagttatcacgagggaaaattgaaacctaatcttatgggggaactctgggagccagtgttgaacacgcacctcagagttactctacctggggggcaagggagttggagaatttcttaccagccatcatcagtccttccttgagggctacaccaactcactggcacctctgatctgccacctgtaggggcagagcaggttctggtggtcagagaaagttctcagaccacgagatgccaattctggcagttggaaggtaggtgggcatgcactgaagtggtaagggcttggagttggggatagaacatccacaacttcatctatactcacaaaatctactttagccaatccagtccaggtttacctccttcctattaaccaatagacacacactacatgcaccactccctagcaaaacagtgccttggaggcaataatgtgcgcattttgtcccttagtaggtctgcaggatttctgacagcacgggccatgacttgtttttcttttatgtttctcacaatgctgggtgccatagcaacatatatattttgggcacttaatatatattgttgaattgaattgattctcataattgtgtgatatctatttcttatatttgaaggtggctctctgttgagttttctatgtttcttctttttaaccttttccttcattgcaatattttaagtacacattaacaagtgataacgagggaaacaacctaaagattttatttttaatgtaagtatctccctacctaccaatgtgttcagcctttgaggaaatcaatgttaatacttaccattagcctttcacagccttttccattttcttacaaatgcacgtgaatgtgcacatgctatgtttttgtttttacaaaacatatgattatattatgtaccttcctttgccaattgtcaatttacttgataataggtcatacacaccaccaggtcaaaatagatttagtttatttattttaacagttgcagaatattatcttttgtatgtactgtaatttattcaaccattattttattgatgaacatgtaatttgcttccagtttctttttgcctccttaaacgatgctgcagtaaacatcctactacaaatattcatttatattcttcaaagtgctattactatgtcaaagagtatgtgcatttggaattttcatagatattgccagattatctgcctcttcttatccatattgaaaattctcatttctcttaaacatttcatattttatttatatgtaatgggatttgtctaaccagcattaatatatacacggttatgaatgataaactggcatggtactgctaggaatcatttgcatgtatcaattgtcatgagaattttctgctgaaggggaattgtgggggtttctttgtgtcttggagtagagaaatgtggcagaatctgaagcagaggctgtgcttcttttgtctaagcaataaagtatgatgcagctttggggaagcagacttgtccccacttctaaatggaacacagtgtagttgtggcagcaaagaatctggcacacaaaaatgcctacttagcttggaacatcctaggggattagcagagataactgggttgtacttagttcagcagtgggtagcaaaagccaatgagacaagtgttgttgcaattaaagtagctagccactttcctccccctagatttgtacccattggctagcaaggtgtgggaaacttactttacatataaatggacttgaattctcaaattggtctaaaatcttataccactttgaatagactcacttcctgaaatagcaaattatttttctctgttgatccttttattactgtaaaaacatttcagagtagagaaatatagtgatgagatgatgaaacactttattaatatagcactgtgaaccttttaattgaagtttgtgctttatattgtttgcaaatgagtttcaaaaatcataaggaaaactttcctcctttctggaaaattcccacttcaaagctaaaatgaaagcatttaaaaaaattaattttcaacaacaaaacagcgttaatggatatacctaagggcaattcagtggcgagagaaggcatatatgttttatgtactaacccagctttgccaagtttcccactttgctgcaaagttcattttcaaaacattggtaatctatcatttgacagcttgttgcttctgaaattctaaatttctggtatgcagctaatgtatgtacatttaaaaaacactagatctgaattcatatgtatgcaactcttaaattacatgctgctgtcaggtattgacttttatggttgatagctttaatattactatttgtgtctctataaattattttatctgaagccaaaaaagatgaaaatctgggttttattaatagatgtactaagcataacactcaagacataattgatatgaatatcaatagcatgattttaataacatcaaacattttggtgtcatagggaaatgtcttctaaatgcagagtgtgaaaggtgcagtgaatcaggggcaggctcgtaggaggaaatacctgacttgaatctatgaaaagaatggaagagtctgaaaaccattagagacagcatttgaaatagtccagaagattcacatttatcataaccttgatttttacaaccataaaaattacaaattttatgaaccaaaaacaaaaaattggctgcaatgaggccatcaagatttctagaactatgcaaacaatggggatttgttattctccttaaatgttgtatggaaaatatttgtgtgtgtgtgtgtgtgtgtgtgtgtgtgtgtgtgtgtcttaagggaaaatgaggtgtttaattacagagagagactcctttagagtatttcctaatgacaggaatttataactttagggatgtttggtttctttccaagtttggaccttagctttgtagagtggcagatgtatgaggaaggagctttaacagggtttctttgagagaggacaaagtaatgcagatgtaacagagggcagagaatcccttaatgaaactccttgctgatcaagtttgacagaagaagacacagaggaagtcctgacaccagagccccacaaagtgttgaacccctggcagttgactcatggaaaaagggccattgattgacccaaagtgagatagagcaaagtggtctttaacacttcccattcaatcccttctctccctttctaacttcaagctctatggcctcagcttactctccagttactcagaacttgatgtggtttggctgtgtcccactcaaatctcatcttgaattctggttcccataatccccatgtgtcatgggagggacatggtcggggggtgggtgagataattgaatcataggggaagtgccccaggctgctgttctcgtgatagtgagtgaattctcatgagatctaatggttttataaggggctccccacattttctctgcacttctctcctcccaccatgtgatggatgtgtttgcttccacttctgccatgattttaagtttcctgaggcctccccagccatgctgaactgtgactcaattaaacatcttccctttataaattacccagtctccaatatgtctttattagcagggtgagaatggactaatacggtaaattgataccgggagtgagatgctgctgtaaagatacccaaaaatgtgaaagtgggtaacaggactttggaagtgggtaacaggcagaggttggaaccgtttggagggctcagaagatgatatgaaaatgtgggaaagtttggaacttcctagagacttggagcactcagaagacaggaagatgtgggaaagtttggaatttcctagagacccgttaaatggctttgaccaaaatgttgatagtgatatggacaataacgtctatgctgaggtggtctcatatggagataagaaactttttggaaatgggaggaaaggtcactcttgctatgcagagactggtggcattttgcacctgccctagaggtctgtaaactttgaagttgagagagatgatttagggtatctggcagaataaatttctaaggggcaaagcattcaagaggaaaaagagagagttacatcatcatggcagacaggaagctggactagattgcagctctggaaagagcagtgtgtggaggctcacattgtgaatttgagctccagatccactgcaagacaaactgacaatcctgagaggacccacataccctccgaaggaaacagactgctcctgcaggacccgggagacccccatatactctgattgccccaactgcagaagtaggaatgggaagccctcctctcccaaacacacaccccactggagaaaccgaaggtctgtttgcaggaaaagtttccaaccttacctggagctgagttaacttggggagccgagtgaaatacaggaagcagcagaaaggccctcggagctcgctgggtctccaagtagcccattcctgcctggtaccacagagatccatcaggagggtagccagaggagcagggggtaaaactccacagggagaaggaaatctgtagctgaactttgtaacaatttgaatggggcgagaagcctcctggccagaactcaggggagtgcacaaatttggcatgcagactcctcctcaagcaagggaagaaccaagcccttttcttttgtagctggaaggcaggtagcctgggacaagttttcaagcctatctcacccaccacctgcaaacagactctgggcttttggagtggggaacagtgggagtgagactggcccttcagtttgcatgggagctgggtgaggcctgtgactgctggcttctccccactttcctgacaacctgcaagattcagcaggggcagccataattctcctaggcacacaactccagtgacctgggaatctcaccccgattccccacagcagctgcagcaagacctgcccaaggagagtctgagctcagacacacctggcccttcccccacctgatggtccttccctacccaccctggtagcagaagacaaagggcatataatcttgggagttctagggccctgcccaccacaagttcctctccatactaccacagctgatgctctctggaaagcaccaccaactgtcaggaggccaaccagcataaaaagagagcattaaaccaagaaagttaagaaccatcacagagtccattgcacccctctatcatctccactggaacaggcactcatatccacggctgagagacctatagacggttcacatcacaggactctgtgcaggcaacccccagtaccagcctggagccaggtagacttgcagggtggatagacctagaagagagacaacaatcacagcagttcagctcacaggaagccacatccataggaaaagggggagggtactacatcaagggaacaagagaaaggtgaagcccagtgcaaggaaatccaaaaaaaaaaaaaaaaagatacaagaaatgaagcaagagatattcaaggaaatagatagattaaagaaaaatcaatcaccaaaattcaggaaactttggacacacttttagaaatgtgaaatgctctggaaagtctcagaaataaaattgaacaagtagaagaaagaaattcagagctcaaagacaaggtctttgaattaatccaatccaacaaagaaaaagaaaaaataataataaaacatgaacaaagcctccaagaagtctgggattacattaaatgaccaaacctaagaataatcggtgttcctgaggaagaagggaattctaaaagcttggaaaacgtatttcgggaataagtgaggaaaacttccctggctttgctagagatctagacatccaaaaatacaagaaacacagagaacacctgggaaattaattgcaaaaagatcatcgcttaggcacatcatcatcaagttatccaaagtaaagacaaaggaaagaatcttaagagttgtgacacaaaagcgatggataacctataaaggaaaacctatcagattaacagatttcttagcagaaaccctacaagttataagggattggggccctatcttcagcctcctcaaatgaaacaattatcagccaagaattttgtatctaccaaaactaagcatcatatatgaaggaaagatacagtcttttgcagacaaacaaatgcttagagaattcactactaccaagccaccactacaagaactgctaaaaggagctctaaatcttgaaacaaatcctggaaacacatcaaaacagaatatctttaaaggataaattacacaggacctataaaacaaaaatgcaaattaaaaagcaaaaacaaaaaacaaaaaaacaaaagtacacaggcaaccaagagcatggtgaacgccatggtacctcacatttcaatactaacattaaacgtaaatggcctaaatgctccacttaaaagatacagaaccacagaatggcagacaactatctgctgccttcaggagactcacctaacacataaggcgactcatataaacttaaagtaaaggggtggggaaaggcattttaggcaaattgacaccaaaagcaagcaggggtagctatttttatatcagacaaaacaaacattaaagcagcagcagttaaaagagacaaagagggacattatataatggtaagaggccttgtccaacaggaaaatatcataatcctaaacatatatgaacctaacactggagctcccaaatttataaaacaaatactaatagactgaagaaatgagttagacagcaacacaataatagtgggggacttcagtactccactgacagcactagacaggtccacaacacagaaagtcaacaaagaaacaactgagggtggagccaagatggccgaataggaacagctccattctacagctcccagcatgagcgacgcagaagacgggtgatttctgcatttcgaattgaggtaccgggttcatctcactggggaatgttgggcagtgggtgcagtgcactgagtgtgagccgaagaagggcgaggcatcgcttcacctgggaagtgcaaggggtcagggagttccctttcctagtcaaagaaaggggtgacagatggcacctggaaaatcgggtcactcccaccctaatactgcacttttccaatggtcttagcaaacggcacaccaggagattatatcccacgcttggctcggagggtcctagcccacagagcctcactcattgctagcacagcagtctgagatcaaactgcaaggcagtagcgaggcttggggaggggcgcccaccattgctggggcttgagtaggtaaacaaagcggccaggaagctcgaactgggtggagcccaccgcagctcaaggaagcctgcctgcctctgtagactccacctcagggggcagggcatagacaaacaaaaggcagcagaaacctctgcagacttaaatgtccctgtctgacagctttgaagagagtagtggttctcccagcacgcagccggagatctgagaacggacagactgcctcctcaagtgagttcctgacccacgagtagcctaactgggaggcaccccccaggaggggcagactgacacctcacatggctgggtactcctctgagacaaaacttacagcggaacgatcaggcagcaacatttgctgttcaccaaaatctgctgttctgcagcctccgctgctgatacccagccaaacaggatctggagtggacctccagcaaactccaacagacctgcagctgaaggtcctgactgttagaaggaaaactaacaaacagaaaggacatccacaccaaaaccccatctgtatgtcaccatcatcagagatcaaaggtagataaaacaacaaagatgcagaaaaaacagagcagaaaacctggaaactctaaaaatcagagcacctctcctcctccaaaggaatgcagctgctcaccagcaacagaacaaagctggatggagaatgactttgacaagttgagagaagaaggcttcagatgatcaaactactctgatctaaaggaggaagttagaacccatggcaaagaggttaaaaaccttgaaaaaaaattaaacgaatggctaactagaataaccaatgcagagaagtccttaaaggacctgatggagctgaaaaccatggcacgagaactatgagatgaatgcacaagcctcagtagccgatgcgatcaactggaagaaagggtatcagtgatggaagatcaaatgaatgaaatgaagcaagaagagaagtttagagaaaaaagaataaaaagaaatgaacaaagcctccaagaaatatgggactatgtgaaaagaccaaatctaagtgatggggagaagggaaccaagttggaaaacatctgcaggatactatccaggagaacttccccaatctagcaaggcaggccaatattcaaattcaggaaatacagagaatgccacaaagatactcctcgagaagagcaactccaagacacataattgtccaattcaccaaagttgaaatgtaggaaaaaatgttaagggcagccagagagaaaggtcatgttacccacaaagggaagcccttcagaataacagctgatctctcggcagaaactctacgagccagaagatagtgggggccaatattcaacattcttaaagaaaagaattttcaacccagaatttcatgtccagccaaactaagcttcataagtgaaggagaaataaaatcccttacagacaagcaaatgctgagagaatttgtcaccaccagacctgccctaaaagagctcctgaaggaagcactaaacatggaaaggaaaaaccggtaccagccactgcaaaaacatgccaaattgtaaagaccatcgaggctaggaagaaactgcatcaactaacgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggaaacccatctcatgtgcagagacacacataggctcaaaacaaagggatggaggaagatctaccaagcaaatggaaaataaaaaaaggcaggggttgcaatcctagtctctgataaaacagacttaaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagacttagactcccacacaataataatgggagactttaacaccccactgtcaacattagacagatcaatgagacagaaagttaacaaggatatccaggaatggaactcagttctgcaccaagcagaactaataaacatctacagaactctccaccccaaatcaacagaatatacattcttctcagcaccacatcacacttattccaaaattgaccacatagttggaaggaaaggactcctcagcaaatgtaaaagaaaagaaattataacaaactgtctctcagaccacagtgcaatcaaactagaactcaagattaagaaactcactcaaaactgctcaactacatagaaactgaacaacctgctcctgaatgaatactgggtacataacaaaatgaagtcaggaataaagatattctttgaaaccaatgagaacaaagacacaacataccagcatctctgggacacattcaatgcagtgtgtagagggaaatttatagcactaaatgcccacaagagaaagcaggaaagatccaaaattgacaccctaacatcacaattaaaagaactagagaagcaagtgcaaacacattcaaaagctagtagaaggcaagaaataactaagatcagagcagaactgaaggagatacagacacaaaaaacccttcaaaaaaatcaatgaatccaggagctggttttttgaaaagatctataaaattgatagaccgctagcaagactaataaagaagaaaagaaagaagaatcaaatagacgcaataaaaaatgataaaggtgatatcaccactgatcccacagaaatacaaactaccatcagagaatactatatacacctctatgcaaataaactagaaaatctagaagaaatggataaattcctcgacacatacaccctcccaagactaaaccaggaataacttgaatctctgaatagaccaataacaggctctgaaattgaggcaataattcatagcttaccaaccaaaaaaagtccagggccagatggattcacagccgaattctaccagaggtacaaggaggaactggtaccattccttctgaaactattccaatcaatagaaaaagagggaatcctccctaactcattttatgaggccagcattatcctgataccaaagcctggaagagacacaataaaaaaagagaattttagaccaatatccctgatgaacgcccatgcaaaaatcctcaataaaatactggcaaaccgaatccagcagcacatcaaaaagcttatccaccatgatcaagtgggcttcatccctgggatgcaaggctggttcaatatacgcaaatcaataaacgtaatccagcatataaacagaaccaaagacaaaaaccacatgattatctcaatagatgcagaaaagtcctttgacaaaattcaacaacacttcatgctaaaaacctcaataaattaggtattgatgggacgtatctcgaaataataagagctatctatgacaaacccacagccaacatcatactgaatgggcaaaaactggaagcattccctttgaaaactggcacaagacagggatgccctctctcaccactcctattcaacacagtgttggaagttctggcagaggcaatcaggcaggagaaggaaataaagggtattcaatcaggaaaagaggaagtcaaattgtccctgtttccagatgacatgattgtatatctagaaaaccccatcgtctcagcccaaaatttccttaagctgataggcaacttcagcgaagtctcaggatacaaaatcagtgtgcaaaaatcacaagcattcttatataccaataacagacaaacagagaaccaaatcatgagtgaactcccattcacaattgcttcaaagagaataaaatacctaggaatccaacttgcaagggatgtgaaggacctcttcaaggagaactacaaaccactgctcaaggaaataaaagaggatacaaacaaatggaagaacattccatgctcataggtaggaagaatcaatattgtgaaaatggccatactgcccaaggtaatttatagattcaatgccatccccatcaagctaccaatgactttcttcacagaattggaaaaaactactttaaagttcatatggaaccagaaaagagcccgcatcaccaagtcaatcctaagccaaaagaacaaagctggaggcatcatgctaccggactgcaaactatactacaaggctacagtaaccaaaacagcatggtactggtaccaaaacagagatatagaccaatggaacagaaaagagccctcagaaataatgccacatatctacaactatctgatctttgacaaacctgagaaaaacaagaaatggggaaaggattccctatttaataaatggcgctgggaaaactggccagccatacttagaaagctgaaactggatcccttccttacaccttatacaaaaattaattcaagatggatgaaagactttaatgtcagacctaaaaccataaaaaccctagaagaaaacctaggcaataccattcaggacataggcatgggcaaggacttcacgtctaaaacaccaaaagcaatggcaacaaaagccaaaattgacaaatgggatctaattaaactgaagagcttctgcacagcaaaaggaactaccatcaaagtgaacaggcagcctacagaatgggagaaaatgtttgcaatctactcatctgacaaagggctaatatccagaatctacaataaactcaaacaaatttacaagaaaaaaacaaacaaccccatcaaaaagtgggcgaaggatatgaacagacacttctcataagaaggcatttatgcagccaaaagacacatgaaaaatgctcatcatcactggccatcagataaatgccaatcaaaaccacaatgagataccatctcacaccagttagaatggcaatcattaaaaagtcaggaaacaacaggtgctggagaggatgtggagaaataggaacacttttacagtgttggtgggactttaaactagttcaaccattgtggaagtcagtgtggcgattcctcagggatctagaactagaaataccatttgacccagccatcccattactgggtatatacccaaaggattataaatcatgctgctataaagacacatgcatacatatgtttattgtggcattattcacaatagcaaagacttggaaccaacccaaatgtccaacaatgatagactggattaagaaaatgtggcacatatacaccatggaatactatgcagtcataaaaaaggatgagttcctgtcctttgtagggacatgtatgaatctggaaaccatcattctcagcaaactatcgcaaggacaaaaaaccaaacaccacatgttctcactcataagtgggaactgaacaatgagaacacatggacacaggaaggggaacatcacacaccggggcctgttgtggggtcgggggaggggggagggatagcattaggagatatacctaatgttaaatgaagagctaatgggtgcagcacaccaacatggcacatgcatacatatgtaacaaacctgcacgttgtgcacatgtaccctaaaacttaaagtataataaaaaaaagaaacaatggatttaaactataccttggaacaaataaacttaacagttatatacagaacatttcatccaacaattgcaaaatacacgttctattcaacagtgcatgtaactttcctcaaggtagaccatatgataggccataaaacaaccctcaataaatgtaagaaaactaaaattatatcaagcagtctctcagaccaccatggaataaaactggaaattgactccaaaagaaacctttgaaaccatacaaatacatggaaattagatgacttgctcttacatgagcattgggtcaaaaacaaaatcaagatagaaattaaagaattatttgaactaaatgacaataatgacacaacctaccaaaacctctggggtacaacaagggcactgctaagaggaaagttcatagccctgaacacctacatcaaaaagactgaaagagcacaaatcaacattctaaggtcacacctcaaggaactagagaaacaagaagaaaccaaacccaaacccagcagaagaaaggaaatgaccaaaatcagagcagaactaaaggaaattgaaacagaaaaaaaaatacaaaagataaatgaaacaaaaagctggttctttgaaaacataaataaaatcgatagaccattagcaagattaaccaagaaaagaagagagaaaatccaaataacctcactaagaaatgaaacaggaaatattacaactgacaccactgaaatacgaaagatcattcaaggctactatgaacacctttacgcacataaaccagaaaacctagaagagatgaataaattcctggaaaaatacaaccctcctggcttaaatcaggaataattagattccccaaacagaccaataacaagcagcaagattgaaatggtaatgaaaaaattaccaacaaaaaaacagtccagaaccagatggattcacagcagaattctaccagacattcgaagaagaactggtaccaatccttctgaccctattccacaagatagagaaagaagaaactctcccaaatttattttatgaagccagcatcaccctaataccaaaaccagggaaggacttaaccaaaaaagaaaacaacagaccaatatccttgatgaacatagatgctaaaatccttaacaaaatactagctaactgaatccaacaacatatcaaaaagataatccaccatgatcaagtgggtttcataccagggatgcagggatggtttaacatatgcagtcaataaatgtgatacaccacataaacagaattaaaaacaaaaattacatgatcatcttaaaagatgcagaaaaagcattagacaaaatccagcatctctttatgattaaaactctcagcaaaattgacatacaagggatgtaccttaatgtaataaaagccatctatgacaaacccacagtcagcataatactgaatggggaaaagttgaaagcattccctctgagaactgaaacaagacaaggatagccactctcaccactcctcttcaacatagcactggaaattctagccaaagcaatcagacaagagaaagaaataaaaggcatccaaataggtaaagagaaagtcaaactgtcactgtttgctgacagtatgaacatttaccttgaaaaccctaaagactcctccagaaaactgctataaatgatgaaagattcagcaaagtgtccgaatacaagattaatgtacacaaatcagtagctcttttatacatcaaaagtgacaaagtggagaatcaaatcaagaactcaactccttttacaatagctgcaaaaaaaataaaatacctaggcatatacctaaccaagaagtcaaaaggcttctacaaggaaaactaacaaaacactgctgaaagaaatcacagatgacacaaaaatttgaaacacatcccatgctcatggatgggtagaatcaatattgtgaaaatgaccagactgtcaaaagaaatctacaaattcaatgcaatccgcatcaaaatatcaccatcattcttcaccgaattagatacaacagagcccacatagccaaagtaagactaagcaaaaagaataaatctggaggcatcacactacctgatttcaaactgtattgtaaggccatagtcaccaaaacagcaaggtactggtataaaaacaggcacatagaccaatggaacaaaacagagaactcagaaataaacccaaatacttacagctaactgatcttcgacaaagtaaacaaaaacataaagtagggaaaggacaccctattcaacaaatggtgctgagataattggctagccacatgtaggagaatgaaactggatcctcatctctcaccttatataaaaatcaactcaagatggattaaggacttaaacctaagacctgacactataaaaattttagaagataaccttggaaaaccccctctagacaatggcttaggcaaggatttcatgaccaagaacccaaaagcaaatgcaataaaaaaaaaagctaaatagctgggacctaattaaattaaagagcttttgcatggcaaaaggaatagtcagcagagtaaacagatgacccacagagtgggataaaatcttcataatctatacaactacataggactaatatccagaatctacaataaactcaaacaaatcagtaagaaaaaaatcaaacaaacccatcaaaaagtaggctaaggacatgaacagacaattctcaaaagaagatatataaatagccaacaaacatacaaaaaaaactgagcatcactaacgatcagggaaatgcaaatcaaaaccacaatgcgatatcaccttactcctgcaagaatggccataataaaaaaatcagaaaacagtagatgttggcctggatacggtgatcaggaaacacttctacactgatggtgggaatgtaaactagtacagccactatggaaacagtgtggagactccttgaagacctaaaagtggaactagtatttgatccagcaatctcactcctttgtatctacccagaggaaaagaagtcattatttgaaaaagacacttgcacacacatgtttataacagcacaatttgcaattgcaaaaatatggaaccaacccaaatgcccatcaatcaactaatggatatatcaatgctggggcattgcctagtggagctgtgagaaggtcatcgtcctccagaacccagaatggaagatcctctgacagcttgcactgtgcgcctggaaaagctgcagacactcaacaccagcacacaaaagtagccaggaggggagctgtaccctgcaaagccacaggggcagagctgcccaaggccatgggagcccacctcttgcattagcatgacttggaagtgagacatgaaatcaaaggagatcattttggaactttaaggtttagtgactgccctattagttttcggacttgcatggggcctgtagcccctttgttttggccaatttctttcctttggaatgggtgtatttatgcaatgcctgtaccttcattttatgtaggaagtaactaacttgcttttgattttacaggctcataggcagaagggacttgccttgtctcagatgagactttggacttggactgttggtttaatgctggaatgagttaagactttggggcactgttgggaaagcatgattgtgttttgaaatgtgaggacatgagatttgggaggggccaggggtgagatgatatgatttggctgtgtccctacccaaatctcatcaagaattgtagttcccataatcctcacatatcgtgggagggacctggtgggaggtaattgaatcattatttccacactgttctcctgatagtgagtgagttctcatgaaatctgatggttttataaggggcttttcccccttttgttcagtacttctctttgctgttgccatgtgaaaaaggacatgtttccttccccttccaccatgattgtaagtttcctgaggcctctccagccatactgaactgtgagtcaattacatctctttcctttataaattaaccagtctcaggtatgtctttattagcagcatgagaacagacttacacagaactcttctgttagttgttttgtaccagtatatatccttcctgggcagtatcaaatttggctggacatttcaccactagccttcatttctttttaccctaataaaatcttagccttcctgaagtttattccctgagttttacaattaaagcaatttggatcatcagtcaatatgatgtttcttatctaatatactgatgtcctaatagaatctctcggagttgttcaaaggacaggttttgttcaaatggataggataggttcaaatggtggtcttttaatttgaacaggtgggtgggggagcttctttaggggtgaaagatttcttgcttgtcctcaaaccacatcatgtacagagctgcctattctgcctaagcataagcccatttctgatgccttgtccacatgtggtgtgtagctcattgtcacatactcaaggtgatgcccagcatactgtgctcagcttatgttactgcccatctactaggtatcccctgtccccatgggccttggctacttgccttgcttcccagtaagagtggtcctaaggaggacttgggcttttcctgtgctctttaaagctctggctgccctccttccatgatcaaagaggccctcatgctcagttctgactgataaggaaagtctgtcatgcctgcaaactggctggagtgggcccacagagggcctgctttctcagtgattttccagaaggccacagaaactcaacccagacgtgcacgtaggctagtgtcctgttgaccaatcagatacttttttgtatttactctccttcctccccttcctcgcttttattttttccctccttcttgcttccctgggagaatactccccagtaaagggttacaatataagcttctaccactggctctgttttctagagaatcagggctaaaaaaagaagtaaaaatagatgattgacaatgtcaaagaaacatccaagtgtatctctattttcctaactataagccaaacttagtcctgtcacagttgcccaaggattatgggatacaggaagtggtcaagtgtcacatgatgtagcatggagtgatgggggtgaacatggcaggaatgtctggagcctggactccaaagggcaatgacccaaaggcataagaaagttcatattaatgcaaggtgctcggatgtgtttggctacaacagtaagtgtcacttgtgcctcagacagtgtagaaaagaaattgagataaaggaaatggtgagcaaaccctgagggtgatttttttctttccaggcacaggctttgtggacatcttgccttgttggcgtggccaagggtctaagagctgggtccagctgggggtttctagggagtcctgaggagcagcacgctgctccagttttcctctgggtccacacgttctcaaggtcaagtaaagcttatgtgtgtatagacttgataattgacctgcaaaacaaagagtccacctttacatgtggttcttaaaatactttccactttacgaccaatttctacttaccattcttaacaagcagaagatttgaaatgaccgtatgcataacaggataagcgtctccacaggttcatgcgtgaagctagaggcttagagtggacagtgtcctctaaatgaaatgaaggggaaacgtaataatggcttttaacaaggtcacattgaaagggaatgacaggataaattggaccatttgagaactttgccaagtgtaaaaattaaggtaacattactaaaaaatctatctagataatcttgggctctgaaaaaaagttaatgggaagtggacctaattatttgaactgagatgcagaaaatgtagttcatgtacctattaaggatacatcagatgcccaaggtatctgaacaaaaatgctgacaaagatcaatttaatattgaatgatttatttcaggagacccagaattttttttaaataagagacttaggggaaagtctgctaaaataaacaaatcctgagataatatttaatttggatttgggttagtagataagtttgatttttaaaatatgtctaaagttgagagtttaaaaaagacttgacaaaaatagaccaagtgctttttaactgaaaccaaagaattttaaaaatatagaaataatcaggtgtagcaatatgtttggtttactcccttaaaagaaaaaaaaatcaacatattttaggaatttaaggctttcaggtgactttagatgaatttatattgtttggacaatcttcttaaaatataaaaatggtaaaaaaaaaaagaatcttatgaaaactcagtcatttaattttgaggcattaagaaaaaccattccaagcacttggttaagtcttttctgtatattatcttgttgatttttcagaataactttttaaggaaataatttctgtaacctcattatagataaaacaggtttagggaagttagctaatttgcccaaagtcttacctcttgtaagccaggacttgaactcaagcctctcagattaaacggtatggttagacagtgggacttagaccctgtgctgtcaccaatctgctaagtgcacagagcatttcatgtgtgtagttcagccatgcagactagctttttagcttgtcattcttggataattaactgtctttgacaaagtctgactgctcttgcttctctagcattcatttttggtatgaccactttttctagcatgtggaagaaatgtttgcatgtttggatgtgtctttttgttaatcaagatacagactaatatggcaaagagatgaaaagcttgtctccatttgagcaactccatagatttctgacaaagcaacagaatttggcgatgctgatgctctaagaatgattgaatggataaagttcctaatgacaacacccagggaggtatgattggttttcttttgctgctttcaaggaagcgtgtactctagccaaatttaggatgccccataggacaccaggaaatgttacaaaattttgtgcagtaaaaaaaacctttaaaatgtataagattccttcatacttagcagccttggattccatttttaacaaattttataatataccaaatttaatgagctattgtctgaatatagagtttgtctattttaaaaaagaaagtagtaagactgaatttgttgtgacctatgggatcataaaatttatagtcataggctttgaaattaaactgagtttgaattttagctctgctacttctaggctgtgaggctgggagaagttatttagcctctgtttcttgtttttctcatctcattgtaaggattaaatgagatcatgtattacaaatgcatccattgtgttcatttattattttttataaaccatacttgtacagtcagtgtagcaaacttgattttataagcaaatcaagtttcttcaatgtatatattttggattcttaagtcagtgtattgattttaaggggtaaagaactttaaaaaataatatacaaacgtatgtttttccattttctcttttcccctactttcttatcatccaccctccacctgtcatgaaaaggaaagagaaagagagaggaataagaaacaggaaggaaggaaggaaggagggaaggaaggaaggaaggagggaaggaaggaaggaaggcaggcagacaggctagcaaagaatgaaataaaacaaaaattaattttttaaatttcttcataatttttggaaatttaacttctttagatgctgctatttaaaatacatacataggtcaataaattcaggaaggacactaggctgaaaaattttcccttcggtaaatctgacaccagcaactcatacagcttgtcggatctaaggtctcactgggaagcacaaaggaagcaggcagcagaaggagacatcaaatggtgcagcctgcagttcccagcagtgactctcaatgggactgcatgcattaccatggttcctgcaggaactactgcccagctgattgtcagtggaagtgtggacacaggctatcctcatttctcctacccttatctggtttcccagcagcagatggtgatggtagtcacgtttttccagctgtccacactacagaggaggacccaagtttgtctgtacactcccttccctcattttgaggagtctgagggctgaaatgttatgcaagagaaagatctggtttgatactttggatccctctaaaattctgtaatttttatctttaatgaaaattgctaaatagtacaagcttggatagtggcaaattaataaattcaagcactctataaataactaaagtattaataagcatctctctaaaagtttgggcagaaaattatcttaatcttacattattatggagagggcatgaaaaattacttgatcatgagatacataatacttatcagtaaaatcaatccaggggtaatgtaatagcaaaatgttctatcatgattttaaagccattatccaaattagttgctgaagaaagaaactaaatataataagaactgtagaaccattagtagtattttggtctcactaaaagtaagctgtaagaatgctcatctaaaattacaagcataattaaaaaatcacagaggccttgaaccaaaacacaaaatgacaatcatgaaatccatcaactgctctaatagcaacttatgtttatatggtgacttacactttgaaatgagatttcacagatgttattgtaatacaatatcctttgaagtagatggacatgcaccattattcctgtttactagatgaatatactgagactcaaagagattaggtaacatgacaacatcagacctataatccagttttcttgtcttcagagtaggtctttttttttccatctctgcaggtcatagatgttaatttttattgtgtagcagccactggaaacatctcaatttgctcgaagaactcaaatactcatctatattttgtgtatatgtgtgtgggggggatactggtgctaatgttgtgcttctctgttgcattggtggccccaaatgaaacatatctcttgatattcttttctttgcatgttctgccctttgtatctgagcgtgacctgtgtttgcttaaaccaaaagaacacaactgaattgctattattccagttctgggcctaacccttaagaaggcctggcatattttgctttgtactcttgaaagcccaagatattcgtgaaagaagcctgactagtctgctggagaggccacttgcatagagggataaaatggagaggctacttggaaagagagagcctctaaggcagcaaggaaagagagaagctcagacataccagaaccctggctgagccccgtccccagacaatctgcctgctgaatttaatcacactagtgaccccagggggtgactaacagaagaatccccagctgagcacagccgaggctgcagggctgggagaaaataaaacgaatgttgttttcagctactaggttttatggtggtttgctacagacagatacctgaaataaatgtcaaagcaatgggcttcaggcttcattactctttccaagtacacagttactgaatgagtaagcattccacaatcctacatctcaaaatccagatgacagttctatgaattctgcattggatgtgtttcatcatcagggaaaaagaaaggcctgctgtgaaagaccaaaacattcacgaaactgacttattttgtatcagagcaataatgctgctaattgtttaaaccaaaaacccaggcacgatgtggctgccaagatatgaaatgacactccgtaaacttgcaatttcatttcacatccatgaatgcattttcatcctatgaggactgctgtgtatgcgggtgctttcaattctgggaatgtcatctgggaaaagagagcagcagcttggccatgaaactgcaggtttgcaaattagcaaattttcagcactctgttcattagtgaaatcaatgagacttttaaaggactgagaaaaattgtcaaaatatgagcatatgaaatgatgacacaaatgggactttagaaactcaggggtgaatttgggggagacacagcacaggaagaatcctttgataaactcccaaacaggctacagttggttacatcaactgaagtgactgctctgcctctaggtcatttgcaactttggaattcttgcttggaactggcttttttgggtcatcacttggtttaaattatgttctcttcagattaagagcacaccagatgttaagtgattctcttcaactgtgtaattttaaaggaagttactttaagatagttattaacttaactgtatatttaacacttaatgcaaaaaacaatcatggttttcataatggaagcacatgattcagagggggagggaaaggcctaaactggtatatggtaagatctagcttttccaactgttttatcttgcctgccactggcttgtgggaattcttccagaggcagctgatgcttctggaagtaagttaaagatggccaagaaaagcctaacatacagcccctgccttcaaggggcttagagtttagttaaaaaaacagtgatttgggaggttcttaaccattctcacagtcagagagcctcagagatgctagtgatgaaatcggtctttccattatttagaaaaaatgggtgcaagttagatatacacattgctttcctctcactttttgtgtcaataggcagcagcacgattccctagtccccacctcttattagtcaccccaaatacctacaatcttgaaatatatcaactgccctatagcgacttacattaaatgatgccttacaatttaaaatccaacttcgtagttttttaaaaaacaaaataatcctaaaatgtaggtgaagcataaactactattcttattttttttaataaataaactgattgagagagatccacacaatatgtgtaaaagtcaggaggttatacactcatagataataagttgttgacttttagcaaaaattctccagaaacacaattcttattctgtccagttaccccggttggaaatcagagggggtggctgtgaaggggtagaagatttatatggaaagaaagatgagtatcctatggtgtgctgaggataacttttcttgtggaaaaagaaaagtcataagctcagaggccatgggattgctgggatgccattaggaaggagtcagcccctcacccaacttcccacttttaagtgggtgtcaacctgtatgttaattgcagcactattcataatatctaggatgtggaatcaacctaggtgctcatcaagggtagattagatagagaatataaggtacatgtacaccatggaatactacacagccataaaaaagaatgaaatcatgtcctttgcagcaatatagatgcagctggatgcaattatcctaagcaaacgaatgcagaaacaaaaaaaaaaaaaaacaagcactgcatgttctcacttataagtgagagctaaacattgggtacacatggacataaagatgggaacaatagacactggggactaaaataaggaggacggagggagagggataagggttgaaaaacttccctgttgtgtactgtgctcactacctgggtgacggattcaattataccccaagcctcagcatcatgcaatataactttgtagtaaacctgtatgtgtaccctctgaatcaaaaataaaagttaaataaatacatgaatatgtaaatcatttccaaaaagtacacagaaactaccaacttaaagcagaaaagaaatgacaggaccaacatggcagaagcctccttttttaaaaaaaatccagtgctgaaataatgcatgttttctggtgtgtaggagagttccaaggcttaccctgtctgagctgttttcactatggtgtatgcatgcacacatacatgcatactcacatgcatatgtgtatgcacatatgtacatgcacacacatatgttattgctttaatctgctgtatttagtggacacataacctggagaaaacactgtgccttttctattttcatctgtacgatacctgctgagaagctttcagtatcattttgaatagaactagaacaaacggcacgattttgtgcaatctcaactgtcctcaagcttgagctatagagcagagaacactttccgtcttcccacaccaaacagcatccttccgaagtgtttgaacaggacatattttctagaacaaaactaagacatgaactggactgatggaacatttagtttgaatttctggtctctagtaaatggttcaaactctctgtgcctcagttgtctttttagtaaattgaagaggattaggattctttcctgataggaaattttaaccatgtgagaaatttttttatattacttcgacatgagagaaataggtttactgtaaatataggattgttattttttcccaatggttctgtgaactcaattaagagataatctagtatataccctgtgtgcactgacatttattttatcctttctcatgagagccaaaggacagacacagttaatccaatcatggcaaatgaataaacttcctccacagcccaggccagacatttctcatgctttgtctagctgtctctaattttctgtttgattttctaccactcacatgcaagatagagggttgctttggcagaaattaaatgtgcaaaaatgttttaccatctgctggaatattcttggatgttatccttccagtagcactcattattaaaaatatttattggacatgaacaatatatcaaattctgctcaaaatatggctgcctcacagttactgctcaaacaagaatgaaaaaaaatcacatgattttaaaataatgattgcattagttctgtccctgaattttgctgctcttgacactatttttctcgtctgaggaagagtggtactatttttcccctccgaggaagaggaagttatttaaggcaagaattgcgtttctcttatttaaaatatgaacagcccttaacacagtgcatgttagtagaggctaaaaatgttgattcactgataaatttgtaaagcctgttttaccacctaaattgccagtttctcaaggggcaatgacaggatttactatctcttaggtatgtgaacatctgttagtttttggttttgtattttattttcaatgcccagaatctgacgctgtagtctaggtttagaaaaacacccactataaaagctgaaacaccagatacttgtttttcccagcctcccttgcagctagggtactggcagacaacctagttagatcaattaggagctaataatgttaagaataaagtactgtgtagaatttatttgcagcagaaacatttgacattacaggagtggcagtggtagcagagttaataatgaaggctgtagtggccagtgttcatagaagtggcagaaatcctttttccaaatccttcatagttctcattgttttccaagccttattttatgactttgtaggtaattatctagccctgagatacattcaatgaattatcttctgctgaaattaggcaggacaatttctgtggcttccatgttaagaaacctagctgatgtattgggcttattctgaagcctcttcaacatagagttttagtcaacatcctatagtccatttacccaacatcattttgtgttccacccatggaaaattctacattctgttgtatttttaactgtttttatgcattagtctttcctgtcccatgatattataaagaacttgcaagcagaaatcacattatccttctttttaacctcagagtcatacaggattctttaaaaagagtacatgttgaatacatactttactgattgatatcaggtaaataacatcagaacaatagtcattagcactgtgggtatatgactcaataaaaagatagatgccatttttttctagaccaagatagagaatacatgagttgcttaaaattaaaattcagtgccatataagaggaacaaaagatttttactgagttcaaactgctttgaatttaatttagtcaaatcaatttttgtaactagacagtcttaaaatggagactaattgtaggtgtagccttcaggctaaaattagacaaaataagaataaaaggatggattttcaatgtcgttggtctaatgtcagcattagattaatgataatagtgcatgttctacccctttctttatttcttcttttcctgccccaaacacaatcacataactaagtcagaggaaattggtttgagattgagtgtcaaagggattcaagaaaggattgagggatagaacttgatgcaggggaaaatctctgaaaatgtggccttggctatggaaatgggcctgggaactgagctgtatgtttcagggagggaactttggtagttggtggtgggaggtggtgtagagaactgcttgtgtcagagcacaaaagattatatctgtatttaaataattagaatctgattctacagatttcagtgttatgatgaatcaatatcaagcagttccttctgttattcattaattcaacaaccatttatggaagatcttttttctgtcatgcattgctctaggctctagaccgagaatagtgagtgagacagataaaatcctgagcccaaggagcatatattctagtaagagagatagataaaaagccatcaaggaggcagaaatatattctaggtattagacagtgataagtgctataaagaaaaataaagtaggatagggagatagagggtgatagtgctgcaattttaggcagggttgtcagaaaagtttttctctgaggtggttacatttgggaagagacttcaaatgaggaagtaggccgggcatggtggctcacacctgtaatcccagcactttgggaggctgaggcgggcggatcatgaggtcaggagattgagaccatcctggctaacgcgatgaaaccctgtctctactaaaaatacaaaaaattagctgggtgtggtggtgggcgcctgtagtcccagctactcggaaggctgaggtaggagaatggtgtgaacctgggaggcagagcttgcagtgagctgagatcgcgccactgcattccagcctaggcgacagagccagactccgtctcaaaaaaaaaaaaaaaaaaaaatggtgggggagtaatccaataaaacatctaggaagaggaaaaaacaagagaaaagtccctgaggcatggttgtactggacttgcttgaagaaaagcaaggaggctagtttacctggcgctgactaaaccagtggaagaatcataggagatgaggtaggaaagtgtattgaacactgtgatgcactgaccagattccccttcaacgaataaattgttgctccagctgttaagagtgctatgggcagacaaacatcagctgtcaggccttccagggactgccccagctgctaagaaccacctcaaccaaggtcttgccccttttgggggcagcctacacccaaacactgatcagtgagggagtataaaaggccaacatcttgacctaactcaggacaactccaaagagccattccagcttcagagcttgccatgaagttggcgaaaactattgtgcctaaatctcagtttgccctctccctctgcccactcttcctttgttttcctcccttccgcagatgtcgattccaagggcgttccttaataaaaactctgccctctaaactccagagggataattcaacctgcttcaacaatgaggtaggtgattggatttcattgaaagtgttatggaaagactgtggggttctgagcagaggagtcatgtaatctaatttatattttacagaaattacttggctgctgtaaactacaggaggaaaagagagaaagttgggaaggtattgaagtaatccaggcaaaaggtgatgatgacttagactagagaagcattgatggaagtgatgagaaatgagtaggttcaacatgttttccgaaaggagagctgaaaggatcaagcaatgttctttaactcgtcaaagacgctataaaactcaacaattagcatcagaaacaaaagagtcaattaaaaacatggccattttacaaggattagtgttgtttaaaatggacaaaagcattaatataagtcaagtcatctcttatattcataatctaaatgctttgtttatgtcacagaaacaaatatcgctggattacctggtagagtgcccagttagtgctggtgggctatgcactctttatatcaggagttagcaaattacagcccacgagataaatccagcctgctgcatgttttcatgtggcccatatcctaagaatgatttttatatttttaaatggttaaaaaaatcaaaacaagaataatattttataacacatagaaattatatgaaattcaaattgcagcatccatataaaagttttattggcacataaccaagctcatttgtttatgtatagtcaatggctactttcatgttataagagcagagttgtgtaactatgacagaaaccatgtggcccacaaagcataaaatatttactaactggcctttagaaaaagtttgctgacctctaatttatctcagagaagtacagcctggtgaaatgcccagttaatgctggtggggctggtggcctgttcacttactctaactttgttcctgctagataccagtgtgatgagcaatcattcagggtcagtttgtttaggaagggcctacaaaattctggctttttccatggttccttttgtttgtttcaaggtctattgtgataccatggctgttagcagtttcttgtgataaaacatgggcttgagacctcttcaactgtccttgtaactttcaactaatcatatccatggtgcagcatgcagtgacgaataaaagcaaatgacaaatatttcagtaccattttccacaactttctatgtgctccaatttctccttgttctccttgttttccccctgccccagcaatttggacttgacatttaagcttgatcttccaagtattgatccttaatattctctatggattttgcctcatacttgcctttatgttcttccgctcgtagctatcctagaggaagctctagactggctttggccccaggactcaatcctagtactgcccttcctaaaggactctcccttccaccagagtctgccttaccagttggttgtttttccactgtgctcccactgttgctccatggtcatcttctctcctctttgcatgaacacactctgcacccagcttcactttaccccatctccttcctttgagctcttctttgcatccactcttaattaatgctcttctctcttgaccagagcactatatcaatgaagagaggcctcttgggcttctaagggtgcaggaaccacatcttttgccaggagacccatcaatttacttactttaattataacaagaaccgtagttattacaacttacatttattgagcgtatatctctgtctctgatggtgcttgtattaggctggtagagctgccataacaaaataccacagactggatggcttaaacaatagaaatttatttttctcagtttgggaagctggagttccaagatcaagatgctggtagggttggtttctggtaaggcctctcttcctggcttgcaaatggctgctttcttgctgtggactcacatggccttttctctgtgcatgtacaatactggtgtctctttgtcctcttatgaggactagtctgattggattagggctccaactttatgacctcatttaaccttaattacctccctaaaggccttatgtacaaatacagtcatattgggtgttagggcttcaacatatgaattttagggtacacaattcaggccataacagtgcattacaaactttacttacaatgtctcatttatttctctcaacagttgcatgaggtaggtgggtgctcttatcattcccattttacatatgcagaaactgagattcgttttggacaaggttacatttgtggtacctttggtagatttcatgctgaatctcaggtctgatgaaacccacagctcactcctttaatcttttctgtatatggcctctcaaagattacctagctattttaaaggatttacagaagttaactctaattcactggataactctttttctttcattggttatgaacaacttagcgacctctaggactatttagtcagaaacccttgctgcccacatgatctgcaaggcctatactgccttaggctgattgtggaggagtcctggaagacagtggaagtcaattcaatgtaaggatgttaacactggggctgtagctgtgtgcaggattctgtggttcgattttgtagcattctggtaaaaggactatttgacaagcttccatgattttaagtaagaagaaaaatgtgtgtgtgcgttgtgagggagtgagggtgggtgggtgagtgtgtgtaaatgtggcagcaggaagggtggaaggggaatgaaaatgaaaaataaattaatatttatggagcatcaattatgtactagaaaatctgctttgctaaactataacattttgtttcatccttgctaggcctgcttttttaattaaaatttttattgagataattgtagagtcacatgcacttgtaagaaataatagagagaccctgtatatttattttgtgtttgtgtgtgtgtatatatgcatgtgtttgtgtttagttctatacaattttattatacatgtaggtttatatccacaaccactgttaagacccagaagaaatagtttcatcaaggcaaggacaccttatgttctccttttataacatgcttacctcctttcctgtcgcaaaccccagcaaccattaatctgtcctccatttctaaaattttatcatttcaaaaatgttttataactggaatcatacagcatataatattttggaattgacttttctcgctcagaataggtccctgaagagtcatccaaattgccgcatgtatcaataattcattctttttgtcaataagcagtattccatgtatatacgtatcccagttggtttaaccattctctttttgatagctatctaggatgattccagtctgtgcctattactattaaagctgctattgacattcatgcacaggattttgtgtggatataagttttcatttctctggaacaaatgcctgagagtataattgcaggatccctctaggtgaaggaagagagtttggggcccagagcgacaaagaaacttcttgtatggggccaattgctagagttccctattgctggttcttttcacccacttcagcatctctcggtggggtgagggagtctaaggcatgactgaaatggagagcacttctcctggctgcttattgttggtagggctccttgttgatctcccttgcgggagttgccaggtcaggggtagggaaactccaagtctgagttgccttctcttccattgagtgggggcacatgagacactgtgcttctgggttgtccctccagtgttgtagtctcagaggggttcatcttcgcatcacctttcagatatctcctttagttgtctcttttataatttcaggggcttaatgaggagaagcaaggcaaaaggggtctatggagtcttgcctagacaggaagtctaagtctaagtaaagagataggaaattcaggacagaaaaagtctgagcaattggcaatgggtgtgttcactgtcctttattgtctagtcagaacaatgttatagagcagtgacccttactggttttagccttttgcatgtgacagttttcctagttttcatatatctagatcaccattctcacacctttgattatggggtggacgtggagtgggtaggcagacaatagaaggttaatcttcacactgggcatctgtttcaaagccaagattcatgccccttttataatttctttgagaacagaaatgattgggtatgataagacccaaccataactctatggccttattgaggtggatcagtgggcaggtcatccttccctgttctttagaaccaacactgaacatcaagctggcacaagctttggacaaaaaaacctgtcagaggcgttgcaagcattacatgttccatttgttgcgagagcatgaaagtttacctttctgagaaaggagcactcagaattttgttggactaatttaataagttacacaattttgtatgtccgtctttttcttgagagacagaagactaataaatctatgatagaggtcagggcactttcaggttctatagtagaattcgtgtaagaatcttgggaacaatgatcgtaagagtattataaggtaagtattattttctctattttacagatgatggagctctatctcagcaaacataagtgatttaacctctggttaataagggacaagagaatccacctactttgaatcctagtgatgattcaaaagcccatgctgttccttcaatttagttaaacttttattcagtgtaatgtcttgtgttaagatccgaggaaaaaataaggagtcagacatggtcgctactttccagggaatcacaatctagtgggtaccacggactctttgctttaactttattcacaccccatccccagcctttcttgttttgtccatccaatagtaattaaagctaacccctttacctatcatatgctggccttagctaagaaatgtcccattgtaaattttcaaattctgtgattttttttctgtttctttcttcaattttcctttaggtgaaagttacattgatacagacacaagcgaaaaatttgatggccaataggggacatgatccattttccagtgtaaggaatctattactatcttttatatctgatgtcttaaaaacgatagcaatgattgtgtttccgttaaaaaaatcgtttttacatgatttccttaataagtgacataaatagcgcttatttaaatgggagcttaatgggaagctttcataacagattaaatatttcaatgttcaaaaatgtaaattttatccataataagaaaaaagtatttcttactttttgcatcatcactctcttaccctgctatggtaaatattttgtctcttttaacttcatttagatgtggcagcagggagagaaggaagactccaactataaaacttttatagtcaaggacatctagttagaatcttagctctgccattcacttgctatatgaccttaggcaagtgacatagccttgccgaacattagtgtctttattaagaaaaggcatgggagaaaatcaaggtgtcagcaggactccctctggaggctctaggggagaattcattcctttcctcttctagcttctggtggctgccagcattccttggtgttctttggctggtggccacatcattctaatctctgcctctgtcatcacattgccttcttttgtaatctccttctgcgggtctcttataaagacattaacacgggccgggcatggtggctcacgcctgtaatcccagcactttcggaggctgaggcaggcaaatcacctgaggtcgggtgttcgagaccagcctgaccaacatggagaaaccccatctctactaaaagtacaaaattatctgggcgtggtggtgcatgcctgtaatcccagatacttgggaggctgaggcaggagaattgcttgaacccgggaggtggaagttgtggtgagccgagatcacgccattgcactccagcctgggcaacaaaagcgaaactccatctcaaaaaaaaaaaaaaaaagacactaaaattgtatttatggttcacctggataatcgaagataatctccttatctcaaaagccttaactacaacttcaagacctttttgcttataaggtaacatttacctgttccagggattaagacttgatatcttcaagtggccattattcagcctactacaggatccatttaggtaaagcttagtggggtatgtctatgtattttcacagtcattttcttgtgcagttgttactagccatcctgatagaataatataatcctacttcccatgatgctaatttatctctcactgtaacatgaaggttaaggatcatattgtgatatgaacttgtcctttggaacttggaagcatgagtataaaggtaggtagtggaggacaagcaaatataggcagccagaaactgatctgtgaaaaataattataaatatcacagtgtatctatgaaagaaattcgatagagatttttgtaaatttggcaatcctaataatgcacctgtcattgtcaataacaggttgtaaagtggaaagaaacttcctaaactatggatttttaacaaatttccatcatttgcgctagaaaaaaggctgaattatctttctgttttccgtatagaaaatattataaaagattaaggaatatgcagtcaaaatgtagaaaataatgtacaatacaggtgtatcaggcagttaattcatcaaaaatattagttaatttttagaaatgttcatggtatctgccaggttttaaagattttgtaatttgttgtgttttctcattctaaataaaaattaacttttgcagttgattttgtatgtatcttctaaaatggctccccagaattgttcaaattttaggtacaataaaacctagaagagctcaggccctctcccgaatgctctgtggttcaggcatgctctcttgggagtgagtgaaaggacagtttctcatatgcataaaggggagctgcctcaggagacagagctcttcaacaatgacaagaagtcagttttatttacaactcggcaaagctggcaacacagagcagttgctctccagctacttgtctggggtatcttcctgaacttggtgcttctcccaagtgtggccaaaaaaccaaatacttatggtgatttgttgaatgagggatgtgcagtgcattcatccattctttgcacatgctcatctctttccctggaccaaggtagaccatcagagatgtgtgtggatgtccttggcaaattgctcttcctgggttatatttatatggtggcaccaaggggagtgtaagaaacttccctttgaacctgtttctgtatttactgtagggatgctgttgaggaagttgtccattatattcctgtttatgagaatccaggggagacatttctctctggctcttttgagtatcaagtctgatttttattgtatggatgttgtaagacatgtgcctggttttgtctctcacatctcacatctctagtgaaacaatgaggacttagaacacgcatttggggtatcaatataacccctggctctatctcaactacttttattttctcctttaccctgcttttcttctttgcttcttattagtttttatcttatataattaaatgtatttatgtaagccaccctaaaatcagtatgcaacaatgtggccagaaataaataatcatttaaaaaccatgttaagtgattaaaaaaacaataaaacatctaaagcacatttcccctcaaggcattattaattacctgatatttctgcacaggccttttgcgaacaggtcagaaccatatttagtgaaaaaggatccaggttttattaatgaaactttagatattttcagcagaaaagaaaaaaatatttttttccccattcacttttttcttttcccctttgcattatattgttcatttaagggtacagaggttctctgaagcccccagttcttttttatttaagtagatttagtcaaattacacataacaaagacgacaaaggcctttctaatcttcagtgctttctgctcctgggaaaactcaggccttgtgttcttgtttccctttcctgagtcagcgcttggctagtccaaggctatggggctccaggtcagacagttagaaataagcatagagagatagaaaaaacaacagcccatagtttaaatttgaaaaggagccttgctctttaggtggcagcataactttgttgttaacacaattctggagagaaggactagggctatgggatgtcaagaacatgaaaaacatggtgtttctttaaccccacttaaattaattgtgatgctaaactacagagtgggataatacccctctggctgaagagataccgaaaatatataggtaagattataaagtactaaggttattttatgtacctgagtctgaatccctgtttcttattctccaaggaaaagttttctagtcttttgctgatagtgacataagctttataagtcttttaattctgatagtcttatttttttttccatgtttgtttttagccctggtgaaaatagtctctagttaatggttaatatagtttttagattacttccaactaagatataatttgattatttttttcctttgtaggacaggaaaaggtgcagtaacctttcttacccatcataaaaatcacagccaacactcttgtaacaaaagataggttaacaagagaaaagcataacaaatgtatttaatcaaaattttacataacaaggaagccttcagaaatgaagacacaaagactcagggaaaattgtctacttttattcttagttttcatgaagaatggacaaccatgtagaaatatgattccacacaaaaaatgtatgatctaatggcaatagacggagtgggaaacccattaagtcctgcttgtttggcttctccttgacctctgtgtagcattcctttctcccaggtatggggcaggacccctctggaataaggatcttatgacctgctatcagacaaggtaggtcagagaatttctttatggccagctcctactgttgtgccagacctactgactccaatagggatagcaccatgtcctagaagcggaagaagagaggagacccggaaccagcagatgacacatagggtttactgaggacttacatatggggcagtacagtggtggtgggctggactgaaaacctgctaccaccctccacctaacaacctccatataacccaaaacaaaggaccttaatcccctatatggcctgcattccaaggcatgggccagggggtcatatgtccttcatagacaaggagcgaatctctaggtttgccactcctggatttcttagctcagaactccaaacacacattcttcttagacttgagggtctttctcagggtatgcttaagttattgctgtcagatgcatctgctatacacctacacagaaaggtgggggatagagtggctttgcttctgaggcattccaatctcctttagttcaaagtactcagcacactaaagtgccataatttggcatgtcattttctgagccctgacaccttcattactgttattgccaaaatttcttgcctcatcaacatggccaatttttaattacatagctacattagattcaccttgtaatttatttttgacctggtggccatctgatttagagtttaggtagtaatattttatttcaggatttatgaatcagttttctatttgtcatctccctgactgtcgaagttcttatgaccttgacatggcattattttatgtacttccccaggctgaaactccatcttatacaccattctccactttatgatttcctgtctgtttctatatcctgtctactggccattcacaggaacacttcaaatcaatgttcgctttgtggacctatgcaaattaccatcccattttcttgacaatctctgctcatgcagcacccattcatgatggtttcttgtctgccttttcctgggctgccttagagcttttccaagttcacatcctatattaaataaaaggaatataaaattaaaatcccaatacaaatcatccaaactaaacatctaccaatgaacttgcaggactgttttacttagagtatcatttctgcttcaggatcgctccatctttgattcattaaatgtgtttaagcaataattgctacattagaatcttttccttttggttgctctgttgtaaggctctagaagttatgtacactatgtgtaaatcatgctgcacatgcattctctttctttaccccaatccccataatctcagtgtaccacattaacaaaagcatcctaaaaaggaatccaagaaaaatgttacacatcatttgatcagtaaagaccgtattatacagtcaaagggacattaaaacaaacaacagcaatgcttaacatgctgagcacttacaaggtgctaggcatgtacaaagcaatttgcatatagtttaactaatctaataacaaccttaaaagtgtgtaattatagaaatacagaaacatatggttcttgttctccactctagaggggaaaaggccagctggctggctcctagaggaattcactacctttgtgaatttcttgagaaccaggacctggctctcagtctcatagccctaaacacctgatcagcttagtgaatgtggattcatctctcaggggtgaatcataagccaagaaggaatcaccatcagacaaacccagtactcaaacccacatgctcagcatatgcatcagtcaggggctcaacaggagacagatggcatgctgaaattaggatatttgagggagggcttaataaagggagttatttattaataatacaaaagtgtgggcaggattagaaaaaccatacaggatagtatggaactgaaagctagtaaaaatttctctgtttccacctaggcttaagaatggtagcccattctctaggcctaaaggaaagaggagaggaagcagtttcaatgagagagtcttggggtgagagggccaccttgacaagagctgcaatctttagtcaaagaattcagccagcccaaagcaaccttacagggagggaattgtgagaattaatggcctgaaatcacttttcgtctccagccacgaggtagggctttctattggtgaagtccaacaagaagccacaaggcaagactttttttaaggcagtctatacaggtcagcttcctggagtaaagggcagggtagaaagggtagagggtaaatatggacaggcaaagggaagtctttcagcattgaatatcttctccttaagccaaacctgggtcagaacccacttcacaaattcatcatgaataattaccacattaggggtaggaatccttaaagttaatgtagtcggcccattgcccactataggcagactatgtgagaggccagatcatatttagaaatttattggcaagcatggactcaagggaaactaggagaatggagtgatttatgatgtcaacccctggggactggaatgctaaaagctataaagccctgtggtgtctattgctacataacaaactactataaaacttagtgacttaaaacaataaacaagtatttttaataattccgtgggctatctgggtgttttttttggggtctggcaacttctttgaggctggatggtctaggatggcctcacttagaggtatgaggcctcaggtaggatggttggacagctgaggactctctacatgtaggttctcattctccaggagattggcccaggcctgttcgtgtgatgtaggaataattcgcagaagcagagaaggtaaccccactatgtgagcactattcaaacctctgcttatttatatttgctaatatcccattggccaaagcaaatcacatggccaaacccagatacacgggtggaggaacagactccacctcttgatgagaggaccttcaaaatattgtggctttttttttttttttccaatttaccacacctgtaactccacattagcaatggtctatcctgttgaacaggaaacactcaaagtttcttcgcttatactctttctccctaacccagtgcttaggcaattgtattttgtgatgttctgctatgtttctatggttgattacaacccctactgtgattgcagttgctaccagttcttacagccattctgtgttttgagagctattgggccatgagtcattgtgttgatgcttaagcttaattctcaaacataattttattttccttgtttctgatttttaggagactcttacatttagtccccaagtattaataatatgcattattattctcattttacatattgtgggattaggaacacagaccgtagaggttggatcagaatcctagtctaatagaatccacagcctgctctctctctctctctctctctctctctatatatatatatatatatatatatatatatttatatacagttgcttcttaaaatttacgtgaaaacactttctaaatataaaggagcattgtcatcatcatcactcttattaggattgtcagtattattgagagtagagccccccccccagtccacagtgaggtaacagcattacagcagacaatttcatccttcttttttttttctcctgagccagcaataagcacttcataaaacttacataaaaatcagtcttgattagaaggttctgagttaatggttttccattctattaaattgccacttattcttttaaattagctgtcatttcaatagggaagccaattggttgagcaaccaggctatagggtgtacagattaagccatctgtagagcaagcatgtttcatgctcccattatattccatataaaggacaagaacaggcccatagtttgctgaatacttagtccctgcgttccagagaattactgtccagtttagggccatcaaattaaatttcattatgagttacctgagtcaatattcctctatattcaaataaattgtaggtctcttagtggcaggaattgagatgtatacttcttttgtgtagcacctaacacataaggcacatattaagtgtctgagaatattgttgattgatgtattgactgaaggctgagagaagttatgagtaggggttgatggggaatagtggctccttctataaaatactattgggtaaacattaatcctttggatcaggaaagaattaggtttgcctgcactaatggatgcccaaatcagagtagcttgcaaaatatagggagtttacttttatttcacataccattaaatttagcagtagacaataaagaggtgtggaggctttgtggatgacatcagtgacaccatctccttgggtttttctgctgcatcatctcaagcacaagtatttacaacatgcattatcaatttatcagcatcttacaacgcatattttgggaaatgttaatctaaatgaaatctttcattttgcaaaatcaacagaatttaattcagcaaatatttattgaacaaacactatatgtcaaaaaactgtttttgaagcccaggaaaaggatagagaaggaaatcaagatcctaagaggtgaagcaacttgaaagttgacacatcaaatgaatggactgagacaaggctagagtctgaagcatgttcccttcttttaacaaacatgaccaagcctcaaagaattacacagggcaggctttcaggcgttattataataattctcccttttcaggttagtaaatgtggctcagagatagtgagtaacttgccctaggtcacccaactatccagatattgaacagaaactttttcctgactcatgtgaccccagatttcttaattttttactatagcatgtttgttgttttcctatttcatctttgacacagcaaaatatagaaactgcttcaggtatgggaggtggcaggcttaaaggagttcagttcttaagtttcaggttagttccttgtcctagcagggagctcatgcaggaacatggaaacagaggcttagacattcatgaggtcagtgagctggccatctttgatggcagttggcccacacattaggctgtaccctgcccatctgaggttactgcagaagccagatgtgttagtgtcagactatttcaacattcctattgtcgagacagagagagaaagaaagagagagagagagagagagagagtcttcaatgcaagacccagacatcatttccttaagccctgggcagggctgaacttgccagatgtatacagcagtggcttccatgagttttccgacacttctttcatcatcctttcattccttactatatactgtctttgttgtacatgccttttacatcccatccaccaccaaatactttctaagatttcttctttagatacgtattttgaagtgtttcctttttcttttccattaccagtcttcaatgatgcattctaagattaccatcgtggagagatcaaacaggagactgtcaccagactctcacattccagtctctttctctgtcctcccggaaaaatctttaaaccttatgctatttctatgttcaaaatgtcatatataatacctagcctatattaacatcctttaccaaatgtggcaaagactcctagtgtcttatccataattcttctcctcttattttttcatttaaaaagccctagttttgttcaggttagcaaggtacctggttaaaacaataacaacaacaaaaacattacatttgtaatacttccttgaaaatatggattgcctacccattacagtaagaagaaaacactggatgagctcctagaaaaatctatttaaatagggctaacttagctaggaaagctagactgtggacttgactgatattccagcaaccatcttgtaattatgagaagaatggaattcatgcactaaggagcagaaagatagaaggcacttgtctctgaggacttcatggagctgccatgacatctctgaattctagaattatttttgctagagaaataagtctaagccaaatataggcattttctgactaacctcaataatccatcatagaaaataagacatgatacatgaaaatgctaatgatgtctagttcccattattttaaatgagaaaaatcatgggtttaaaggtcaacgaaaaccatctgaccaatttcttgaaacaaaactaaaacacagtaaattgccaatatgcaaataacaattgtgttgatttgtaaaatactcaaaatatcactttctaatatacaaacaatcaatactgttgttaacaaacaattggaccttccacttgcagccaaaattgagtaaggagtaccagattcactgaaccaaccaaaacaaccaaaaaagtacacaaaaatatatgaaacaacagtttttaagacattagacatcatgtaaaaaaggacagtgattcctgagatctgagaaacaaatgaggtaaaccctaccattggcccagcttactaacttcaaataaattccaggctgaagtacagagaagaggaactgaggcagagccagaaaaattccctgagttgaggagatgtggctgaagatctggcaagaatcaatgacctcagcttcaaccttaagaaactggaaaaatacgagcattatcaaaagtaaacataagaaaaaaaataataaagttcagacaaaaaaatggactagaaaagagaaaaacaatagaaaaataatcataaaactattagttggtttttggagaaaatcaataaaattgataaaactcttgccaggttgatcaggaaaaagagctagagctagaggtggaggtagagagagacagaaagaaagagaagacaaattatcaacatcaggaatgagagaaatgatagcactatagattctatagataaagaacgttatgaactactttatgcaaataaatttgataaattagaataaatagacacattttttgaaaggaacaaactaccaaaactcacaaagaaatagataatttaaatagccatatatctattttaaatatgtagtaaaaactcttctcacaaaaaatcctcagaagtagatgccttcattggagagttctaccaaacatgtaagtaagaaataacaattcttcacaaactctttcacaaaatgggtgaccataaacaagtatacaagaaaatgctcaacctgattagtcattagggaaataaaaattagaaccacaatgagaagtatctcatactccatactatgctccatacatattagcatagcccaaattaaaagatagaccaggccaggcatgatggctcatgcctgtaatgccagcactttggaagtcctgagacgggaggatcacctgagcccagtagtttgagaccagcctgggcaacataatgagaaaccctgtctctacaaacaaaacaaaatgaaaaaacaaccattagccaggtgtggtggcacatgcctgtattcccagctatttgggaggctgaggtgggaagatcacttaaaatcagtagtctgaggctacagtgagctatgatcacactactgcactccagcccaggtgacagagtgagtgagacccacccccgccagccccctcctctctctctctctctctcctctctctctctctctctatacatatatataatatatgtatatgtatatatgtatatatacatatacatatatacacatatatatacacacacatatatattttatatatatatatatatatattacttctggtgggaatttaaaatggtacaaccacattggaaaacattttttgttgttgctgttatttgaatagctttaaaggtactagtagtttttggctacatggatgaattgtatagcagtgaaatctcagcttttagtgtacccatcaccccattggtgtacgttggactcaacaggtgatttttcatctctcgaccccccaccctccccacttctgagcctccaatgtccattacactattctgtatgcctttgcaaacccatagcttacctcccacttataagtgagaatatgcggtattttgttttccattcccgagttactttaattaggataatggcctctagctccacccaagttgctgcaaaatacatgattttattcttttttatagctgagtagtattccatggtgtgtgtgtgtgtgtgtatgtatatatatatatatcacattttctttagccactcatctgttgatgggcacttaggttgatttcatatctctgcaattgtgaaatgtgctatgataaacatatgtgtgtaggtgtctttttgatataatgacttattttcctttgcgtggatacccagtagtgggattgatgaattgaatggtagatctactttagttctttgagaaatttctattctgttttccatagaggttatactactaatttacattcctacaagcagtgtataaatactgccttttcaccacagctgcaccaatatctattgttttttgactttttaataatggccattctggctgggataaggtggtatctcattgtggttttaatttgcaatggaaaacatttttgatgggtttttaaaaaaagttaaatatacacctagccatatgacccagcattttacaataggtatttacccaagggaaaaataagagtatatgattatgcaaatacttgtataggtagatcataggagcttttttttttcataatagccagaaaccagatataacccagatgtccatcagctggtgagttaaataatcaattatgaagtatttatataatggaatactactcagcagtaaaatggaatgaactattgatatacagtgaatctcaaaataaatatgctgagtgacagaagctggacaaaaaagtgtatattagtatatatcgtatgattctatttacataacattctacaaaaggcaatttaatttatagtgatagataacagatcaacgcttttccaggtagggaggtttggagctgtgagggaaatgagggagttattctaaaggaacacaaggagactttcaaagtgatgaacatttttattgttttgattgtggttttggtttcatgtatgtcaaaattaccaaatagtatactttaaacagttgcaggttatcatatgccaactatatctcaatagagttgttttttagaaagcaattgttttattttcagtttctcaacttttcctagcatcagtagcatgatagctttacatcccctttgtcatctcttttcaaaatgtctgcttcacatattatgacattttaccaattgtatttggaatgtttcttgaaacttccctgacacattattttgttttaaaatgttacaaatgtttagatgttagaaattgtcttaatataatttttactatagaaatataaggcaaaaaatgatctacaaatgcaaggtataatacttacatttataacttgggttcagcagaaagcagagctgaggcttctggagctatttgcttgcactttattagggatacaattctggggagcaggagagaaacaaagagagtggagcagctaaaggagaacaaatacacaattgtgctgttgaacttactgttgctaagtgcagcagaatgctagatttgtgaaactcggcctccaagaagctatctctataaagtacattcaaggactctactgggggcaatatgtggacaaaaaggaaggatttatccactggttcctgtttcccactggccaaaggtttactccacaggatattaatttgtctatacttctggattatgtaggccagggtgagggcacagggcagtgaaccaaaaagagaggctttaggagcaggcaggaggcgatgacactctctgcttgggactgtgtaaagaaaagccctcattgagctgcctgccaccacaaaagctgaaaaaataaagaaagaaagaaagaaagaagaaaaaaagaaaaataaaaagaaaaaagggaaaaaagcgtgaagctaagaaagaggatctgaaatgatgcagcagagatatctgaaacatgtatgttctatagctattaagaacagcagtaagcctaaaacaaagttttttttctatgtcctaggtatcatatgcaacctatagctcatcctatttgacatatgtatcctactaatttgttttacgtgagtacactcttaatcatgcttgtggcactcatctctgaggtacactaaatttacttggatcacttttataaaccattgacatctgtgctccatcacacagcaatcaaaacagaacacctgagatgggctgagtatcactatttgtaaagacttccaagtgatcctaatgtgtagccagggtagagaatcattgaatcacttcagtctcccaggtgtccactgtatgttccatgtttttaccaattccaaatactattcacaccttcactacttaatagaatgctactttctttctctaagttctacccattattcagagttcattttaaatcttatctcacctacatatcttttcctaaccattttatccttcatggtttttcccttatttgactccatcatctgtattagcaaagcatcttctatatccaccttagcagtctgtagtaaaacccttttttatttctttcccaacttaattgctttcctcttaccttcaacttttggaatcctcaatgttaacacacacatgttctcaacacaaagatttcaggataagattcccctgaaaattgtgttagttctgtttattttgaacaagttcaatggggccaacagattttaagatggtccaataatctctgcttttgtaagtccatgtccttgtataatcctttccccttgaatgtaggtgaaatctgtgacttgcttctgaccaaaaaaatatggcaaaggtgataagatgtcattcccatgattatgtttcattatataaggctccatcttattaacagtctccttcaattactggttttgaagaagtttctatgaattctacagtcacaaagaatacaccctgggagaacttggaagtaaataattcctcacttaagcctctgatgagaacccggtctggctgatactttgattccagcctcgtgaaaccctaagcagaggaccaagttaagcagtgctctgactttggacttactaaaaccaggatattacatgtgtgctgctttaagccattaagtttgtagtaatttgggacatagcaataaaaaattaatacatactttggtactagaaatgggatgctttttatctgaagtggaattctgttgtaaaatacctaaaaatgtaagagtagctttagaattgggtgggtgcacactggaagaatttggagaacaacggagaaagtataaattgccttgagtggactgttagtggaaatctaaaattgaagcatgctcctggtaagggtgagagctcagaagaagtgaggaataagccattgaaaactggaggaaagagaaactcttgctaagtagaagaaaactcagaattgtctcctgcatttatatgtaaagcagaacgtgtaagtgatgaacctgtttatctagttaaggaaatttacaaaagaagtattgaaggtgctatctcgtttcttcttgttgcttacaataaaatgtgagaagagagaaataaatcaaaagaagaacaaaaatgaacaagaacttgatgattttgaaaatccagtctcttcaaatggcaaaaagttaatggctgaaattaagatggcttggtctagagaaaaatttgaccatatgactctacaacttttcactaaaagttcagaaaaatcaaaatatcagaatattcagccacacaaaggacgctttcaagagattaagggagtggctcacaaatcttaatctgtagggctttcgtgctctggtataatcccttccccttgaatgttggtggaatccgtgatttgcttctaaccagtagaatattggaaaggtgatagattaccactcctatgattgtgttctgttatataagactccattttgctagtagtctcattttcttcattgctggctttgaagaagaaagctttcatgaatcctacacatacaaggaaatgaattctgccaacctaagggagcttgaaagtagatccttcttcagtcaagcttctgatgagaactcagtcctgataaacatcttgattggagctttgagagacactaagcagaggcccccactaagtcgtgcccagactcctgacccacaagaactgtgagataataagcattaattaagttattaaagttgtggtaatttgttatgcagaactagaaaactaatacagtctgactatttattgctatattttagtcaccatttctagtcactaagcaagaggtaaattatgagattatagttgccttccacttttagacatttattttcatttctgtcttatccacaatctgcacatgtggacattgagagttgaagccaaatttcctgacccttagagcactggttcttaaattttagtgtgcatcaaaatcacctgaaaagcttgtgaagatacagattgctgggccccagccctagagtttttgattcagtagatctagagtggggcccaagaatctgcacatttagtaagttctcaggtgatgctactgctgctagtccaggaccaatactttgagaaccacttctatggaccatctttaccatagttctttctgtggcctccatgatattcatttctgcaatttactctgcctctcttctcatgatgattaatattgtaagctgctggaatttctaggttttggctggcagttgccatggcaacacacacagcgttgcccagtgcctgaggccctgagtgaggatggcaccagatgaatcactggaataagtgacttgcaaggggcacagacatttttccctgagttgtccatttccttctgtgacccttattcttggtcttttctttttttggtaatgtcttttttgagaccccctccagattcttctctatgtaatgtaataataacaaaaccttagattcatgtcattcttcacatttataaaacaagcaataccctttccagcacaaaatcaaattttatttgcataacaaccttgtgaggtgtgttgtataggtcttattattcccattgacaaatacttaatgtaaggctcaaaaacattcagaaataactgatatccaaagttacataaggtagagagtggcagagccaagtctggaggccagaactcctgatttctagctcagagcttgtatcacccagggccctagcaagaaacaaatttcacagtcaaaaggataactgaagagagattaacgaagggaacccatgagtgatggtgacataccccagcctagcaagtagcctggagggtcaataggatagagtggttagtaaaacctggaaagagatatagctacaggtgtagctgcaggaggacacccaacaaaaaagctgtggcctttagtggaggaatgcagtcactgccaacccaaagcctataaggaagggtgccagagcagtaaacaacacaacttctctccccaggttatgagggaggcttaagatgaagtagagacattttgacttaccactgtctgattaggtcattgcaggtttctgaacagggagcaatacatgaaaatgaggccctaggaaaactggactggcagcaccatgcagggctggttggagggagaagctggagctatggagatcaatcaaaaggatgctacagagcttagaacatttccatttctgtccacactgaagtgggtctgaacaaaacgggcaaaggcagacatgaatgttatggaagggtgttatgcccccatccctagggcatctttgtttgaaggaaatatcccactatacatgcatactcaatattgatcttaaagcctttcaggatttaactggggtatgactggtcttttggccttggtttgggttctggaaaagcagactcagagatagggattcaagtataagtagcttattaaggaggtgcagggaacaccagcagggaaataataagtgagggaggcaaaccaagaaaggggtattactaaatcagctatcacagtcagtgactgccacttaagaccaagagtaaattccaggaactagtgtaaaatgcatacctcagaatcattccacttgagcggtgaaggagttgaaacatttgtataccaactcctaagcatcattggttaaggcacgctcccgggaagcaataattcctgacacttccagcctgccacaaacaaaggcagaattaccttctgtggttctggaaacagcttcctgatgcagaaatgcagacactggcagttggaagtcattctgagcacaacgaactggacatgggtggagcattgacaatacctgccacattttcatttgcaggattgtgttcatcagcactacagtctctacccacttgatacagcacctaccctgccatgtccacatggaattcaacttgctcatgcacaaaatcaagccagcacaattgttttgaaagttatagcattgttggataaataccataatgggcagcggaatttgtagtaaaacacaggaggtaaattttggtaatttttaaaggtttcagaggagagaaaagacatattaccaaatggccaggggatcaaggtagctaacatatctgtttttggctaacaggtgatctgtccctgggattcaggtgtcaacccaaaagaaaaacacaataaggaaatgcaagtacccatgaaaaagaactcatcctgcattgcacagcatatctgtttatcgtcttgaactggctgcaaaagatacctaattgctcttacttcgctcaaaaataaaagcttcaaagtgctgtcattttccactgagtttcagaacagctgatcatctcatgcactcgctctgtacttagaccacactaagtttgcatctctcaattcagccaggacatctgtcctgctctgcatcagagccctcagcatgatcttgaatctacacagacacaaggcaaaaaaaaaaaaaaaaaaaaaaaaaaaagaggcagagagaagcattttctgtgccacactgtgctgaattatttactcccagctctgggattcagagagctagtgctttctcagccttgaattttattgcaatacaaagaaataaaataagtaaataaggagagagaggaagtaaatcccttggagacctactggcatatgaaatatcttttgaaatggagcttgatgctgaaataattgtgtcatttagagtgcaatactaatatgctcacaactatggctaaatgctggagcaaagaacaattttgcagcaataaatgtgtggccatttgtttaagcagaaaaaaaaatgaacctaaaatttgaatggatttatttaattaagcattggcaaatttagacattgactacaaaacaatgccttcaagcattatgtgcaaaacaataagtacaggtaatggaaattagggtatgtttatttcatctgagatcggaatgagaaaaaggaatacagtatggtcgggaggtatttgtatggccataaaagagagaaatccgcctcgtttcacgatatgtgtcacagacagggattgtgaacattctcaatgtattctaaaggggctgtaatcatgtaatcacataaatataaagtaactttatttttgtctcccactactcctttacatatttcagaaggaaatttcttcccagcctctaggcaaaatcctgccccaccgcccccaccccctccatttctttcctggggtgcttaagtattaaaaaattcctatggtctctttaagtccaaagtacattctctttttagtgattatcagtagctataatctccaggttcgtgtaatgctcaaaactttgaacattacttgctactctgataggaagcctggagaaggggaagggcaggagagacacggtcagcttttcctctggaggaaaagaaatagtgcttctttgtcttcctcctccagctgctcaccttgttcctcactcctcctgcaccagtgtgcagggagagagaaatatacagagaaagaaagcatgttgtaactggaatgcttatgaacaccatccatttagtggcctggttggcatacaattctgactcttcctcatggatgcagttgtgatgttttcggagatccttttccacaccaaatattggggacctctcacttccagatgtcttgcccttgattgatggactctctcctgtttcacctttgcactgttttcttagtctctagctgtccccttgggttcactgttagctcttttctctggagatcttttcacttgtccaagtgagccctcctggctagtccctaaattgattttatgctcgtttattctgtttctgtccctcgctgtctctggctctctctctctctctcctctctttttctctctttcttttacacacatacatacacacttgtccaattctgtttcacaggaaacacttaaacatttatgcattattttctccaataaatttcaggatgttggtcaatcccaatgcagccacccatcagagcagccagtctatccatttcagttatgacgtagacattaatccactgcgtctgcccctcaaatcttgggtaacaaatattaccttaaagcccctctcttttgacttgaggtaaaaagagaggcaccttccgaccttctaaacagagcttgctcaaatacattacatctaaaaaatctttctccaaaccccgaccctcaaccatttttgctcatgtgttgggtgagagtcataaaactcataaaattcataacattggtgtttggtcatttctttctggaaatcctataggaaagcctatctcacaagtcactttggtatctggtatctattagtgtctcagcagaaatttctattttaacatccaattatgaaataaaaagtgtgaggaggctaattttctctcagtcaacccttggaagtgcccacagacttagcaataaggaaatccttggctgctatttttaggtctgcagagggcttcagaaccatgttttactgaagggtagtgcgttaacactatttattagaaaaccaccatgtgcccccaagatagttataatgtgtaaaatgctattttccttttttttccccagaaaaagaactggaggtacagacaaataaagtgactggtctagagacattaatgagctgttagaacttgagaaacaactccattattgtatggtcagctaactggttaagtctgttaacagacatgtggcataatttaatctaataattttttctattcctcaggcctataggttgaggttgatctgaaagataggactatttgtgatccagaatcaaaagagtcaagaaaagtctgagaatttcatccttggagcagaaagtgaaagtgttctggagccaaaagtagtaacaaagatggagggcaagaga

SEQ ID NO: 4494 - DNA, 24728 bp, human; identical to SEQ ID NO: 3357

SEQ ID NO: 4495 - DNA, 23704 bp, human; identical to SEQ ID NO: 3358

SEQ ID NO: 4496 - DNA, 153737 bp, human; identical to SEQ ID NO: 3369

SEQ ID NO: 4497 - DNA, 881 bp, human
atgacggggctgtacgagctggtgtggcgggtgctgcacgcgctgctctgtctgcaccgcacgctcacctcctggctccgcgttcggttcggcacctggaactggatctggcggcgctgctgccgagccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtattttcaaaagaaataattccagattgatggatgaaattttaaaacaacagcaagaacttctgggcctagattgttcaaaatactcaccagaatttgcaaatagtaatgacaaagacgatcaagttttaaattgccatttggcagtgaaggtgctgtctccggaagatggaaaagcagatattgtaagagctgctcaggacttttgccagttagtggcccagaagcaaaagagacccacagatttggatgtagatacgttaggcagtttacttagttcaaatggttgtcctgatcctgatttagtattgaagttcggtcctgtggacagcacattaggctttcttccctggcacatcagattgactgagattgtctctttgccttcccacctaaacatcagttatgaggactttttctctgcccttcgtcaatatgcagcctgtgaacagcgtctgggaaagta

SEQ ID NO: 4498 - DNA, 47949 bp, human
tgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactggtaagccactgccgcggacgtctcccgtgggcctgggtccccagatcgttcttctgcgaatgagcaattatcgagcgccgcttgtgtgcctgacacctggccctctcacctaaatctttttcctttaaattattaagctggatgcttcctctgtgccccgcccttgtcgcccccctccgccccttaaaccttgatggatccagggagcaattatcaggcacctgctgcgtacctgttccctactacccctcccccaaaagtctttggcttcaatatatcctatgagccttcgaaaaccgaacgtgtccttcctaccctccccaacccttgccccataggccttgtcctctaatggatcttgtgagcacttatctagtacctgcagtatgcctcatccaagagcccttccccaaggcctttgatttcaatgaggtttgtgagcattctttgagagcctgatactgtcctgttctcctcaacccttgccctgaggccttctctaatgggtcttgtgagcatgtgtccagtctatgctatgtgtcccaccccagctccgtccttaaagcccttttaaactatttagtaaacattgagtacctgctgtgtatcccaccccagcttctctccaaaagctttgcctttcatggatcctgtgagttttgattggatgccttctctgtgccccaactccaagccctctctctgagggccttttctccaaaggatctaggaagcatttgttaagtgcctgatacgtgccgcacccccaaaccccttctcaaacaaatcattttcctccagtgagttccatgagcagttttgaaccttctttgtgtgactcatcttcagaccgtctcctcaaagacctttccctacagtggatctagaaaacatttattgagtgcctcttgtatcccccgttctccagctacttcttcaaagacctttcctttggtggatccatctagcatttatcaactgcctgcagtgtgagccttctctaaaagttctttcctccagtgtattcagcaagcatgcattgactggtgcctgctgtataccccaccctcaaaccctttctgcaataccctttcctccagtggcttcagtctgcatgtattgagcactttctgcatgacccaaccttagacctctccataaaggcctgtgcctccagttaatacagtgctcagatatctggcacttgctgtgtgtaccattccagtcactctttccaaagaccttttcttttaatcactccttggagtatttatggagcacctgctgtgtacctgattgtgtgccttcttcacaaaagccttttctcctatggatgaagaatcgagctcccatagatcaactttctgcactcccatttcccctccccataggacttttccttcagggatgcagtgagccttgatcaggtgactatatgtccatccccagccccactccccaaaggccttttcttctaatggatccagtgagcatttattccttgtctgtcatgtgctccattttaatcatcctcccccaaagaccttttcttccaatggctcccctgagcatttatggagtgtcttctgtgtgttctgtatattcacacctcctccccagaattgttttcttaacagtagatccagtgagcacatatgcaggacctgttgttttggggagtacattcttcttccttacccctaggagagcctgttccaatcacaaggcctctcccaaggtcctttcctgtgataaatccagagctgagtttataatgatcacccctttcccactcccttcagtacccctaggattccctctaccaactttaattcatacccccaaagggcttttagtctatttaagtaacacttacttaagtaaacacttttacttaatagttttactattgacttaatttactaaataaatttagtaaatttactaaatttactatttacttaatagttttactatttaagtaaacacttattgagcacttactgtataagtcactttcaacttcctctttccaagtctctggaaatccctgaccctgcctcaagagctctctctctaggggtctacttcagcctaaatgtattgagtaccagctgtttactggttagattacctctcccccaggagcctttaccgagtagcctttctctccattcagagcaatttattcattctgcagatatttattgcatcctttccatgaaagtgtgggaggcatttattatgcaccattatatactaggaataacccttcttcagctccccttccttcttttttttctaaatgcaggtgtgcttgaaatcctcacctgccagctggccttgctataccttttcctccatgcaaccccacaatcatttaatgagcatttatcgtatactactgagaaccctgcgttaaatgcctcttctcccctttttgtagtcccaattcccccttcaacaatctccatcctgccttttacacaacacaatcctgaaagctcacaatgtgcactgttttccatttattctagctaggcctcttcctccacttagtagccatctccccagctgcctttttctccccgaattagtccagaaaacacttattaatctcttactgtattattttcaaacagccacattatcatccctgcagcaggcttctccgcttttttctctatcaatctgtaaagcatttatggagcacgtgctgtaattccttcaccaacgtccactcaccaacgtgttatcttcctggttaagtttgctccattgaagtcagcaaacatcaatgaggcctctgctggatataggtaatcaccctcctttagacttccggtctccactccagccctccatgcaggtcctttgcgtctgcttccttctttccatcaagcatttattatctatggaatactgacaagtcccttcccctttccataatcacaaattcaatgttttccattttttctttgtccagaaaacatttattgagcacctgctgaattcagtgaaagatccatcccttccccttctgcatctcagaagcccccctttatcccagcatcccctccagtcttttcttccaggcaatctagcaaatatttatttagtgtctactatatgtggggtggggtggacaaagggacagagcctatgtatgtacgccaggctcagtgtggggaacagagacctgttttaccaacttgcagacactcagaaccacactagcttcagggatttcagccccaaataaagcaggagttgtgcaaactctgtgatggaatgtacaccgaaatacagtctgacgccttttccaccaaacctcaccaccctcattccttcctgggtctcaattcctctgtggtttaaagttgaaaactctaagttgagactcatctcccccattttgtgggtaattttgtcctgtgtttttctttctttttttttttttgagacggagtcttgctctgtcgcccaggctggagtgcaatggcacgatctcggctcactgcaacctccgtctcctgggttcaagcgagcctcctgagtagctgggactacaggcacatgccactatgcctggctaatttttgtatttttcgtagagatggggtttcaccatgttggtcaggctggtctcaaacttctgacctcgtgatccacccacctcggcctcccagagtgctgggattacaggcttgagccaccgtgcccggctctctggtgtttctcaaactatgggtcacctattggcttatgaccagcatttcactttcttcttgaagtaggataaataaaaatagagaataacagagcatattgcacatagtaaatggagttgttgtttagcaaaacatataatgttattccattaagatatacaatctgtaatgtatattatatatgacatacggtatgtaatacatgtgttatacaatggctttacagtacataatacatctatatgtatatgttcttcttcatgaaatgaaataaaatagcatagaaaaatcagactgcattacacatagtaaaggtaattatctattgaaactttaattccagttatgcatatgtatttatatacattctaaatacatatacacataatatgtaatatacaacattttatatgttacataatatataagacattctatattctcatatttgctgtacaacatatgtgtcttatataatacatatataggatgagttattatgcaaatacatatatagtgggttatataagctttatttcttactgtggcttcttttctcagatatatttccctggaagcagaccccgagactctgagatttgcatgcagatttactggggagagcgcttgggaataacacctgtgggggaggttgtgagggaagcaggattgtgcagagggaaaagttgagctgtgatgcaaccacaaaagaggcctcggccaatcctctggggagctctggcactggaatgacccttcagagttgtcccagttgaagcggggtggccaggctttgaattcctatgtcagtcattggctgtaggctgccccctgggaggaggcgtaatcttgggtgaggcaaatccctgttgcagaggccaatgcccagtgagggacacctatgagccatcagcagcggataattccagaagctgaggatagatgcaaaggtctggaacaaggaggtaaggatctggggggagcatatagtccacaccttgcactgctccgatccacttccttcttatagtaagttcaccccattggggaacggcatttccagaattctaatcggtcttgttttctcagggacacttgaaagagcacggtagtgagatgagccatagtctctgctgctgcagttgatttcaacgtcataaatgatattcatcctctccttcttttgttacccattctagattccccccaccctcagctagcaccactcttggtctgggtggctcccatcctgcagagatccctgagcctttggtccccatgcccttctcaggctgtagctgctgtacaaacaaccacatttcccatttactatcaaagttgagcaaggagtaccaacagatgcccaagtggatcccctgggtgccagacatactcctccctgcctccactgtgtaccagcagctctacctcctcctgaggagcaaggttggtcacgtcccctgccaagacaatggctcctttttatgtcccttggcatgagaaacacgaagtgccctgagggcaatcatagcttacagtttaatgggattcttgctgtgtcccctggtagcagtgttcccccttggagaaccaggacctctaaccttgcagagccctgagggaacaggaagcacaatttcaaaagtggatcactgggattgctggtaagctgggccactccttcctaacctctgtgtccccaaaccggtgtattctacctgttaggaacacagcacctacaatggccattgatttagggttgacactgttttggaggatggtgcccattcttgcatgatctcaccttcaacctgggatcttagctgtggctgcaccaaattgttccatcattccatcaggccagcagctcccgggtggcgtggtgtgtaataccatcagttaattccatggtcatgggcccacttttgcacctcctttgctttgcattcctttactttgctataaagtgtgtcctttggtttgacgcagtgttatgcagggtctcgtgctggtggatcaaacgttatgtaagcccttagacagtgagctggctgaggtcctgcagtaagaaaaggcaaactcaaatatggaatattccagtcaaaatcgattactgttctttgcaggatggaaggggcccaatctaatcagcttgccacaaagtggttggttggccttctggagggatggtggcgtgtcagggattcaatgttagtctctgttgctggcagattggacattcagcagtaacactgctgcccccacacatagcttctctctctgctgctattgccacttattcatgtgcccatctgctaacactggggtggctgattagagcctggctgacatcatcgggctgactcatgctgtctacctggttgcctagtgtcacttccatggcgccatggcagatgctgtctggtgggtgttaacacacgatccaaagatcctcgctcctccctttttttttttttttttttttttttggagacggagtctcgctctattgcccaggctggtgctgtggcacgatcttggctcagtgcaacctccacctcccaggttgaagcaattcccctgcctcagcctcccgagtagctgggattacaggcgtgcgccaccacgcccggctaatttttgtatttttagtagagatggggtttcaccacattggctaagctggtcttgaactcctgacctcaggtaatccgcccacctcggcctcccaaagtgctgggattacaggcgtgagccaccgcgcccagtctcactcctcatttcttgcccactcctaggtgtctgcccacatttctgtatcccagacctctttgtctggatcttccagtctttttatttccaggcccctgaccaaccagccaaaccatttaccactgcccataagtggatatatgtattctaatcttgaggcacttctctttctgcacaaaggagatgagcaggtgcacagcctgaagctctgcccactgggagctctgccactgtctttcaaggccattccagttgggttatagtgcaaccactgcccatttttggcttccacccacatactaagacaaccaatttgtgaaccaagcttagacctttccctctttcatcagctagttttaaggagtccccttagtgagacaggcactagcacaacagtgtggaagacatggggatcagggttacttacctgctcatgcaccttgcttggttctgcttgggctcaatcctgactgctgggcccacctgactttattatttggcgggcccagcaggacccagcttataatgggaacttctggatgcacaatcatttggtgcctggtcaagcattctgtctctatcagggcccagcacctcaatggggtgtctttctcaaaaggcgtaaaattctctgctgcagatggcatggctttgctccagaaccccaagggcctcccactcaggcttcccataagctcctcactgcatctttccccactactgacacctccagtatcataagatctgccagatcatctggcctaaatggcaggactgcttgtaccacagcctggacctgctgcagagcccttttctgctctggccctcacacaaagctggtagctttacatgtcgcctggaatatgggtcagagcattatttgtgtgtgggggacatgctgcctccagaatgggaagaggcctcctaggtattgtgctttcctcttcatggtggaaggtgcgtgattcaatgctttgctctattctttggaggggctgtcctggtttactgccctggaccactggattcctaaaaattttactaatgcatcggtcccctgagtctttgtggagtttatcctccaccctctgtagtggatgtgtcttaccagggcaatatgctcaccctctcttgctcatcttgcacaatcagtatgatgtaatccatgtggtggtccagtgtgctattccatgggatgtccagatagtccaggtttctctggactatattatgacaccaggtgagagagatagcatagccctacagcaagaccatctatgaatattatcatcagtctcatgtgagtgtaaactgtttctgatccttttttctaatcagaataaaaaagaatgcatttgccaagtcagcagccacctgctgtacctgaggtcttattaatctgctctggcaatgacagcgtgtccagtatggcaggtataactaagggtactacttgattgtgcttgcagtaatctgcaagcattctccaggacccatctgacctctccaggggccagactgctcaactcgatggagataagatgagaccaacacccctgcatcctttagatctttcaatgtggcattgatttccatcatcacccataggatgcacacaatattgtttgtggtttattgttttgttcagggcatgggggtgtgcgccattttagaagcttctatttggacttccctactgaaacagctcttatcccacaggctgaggagcccatgtaggggttctgacaactacaaagtatgccattgcaattacgcatttgtgaactgaggaagtgaccactgggtgggtctctagacccaccagacccactgtaagcaggacctgggccaggactcatttatcaccttaccactactgtgcttctcagcgtgactggtaccaccctcaccagcatgtttcttattaatttcataagttgagtgtatcctccaggccttaatcagctggtgggttttccagacttcagtagtatatctactccaacatgtctgcttctttgagccctttaatccttccctgtgcaatctgccatggaagttctgcttcacttagtgtgggccattgtttactccaggtttccaaataccagtgtgttagtaacacttcctagagtcctcgccagggttttaagttccgtatcctgggagagcacaccaacttcctgttctacctccttcgcccattgtcctcaggatccagtctcatgcataccttcccagctcctgccaatacgtactagccagattctttaggttcttctacagatcatttctctccctttgcaagcctagaacctgtccagtcaggtttcactaggatttcaccctaatttttggtctggtttccaggagggtaggtggggggtagactctgaggggggcaggcattgtcttacaaagcacctgcatcatccgaggcctctgcattatcttcaagcagaaggtctatattctaactcaggggagtagtctacttcagcaggcccagtggatgcaggtgagtctgtaagttcaaggtgtttaactgcatctgcccagatatccccatctcagagtcctactcctgtcctattagggacatgagcatggcccaggagatgtgctgggcctgagaagtcaactttctccgaagctccgccaccacgtagaattaaattctgagcctggccctcccttctgtctgccctctgactgcaggagatgagggtttccttaaatgcagtcagggagatcctctggctttcacattttgccttgaattcaccctgagcatgtcaggtctttcttcagctactcaatggcgtttagggaatagtcacccaagtctggttaccatttccctgacatcactcaagttccagggatatttcaccatccagtacattcccttccaccagaatcccattacagcccaccatcaggaaaagtcaccgctactccaaaaccctgggggcctgcgctgtattctcccacctgggagaagaaattccacacagcatcttttcctactactgacacctccagtgtcataggatctgctggatcatatggcctaagtcacatcctgcttgcaccacagcccggacctgctgcagagcactttgcgttgctacagcatatcggaggctatctatgccccacctcccactactgatgggtcctcactgccatctggctgctgggtaacccagctccagaattgcattagaccacccttgtagtttgacttccatggcccactgttttaggttgggttccctggaaaaagactttgaggtggagatttgcatgcaggaggcttactggagtgtgccattgggatcaacacttgtgaggagggttgggttgagcagaggaagaggctggctcaagatgtagttgccttaggggcctccgctgctcttagggggagccctggggctgggagggtccttcagagtcagcccagattgaggcaaggaggctggcctttctttcccttcatagaccagaccatggggatgccctcatgaagtaggtgtaaccttggacaaggcagttccctgtgacaagacaattcccagtggggacacagccatgagctgtcagtagctgccattcaaggtacattgtccctgaagaggaggcctgagcagaccaccacagtatccaactacacttatggtcagaaaagttttagaaacagtgatacaccctcatcatccccactcatcagtttatagatgaaaaatgtgcagggctgagagagattctctctcaacacttctgaggggatagtgtcagcgatggtgtgtgtgtgtgtgtgtgtgtgtgtgtgtgtgtcagagagagagcaaggaaaaagaagtagctgtacttggggtctcttgcatatgtcagtcaagtcaccagggtccatttgtgccgtgtgtgtgtgtgtgtgtgtgtgtgtgtgtgtgtgtctgtccaagaccctgattgtatgtgtgtcagtgaccagtagccctgaaagtgtctctccccctcatcccccttccatgataaacctgattgaggatgagcttccatccctggagcaagcagcctgttggctagaaatcttgagcctgggggaggaggccaccggaaaccaagcccagctggggacgggcccggggacaatgacatagcagttcgtgatgttcctactgctgctcccactccccctccctcctgttgctccctctcctcctcagctgcattcctccctgccccccatcattgccagctacactggcttctctagagccacccagcctgcaccactcaatccactcctccttatcggatgcagctgcccacctatggccattgtgtttctcacagcacacaaccacacatggtgaatgtgctcctccttgcgaaagggccagagagcagagagatgcttcaggccacacagccagacacaggcactgacatatacacaggcactaaaaaatacacaaaaacaggcacgcttcagagaaatgtagtttctttctctccttccttccttccttccccttccttccttccccttccttccttccttccttccttccttccttccttccttccttccttccttccttccttccttcctttctctttatttctttctcttttttgcctaggtcttgctctgttccccaagctggagtgcagtggtgcaatcacggctcactacagcctcgacctcctgggctcaagccattctcctgcctcagcctccccagtagctgggactacaggcatgcaccactatgcctggctagtttttgttttttgggttttttggagatggagtctcgctcttgttgcccaggctggagtgtaatagcaccattttggctcactgcaacttccgcctcctgggtccaagtgattctcctgcctcagcctcccaagtagctgggaatacaggcatgcaccactacacctggctaattttgtattttagtagagaaggggtttcaccatgttggtcaggctggtctcgaactcttgacctcaggtgatccacccgccttggcctctcaaagttgtgggattatagacgtgagccacagccctcggcttttgttttttttttttttttttcaattttttttgtagagatgggggtctctctatattgtccagggtggtctccaacccttggcctgaagcaatcctcctacctccagcctcccaaagtgctgagattacaggcgtaagccaccgtacctggccagataggtgttttctaaggttctttgctgtttaccggtctccatgcaatttcaaagtatgttctaatttacatagtgctgctaattttgtgaagtttttttaaaaaatttacaatgacaatgtgatgagcagactaaattttgggaaatacctgctctctgcagtgtaaggccacattttacagtttgcaatgtcctttaatatttttgcaactccatgaggattacaacagacattattcacaaagcactcttgattttttcaaaatatttcaataattataaggcactttgtggtttctttagtagcattgaaggggcaaaagggtcaagggcctgtgttttgtcttcccttctgagatttcatcattgacagatgtgttgtttttcctctccagggcaaaatacttcaaagggaaaaagatccatggagaaattgacattaaagtagaacaggtaagttgggacatttggacctgggggtcagttgtccatactgcaaactgagtggccatttttgtgtgatgtaggtgaatcaccagtttttttctccttcccaggccgaattctctgatctcaaccttgtggcccatgccaatggtggattctctgtggatatggaagttcttcggaatggggtgaaggtcgtgcggtgagtataagaagggtaccttggtgttatgagcaaggcataagaactctcccttagagctgggggaaagttcctacctccccacccatccttctgtgggcaagaacttaggcatggaatgtggggagacaacttttcttcagaaaaagagccagggaccccaggatgccacaagtcagactttaaaaaaaaatatatatatatatatatatatttcagacagggtcttgctctgtctcccaggctggagtgcactggcacaatcatggctctctgcagctgcaacctctcaggctcaagtgatcctcccacctcagcctcccaagtagctgagactacaggtgcgcaccaccatgcctagctaatttttatgttttttgtagagatggggggggtcctcactatgttgcccaggtttgtctcaaacttctgggctcaaacaatctacctgccttgtcctctcaaagtgctgggattacaggcatgagccgccacacccagccttcaattattaattaaataaacatttgctagacatctgctgcatgccagatgctgctctcaggacttcatattcaataaatatttattgtacacctactgtgtgccaggagatattctacatgctgaaaggccaaaaaaaaaaaaagaaaaagaacctgggccttatgaaacttacattctactgtgagatacacacaatacacaaataaataagaaaatgtaaaagtgctaagaaaaaacataacagtggccggatgtggtggctcatgcctataatcccagcactttgggaggccaaggtgggtggattgcttgagcccaggagttcaaaatcagcctggccaacatggtgaaaccccgtctctactaaaaataaaaaaattagccaggcgtggtggcaggtgcctgtaatcccagctactcgggaggctgaggcagggaaatcgcttgaacccgagaggcggagattacagtgagccatgattgctccagcgcctggacaacagagcaacagtccgtctcaacagaaaaaaaaaaaagaaaaaaatatatatatagcactaaagcagatgtagcaattgttggatgatggtggggtctgcagttgggatagggtggcctggttgcaggagagacatttgaggaaagacctgatggaggtgaaggagtgatccatgcagatatctaggggggaagtgctttaggcagatggaacagccttggtaaaggtcccaaggttagaatttattctgggcagaacactgaagacagcttgcagtctgagagatggtgaccagggagttgtcagagctgtgtcggtaagctgcaagctgaccttgctgagaagggaacaggtaggagaggcttaaaggggatcaccaggtgggcagagggtagaaagggtgcactaggcagagggaacagctcacacatgtgtgcagaggtgagaaaccactttgcaatttctgggagctatggagatttaaaaacttggtctttgtttcgagagtgattgggagcttctgggggaactctcaacactcctacccctgccacactaggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtggtaagtaacaggaagggtgccactggcagagggaacagctcatgcatgtatgtgggagcttgaaaccagtctgcgatttggggaagtgagggtgttcagaaacttacagattcgtggtgaaggactcactgacccagctctcctggttctcatagtttgcccagatggttcgactgcataagaaactggggacagaagaattccctctaattgatcagaccttctaccccaatcacaaagaaatggtgagtttggggaaaatagagtgggcaggagggaagagtcataactactgcaataatattaaatattggtatattatcagcagtgcgatatcaagagtgtggctgctgtgtgcacgtggagtcatgaagttgctttgtgatagggtctaccgtgaatttccttatgcttacaaggaaaactaaatcatgatccattctaatatgtatcagatcctgttactcatgttgtctatttttgccagtattaaaaacctatttctaatgtgaattgacagaattaatgtaatgaatcagaatatattacatatagaaattaagtcattattactaacattatcaaatattccttctgatagaaattttacctatattcaaattaggattgccaataacatttatcaataataatgttataaattaaattgttggcaaggcacggtggctcatgcctgtaatcccagcactttgagaggctgaggtgagcagatcatgaggtcaggagatcaagaccagcctggtcaacataatgagaccccgtctctactaaaaatacaaaaattagctgggcatggtggtgcgtgcctgtagtcccagctacttgggaggctgaggcaggagaatcacttgaacccgggagttggaggttgcagtgaccagagatcacgccactgcactccagcttgggcaacagagtcccacctcagcctccctcctattaattaattaatagaaattgaacttttggttactattatgaaatataatcactggccgggcgcggtggctcatgcctgtaatcccaacacttcgggaggccgaagtgggcggatcacctgaggtcgggagtttgagaccagcctgaccaacatggagaaaccctgtctctactaaaaaaatacaaaattagcccggcgtggtggtgcatgcctgtaatcccagctacctgggaagttgaggcaggggaatcgctggaacccgggaggcggaggttgtggtgagccaagatcacgctattacactccagcttgggcaacaagagcgaaactccatctcaaaaaaaaaaaaaaaaaatatatatatatatataatcactaatattacaaattatcactaatattataaattatttttactgttgtaaattatgagtacctatgtcatgaattaaattatagtttctagtagaaattgaataatcattactaatagcatcaaagattattgctgttattacaaatgattattgctattacaaattatgctctaatataaattataagtacctgttttgacttacataaacatggcatgcagtggagactaccacagttgggtcattgggctacaatgtgccagaataaaatatgctgaacgtttaaataatagaaattgaattatcattgctaatatcatcaaatataacaactaatattacaatgcattacagtgttacaaattaagtttattactataaatgattagtacttatgttgtaaattgttataattattttttaaaaatttaaacccaaagtgggaggatctcgtgagcccaggagtttgagaccagcctgggcaacatagcgagaccccatttctacaaaaaatttaaaaatcagcccggcatggtggcatacacctgtagtcccagctacttgggaagctgaggtgggaagattgcttgagccctggaggttgaggctgcagtgagccatgatagcaccaccgcatcccaacctgggcaacagagtgagaccctgtctcaaaacattaaataaataagtaaataaaattaaaccattagtacaaacagtgtaaaaatttttacagatataactattaccagtgttacaaattaagattactaatataacccatgagtacctgtgttttgaattatcttgtagttcctaatagaaataattactaatatggttaacattctaactgctattataaaaaaaatcactaatattaaaattttgattactaatataaattatgagtaccacagttatgaatcaaattttagttacaaatagaaattaaataattgttactaatgcaatcaaattgtataagtaattttgtcaatttttaccaatattacaaattatgtttactcatataaatgatcatcaccaattttatgactaaaattacaattaaatataaatattgacccaacactatcaacttgattaaataaacattgctactaatattagcaattcttaccagtactacaaattatgatcactgatatacgtcaacagtgttgtaagttaagtttacttacagataaagattgaatcattagtttttcttttttttttttgaggaggagtctcgctctgtcgccaggctggagtgcagtggcacaatctcagctcactgcagcctccgcctcctgggttcaagcgaatctcctgactcagcctcccgagtagctgggactacaggtgcgtgccaccacgcccagctactttttgtatttttagtagaaaaggggtttcaccatgttggccagcatggtctcaatctgcccgcctcggcctcccaaagtgctgggattacaggcatgaaccaccatgcccggcttgaatcattagttttaaggaaacccaatttgtttatcattattattagtctacattctttgagagacagtagagcagaatgtgattaagagcatggactctgtagccagaatttctgtataagaatcttacctccacaacttattagttgcttaacacaggaaaagttacttaaacgccctgtacctcagtttattcatctgcaaaatgtaggtaataatagttcccgcctcatatagttggtgtgagaatgaaattacttagtaaatgtaaggtgtctagaacaatgcatctggcatatattaactgctacctcagtgttgacaaatttctccttctattcttagttggttgagtatttttgtcgtgaaaggatgttggacattgtcaaatgcttcttctgtgtttattgacatgattgtgtgaattttgtcctttattctatgaatatggtatgtagtacattaattgattttcatgcaagttgatacgttcataagtttgtttatgatgtgtctaggtgtagacatttgcattcctaggctaaatctcacttggccttggtataaatcctttttgtatgttgtaggatttagtttgtgattattttgttaaggattattgtatctatattcgtaagagacattgctctgtagttttcttatgatgtctttttctggttttggtatcaggataatactggcctcatagaataagttggacagtgttccttcttctatttttgggaagattttgtgaagattggcattaattttttttctttttttgagacagggtcttgctgtgttgctcaggctggtcttgaacccctgggctcaagcgatcctcctgctttggcctaccaaaatgctaggattacaggtgtgagccaccatgcctggtcggtattaattctttttaaatgtttagtagaattcaccagtgaagacatctggtcctgggtatgtctttgtaggaagttttacttattcctaaatcaatctcttcacttgttataggtctattgagattttccatttcttactgagtcagtttttgtagtttgtgtctttctaggaatttgtccatttcatctaggttttctaacttactggcacataattgttcacagtactctcttatactctcttataatactttttatttctgtaaggtcagtagtatgtccactctttcattcctgattttagtaattagaattttctgcccttttttattcttagtctaaaggtttatcaattttattgatcttttcaaagaaccaaatttttgttttattagttctctatttttaaaattctttatgtcatttatttctactcttattatgtttttccttgtgcttgctttggacttagtttgctcttttctttctaatttcctagaaaaaaatggaagattaggttactgattttgatatctttcttctttttagatataggcagttacaactatgaattctcctttaagcaccactttaactgcatcccttacattttgatatgttgtgtgttcattttcattcatctcaaagtatcttctaatttcacttgtgatttcttctttgacctattggttatttaggagtgtgttactttccacatatttgtaaatttttcaaattttcttctgtttttgatgtctaatttcattccattgtggtcagagaacatattttgtataatttcagtccttttcaatttactgagatttgttttctggcttaacatatagtctgtcctgaagaatgttccatgtgcactgaagaagaatgtgtattctgccattgtagggtgaagtgttctatagatgtttatgaggtctaattggtttatagcatttttcaaatcttccttattggccatgcacagtagctcacacctctaattccagcaccttgggagtctgaggcgggtggattgcttgagtgcaggagttcaagaccatcctgggctacatggcaaaaccccaactctgcaaaaaatacacatgcacacacaaaaagccacatggtggcacacgcctatagtcccagctactcaggaggctgaagtgggaggatcacttgagcccagaaagtggaggttgcagtgagctgagattgcaccactgcactccagtctgagtgagaccacgtctccaaaaaaaaaaaaaacttcctttttggttccctgtctagttgttttacccatttctttaaatgagatattgaagtcttcagctataattgttgaattgtctatttctgtctccaattctgcctgtttttatttcatatattttgtgctgtgttgttaggtgcacatatacttattattgttaaatcttcttgatggattgaccatttatgcttataaaatatttttctttatctcaagtaacaattgctgttttaaattctattttacctcatattagtatagctattccagctctcttttggctattgtttgcatggtaaatctttttccatccatttactttcaacttatttgggtctttgaatctaaaatgtgcctcttacagatagcatataattaagtcacgtttttcatccactgtgcctattaaccctttaccgtttgtgctgagaacactctctgatggcacttgcggctgcagtgtttaccctgagataactttgccacaaactgtctcatttttattattattttcacatcactctagtatatcgactttggaaacaaaagacatcattctatttatagcattctgtttttaggagtggtatttccacttacaaaatatagtaattctcaatcattgaaaatgtcaaatcctagaaaatgtaacatccctacaaatgatgttaacatcgttcttgaacagtcgttggatgaagaatcatttgatgaatctgatttttccaaaatagatggttctgatgattcagatgattctgatgattcagatgattctgatgttagttcagcttagaaataactccaagaatagtttttatattttgttttgacattgaaaatcagttagctttgcttcagcctcaaagagcatgtttatataaaatctagtgagcacaggcagcaagctgcacgtttttttttcctaaacaggaaaagggttaatcgcagtgtttaattaacttatgttattgtaattcctgataaggtagggtttatgtttgcaattttgctatttgttttctatatcttattttttgttcctgtattcctctagtaatgccttcttttaagttaaacagatattttctagtgtaccatttttaatttttctgttatttcttccctatgtcttttattcatttttttaatttaaaaaatttttatttttttttgatacagggtcttgctctgtcacccaggccagagtgccatggtaggaacatggctcattgcagcctcaacctcctgggctcaagctaccctcctgcctcagcctcctgaatagctgggaccacaggcatgtgctatcatgctcagctaatttttagttttttattttttatttatttatttatttatttattttgagacaaagtctcactctgtcacccaggctggagtgcagtggcacgatctcggctcactgcaacctccacctcctgggttcaagcaattctcctgcctcagccttcttagtagctgggactacaggtgcctgccaccacacccagctaatttttttgtattttaattgaggcggggtttcaccatgttggccaggctggtctcgaactcctgaccttgtgatctgcccaccttggcttcccaaagtactgggattacaggcgtgtgccaccgcacctggccaatttttaatttttttgtagagacaggaccttgccatgttgcccatgctggtctcaaactcctgagctcaagttacccaccttggcctcccaaagtgttgtgattacaggcatgagccactgcacttagcctgttttttttttttcttagttgtttccttgggtattacaattaacatcattatttatattactccaattagaattaataccaaattaagctcagtaatacaaagaaattgcctctatataactttattccttcatccctcctttgtgctattattgtcaaacaaattacatctttacacattgtgtgcccatgaacatagttatagttattgctttatgcagttgtcttttaaatcaggagtaaaaaagtgttacacgcaaaaaaatgcatttatactgtcttttatatttacctatgtagttaactttacaggtgctatttatttctttatgtagatttacattactagctagtatcattttatttcaccctgaaggactccgtttagcattttttgtagaagtttgttagtgatgaactatctcagtttttgtttatctgtgaatgtcttaatttctccttcatttttgaaagataattttgctggatgtagaattcttgtttggcagtctttttctttcagtactttgaatatgttgtcctactgccctctgacttcaagatttctaatgagaaattagctgctaatcctattgaggattccttgtatatgatgagttacttctctcttactttcaagattctctctgtctttagcttttataagtttatgatgtgtctgggtgcctatctctttgaatttatcttagttggagttcagtgcacttcttgaatgcatagattaatgctttaaatcaaattggggggatttttagccattattccttcaaatagtctttcttgcacctttttttctctcttttctctctccttttgggacttccattatgtgggtgttcatatgcttcatggtgttccacagacctctaggactgtgttcattttgtttacttttcttcttcctgttcctcagattggatcatctcacctgacctgtcttcaaattcactgattctttaccctgccagctcaaagctactgttgatcccctctagtgaatttttcatttcagttattatgctttttatctccagaatttctttttttttttttttttgagatggagtttcactcctgtcacccaggctagagtgcaatggcacaatctcggctcactgcaacctccacctcccaggttcaagcaattctcgtgcctcagcctcccgagtagctgggattacaggcacacgccaccatgcctggataatttttgtatttttagttgagaggggggtttcaccgtattggccaggctggtctcaaactcctgacctcaggtgatccacccgcctcagtctcccaaagtgctgggattacaggcatgagccaccatgcccggcccagaatttctttttcatgtaatttctctttattgatactctctacttattaggatatcattttatcctttcctttaagttctttaaacatagtttcctttagttctttgaaaatattaaaaatcactgatttacagtttttgcctattaagtctaacatctgggtttcctcagggatagtgtttgactgcttttttccctgtgtttgggccacacttaattttgtttctttgcatctctcatacatttttgttgaaaactggacatttaaataatataatgtggcaactctgggaatcaggttctctcccctcctcaggatttgtttttattgctttgttttgtttttagtgaccttcctgaactaattctgtaaagcctgtgttctttgtcatatgtggctacccaagtctctgctccgttagcttagtggtcagctaatgattggacagatatttctttaaatcacctgaaaccagtaagtctcccagactttgctgatgggctctatgtgcatgtcagggtgtgcctttaatgcaaaggcaggctgtttacaactttgccttatccttcatttcctgcttgtgcagagttttgaggtcagccagagatcctaggcatacatacagccttatgcgtatttgtggttttctagattcccaggcatatgtcagagctttttaaagcctaataatggactgataatggatatataattacctagattttccttttaagttttcttgaaaagcttgttgttttttcctaaatgttatcactgctgtgttaaacagttgctgctaattgtttctgaaaagcacccccagagaaagctgtttataccagatgagccccatgagtggagtattcaggatagtgccagacagatcaaataaagacagttctctggaaatgagattttggaggaactccaaccctgttctgcctcctccaatggttgctagtctgctggttttcactggaattgcagggctgttgattttcaaggctcttgtggaggtgaggagaaggggatgtgtacaagagaagttcaaatgccacagcttcctgttgttaccaagattcagccattttcttgaaaaaatgctttctgaattgtaaaccttggtcaatttccagagttctgataagtttgttttgacaatttttgccagtgttctcattgcttttaagcaattttaaggaggagaagacaggctcttacatttctgctgacatcacctccaggcatatcttgttctttcccggccccagcccaaagataatagtatttcaaagccaagatctgggaactagatttactcattgctactggaatgttcttgcttcaaggccctctcattgtacacagctaggacatttcatttctttatgtatatatatataatttcatatatgtgtatatataaaattgttatatgtgtgtgagtagaagaatcaaactgttttttcttctgctctcacaataccatgtgtggaggcttttacacacacaccaagaagcaattaattctgcagcaaattaatataccagctggatgtcctgcaattcaattctgacactatctacctggaggatagcatcagatcacacaggttaagggtgtagtcccacaggactaagccctacttctaatgctgatggcaagccccaggttattttacctgtgcttctgaccaactagctataaatcggggtccacaaccccttcctcaggttcaattagtttgctagtgtggctcatggaactcagggaaacacttatttacatgatcggtttattgtaaagagtattacattacaaaggatacagatgaagagatgcagaggacgaagcatgtgggaaagagcacagagcttccatgccccacccccaggtagccaccctccaggaaccccacatgttcggctatccagaagctctccaactccatcctcttcagcccttcatggagacttcattgcataggcaggatttataactgtatagaaatgtgatgggacagccaggcgcagtggctcacacctgtaatcccagcactttgggaggctgaggcaggcggatcacctgaggtcgggagttctagaccagcctgaccaacatggagaaaccccgtacctactaaaaatacaaaattagccaggggcagtggcgcatgcctgtaatcccagctactcgagcggctgaggcaggagaattgcttgaaccaaggagacggaggttgcggtgagctgagatcacaccattgcactccagcctgggcaacaagagcgaaactctgtctcaaaaaaaaaaaaaaagaaaagaaaagaaagaaagaaatgtgatgggacaaaaagggtgtgatcttgtactaacagactgagtggggaaacccagcaaggcctgtctgttcagagccttagactctctctgcaacatcccttccttctgggtattgggcaggaccccttctaaaagggaggtctttttttttctttttcttttttttttttttgagacagagtctcactttgtcacccaactggagtgtggtggtgtggtcttggctcactgcagcctctgcctcccgggttcaagcaattctcttgcatcagcctcccaagtagctgggactacaggtgtgtgccaccacacccagctaattatttttgtatttttagtagagatggggttcaccatgttagccaggctggtcttgaactcctggcctcaggtgatccacttgcctctgcctcccaaagttctgggattacagacgtgagccactgcacccagccttttttttttttttgagatagagtccgtgactctgtcgcccaggctggagtgcagtggcgcaatcttggctcactgcaacctccgcctcctggactcaagcaaccttcccacctcagcctcctgagtagctggggccacaggtgcgtgccaccatgcctagctaattcttttgtattttttataagagattgggtttcaccatgttgctcaggctactctcaaactcctgagcctgagcgatctacctgccttggcctcccaaagtgctaggattacaggcatgagccaccacgcctggtaatgctgatttaattttatatttttaaatgtaagacgttagcgtggttctaaaagtcaaaatataaaaaaggcatccacagataaaatagaaaacctagatgaaaataagtaatttcctggggaaacacagtttaccaaaatcgaccccattagaggttaacaaaccaatttccataaaagaaatagagaaagtttttaaggaacttccccataaaaaatcatcaggcccagatgatttcacaggggaattccactgaaatgctagagactagttaatcccaatggccacataaattgttccacagaatggaaaatgaagacaaacttccatattacctttctaaagcaattataacattaatagcacaaagaaaagcatagacctggtgcagtggctcacggctataatcacagcatgttgggaggccagggcaggtggatcacttgagatcaggagttcgagaccagcctgaccaacatggtaaaaccccatctctactaaaaatataaaaattagctgggcgtggtggtgtgcgcctgtagtcccagctactccggaggctgaggcaggagaataacttgaacccaggaggcagaggttgagtgagctgagatcatgccactgcactccagcctgggtgatagagcgagactttgtctcaaaaaaaaaaaaaaagcatagaccatttttactataaatatcaatgcaaaaatcctaaataaaatattagcaaacaaattcaaaaccacattaagggtgagcacggtggcttacatcgtaatcccaacactttgggaggccaaggcagaaggatcacttgagcccaggagttcaagaccagcctggtcaacatggtgaaaccccatctctatcaaaaaaacaaaacaaaacaaaaaaaacacaaaattagccagacatggtggtgcacccttgtagtcccagctactcgggaggctgaggcgggaggatcacttaagtccaggagtttgaggctgcagtgagctatgatcccaccactgcactccagcctgggtgacagagcgagaccttgtctcaaaaaataaaaataaaaaagaatgcagtaacagcagcatatgaaatcaacatgcagaaatcagtagtttttatatacacaaataaccagatagaaggtataatagaagagaaaacatatacaataacaacaaaaaaaataagatattttgggataagatcaacaagggatgtgcaaagtgatatgaggaaaagtttaaaacactcctgaaagacacaaaggtagacttaggcagatggaaagacattccttgttctcgggtagaatgaattaacatcatgaaaatggcagttcaccttctcacgtccttatttaatttatatatttaatgtggttcccaaaaatatacctacaaacttatatctagagctaaatgagttgatagtaaagttcatatggaaaagcgaacatgcaagaaaaactaggaaaaccctgaaaaagaaaagtgataataaggactcatactcccagcccacagggagtctgatgcctctgccaccagacattttacgaagatttcatttatttatttatttatttatttatttatttatttgagacaaaatcttgctgtattgcccaggccggagtgcagtggcatgattgtagctcactgcagccccaacctcctgggttccagcaatccttctacctcagcctcctgagtagctataattacaggtgcatgtatagctaatttttttattgtttattttgtagaggcacggtcttgctatgttgcctaggttggtctcaaactcctggcctcaagtaatcctcctgctttggcctccccaaaactctgggattataggcatgagccgccatgtccagcctgaaacttttataatttaaatagtgtgatgctgacccatgaatagacaggctgacagattaaaggaagaaaaacaaaagtccagttatagatccatgtacatatggaactttagtgtatgatcaaagtagtgactcaagtcactagagcaaagagggactttttagtaaagtttcgtttttgccatctaaattcttcattcttctgaaattccttttcatatacagtgtgaaggaggtagggattgagttcatctttttccttataggtaagcccttgtcccccactgagcttgtatgccacctctgtcatatatatactaacttttttttttttttgagacagggtgtctctctgttgcccaggctggagtgcagtggcgcgatcttggctcactgcagcctccgcctcctgagttcaagcaattctcccacctcagcctcccaagtagctgggattacaggggcatcccaccacacccagctaatttttgcatttgtagtagagacggggtttcaccatgttggccaggctggtctcgaactcctgacttcaggtgatccacccgcctcggcctcccaaagtgctgggattataggtgtgagccaccgcgcccggcctatactaacatttcatatctctgtcctgcaggttcagaactctattctgttccattggccactttctgtaaacctgtaccaaagccatactaccttaacagcaacttttctcattaattcctggtgcctggtagggcagcagcacctcctggctgttttgtaactatgtagttctgacaagagtagaaacagaaagggaaccacgaagagtgggaacaggagctggagcagggcttgatagcagggaacatgcaggcagagcctgatggcccacgcctgtaatcccagcactttgggaggctgagctgggaggatcgcttgagcctaggagttccggaccagcctgggcaacatgatgaaaccccgtctctacaaaaaattagctgagcatggtggcatgtgcctgtagtcccagctacttagctggctgaggtgggaggatcacttgagcccaggaggttgaggttgcaatgaaccatgattgcaccactgcactccagctggggcaacagagtgagactctgtctcaaaaataaaataaaataaaataaaacattttacaaaagagtagggaatatgtagaaggaccaagggataggaagtaggcaacggggacaaggagcagggaataggaagaagaagtaggggagcaagaggcaggaagaacaggggtgagccacaacacaaaggggacgcctgtggctgcgggagtccctgagggactcactcaaggccccatcgcatcctttcctatagaaagtcaggaagccctttctgggctcctccctgagccccttccaaggatgcaccccccatctcgcagagtgcagacttctatccctcaaaggacctggagggacagaggccatgtcccaaggaccagtgtagcatgaccatatgtcccttggctaggacatgctatgatccccaagtctcaaagactcagaacactacggactggggacagaatttgctgtgacgggctgaagttgggaacatagtattgtgaggcgggggttcttcgtggggagaatgctccagggatggggactttttgttccagggtggtgcagagggagacctgagggtgaggagtccacacagggtggggacaggttggctggcctgccgttaggaatccctaaaggggaacctctcctcatggtgtcgccacagttgttgtgggtgggcgtgtagaaggatctaaccacattgctctttattttcaggtgcttctgtgagccacaggttcaggactccactaggaaactggattgtctgtgagggggaaaagagagagggacactgggactgaggaacatttatggcgtaaagagctgggatcttagtatcacatcaggagcttttgggtctcggagacctaccccattccttcaggcagagcagggtcaggagcttgtattttggtgaggagactggtgtgggggagaaatggacattaaattattggtactaatcatacacattatttccaatatcgtatattatcatgcctaatatcaaacattgtttgcaatattataaataatcactactaaagttataagttatagttatcataactacttctagtaactaatgcttgtaagtgctatatgcctagcactgttccaagtacttcacatatacaacctcatttaatatggacattgtctctatgagttaggccttctttttatccctgtcttacagatgcaggaactgaggctcaaagaggcaatatgatttattcaaggacacagagctaagacatggcaggggcaagatttgaatgcagatgatctggctccagggttcctgctttttttttttttttttttttgagacggagtctggctctgttgcccaggctggagtgcagtggcttgatctcagctcactgcaagctccgcctcccaggttcatgccattctcctgcctctcgagtagctgggactacaggcgcccaccaccatactcggctaattttttttttttttggtatttttagtagagacagggtttcaccttgttagccaggatggtctcgatctcctgacctcgtgatctgcccaccttggcctcccaaattgctgggattacaggcgtaagccaccatgcccggcctttttttttttttttttgagacagtcttgctctatcccccagcctggggtgcagtggcatgatctcagctccctgcaacttccgcctcctgggttcaaacgattcttgtgcctcagcctcccaagtaactgggaccacagggcatgcgccaccacagctggctaaattttgtatatttagtagagatggaaaccatgttggccaggctcgtcttgaactcctgacctcgtgatctgcccaccttggcctcccaaagtgctagtattacaggcgtcagccaccatgactgtcccatttcctgtgttttgacccccccaaaaatatccaaggggcaaagacaccccgtaaacatcctccaaccccaccacagacctctgaaggattctgggccaggactgtgacgtccatgtttaaacatggcgagaaggactgaggctcaggtgagagaaggactggccccccaggctccccactgagctgggtcccatgctgaataccacatggctgtgacccctacaagcttcctctcagctgtcacagagtctctcccagagattcacccacagacaccccgaatgctggggatggaggatgctcacttgacctattttaacagatgttctacaagagcaatgggggatgtaatgagcccagggttacagatcctgccaggagctcatgccaggtctctggtggaggtagcctcgtctgctgttctgggctctgtgtcccctgagacctgttctggtctccggtcctccctgtccattctgcattgcacttggcgaagggctgacctgcagggtagacaggtcggcaggagaacgacctccacgctgggttccatccttcccctgctacttcaccttccccctagggcttggaagagctgaggacttaggaaatgggccctgaggccagggagcagcttaagagtgcaggtagctgacactaaggtttggcgaattgccaggagcggtcagcctcttgcaggcagctgagggaacattgacaaggtcaccagggatgaaccagggctcgggcccttaccttacagttgtgcccatcagcaaaggctgcggttggccccttcggtggacaaggttcagaccctccgagggcgtaaccaaggtgtagatgttgatgtagaaattgttgctgcatgcgcattccctgcttaagtggctgagtactgtgtgttcaaaatctgcccattcccatccgggacataatttgggccgtggggtaacctcccaggagtgtaaaaggctctgggacaggaccacagaagatccagggggctgtgcttggtgacctagaatgccctggaggagacctgggttcttactggtaagagcagtgggtactctgatgagagggaatttgggggtccttttctttaccaaaggagatatattggggcccttttcaagcacgttcaggtcaggaggacacaggtgctccattgaatgtttgcaccagtctgaaattctagttcccaagggcctcacttgagtcaagacctttggagtatgaggggcaggagccagggactggaccccgctgtggaagcaggaaggcctcagaggggagtatttggaggttctctcactcagtttttctagagaaaggatgattcataaaggtgagggtcgagtctagagaccctagtttgggtgaggggacagttgggttgagggaggtgtgtggagggtatgggccagcatatctggctggtcttaattttgaaccctacctgcatttcattgctgtcagtatttccttccaagttggtcagaggagtgaggggagaagtaggggagggaggatggcagagcttggggatttttagctcataccttctctccatcccacctctcctctgccccaaacagtcccttccaaggaatgtcctgcagccatggctggggagccagggccaccccttcttcccaagtccccagctgggttactgtgggactctgggtgccctgggtcccctttcactcaagtcagactcatggtacaaaacctgaggatgaggacagtaacacccacgtgtttggatggggcatcctcactggacaacatcaggactgtgcttgaggcaatgatagtcatttgccaattggtagggcatttgtcaatgactctgtcagctggcaagatgtgtgaatggggaatttccagtaaggcagtgatttgtcagctgtgggataatttataactagaaagccctgggcaaatagcaattaggaatcagtataggaaaatgttttaaagtattggctggagaaattattcagaggttacggttgataatgcaggttcagtgaccattgctgctgttgcagatcatcagtgctaatgccaatgttgagaattactaccagtacatcagaatttaagtaaaatataaaaacccaacatttggcatccctcatccccactggtcccagggtgctcacaccaggtcatcagcaacatgggtttgttcccaggcactacacagaaacagtgtctgctgggtggtaactctttatttcattgtccggaagaaagatgggagtgggaacagggtggacactgtgcaggcttcagcttccactccgggcaggattcaggctatctgggaccgcagggactgccaggtgcacagccctggctcccgaggcaggcaggcaaggtgacgggactggaagcccttttcagagccttggaggagctggtccgtccacaagcaatgagtgccactctgcagtttgcaggggatggataaacagggaaacacctggaagggaggagggaaacatctctgagggcttctccctgcctcccccgtggagcagaacttcctctcctcagctttcaacactgagccgctggggagacttgctctcaccccacctaagtacataccccaggacagcccctcccattgagggaaatgtcactgggtcctgaaaggtaacagtaagccagtaaatcagtgtcctggaatggtggctggggaataggccctgggggtcagtcaggcaggtcgcctgtggaattgtcccaaaggacagggaaaaactggcagtagtaaggggccccacccggttggcggctaaggagtttaagcacaggaatagccagtggggcttcaagatagtcactgggctcagaggccatcaggagccatcagggaacaggcttggactagccaggaggtcagtgtaacaccctctggtgtctggaatagtcagagctgcagagcaacaagcagatgtgctgaggaagggtcagtgggattagggaacagcactttgggttcttggagaacattctggggaaccaagaaacaatcccgggggctcaggaacggggagtgggattacagaatagtcacaagggagaattagagggaccagggagggacaggtgatcacacggtattggacacagggaaagggagcagccagaatttgtaagggagcagtctcgggcttggggaaatagcaagagagatcagggacagcccttagggttggggagcagccacagggacacagaatagccagagggagcaagaaacaagcccacgatttagggaatggccccgggaaggatctcccgttggaggtcagggtccaggcactcactgtgcattcctcacagccaacagtgtaggtcttggtgaagccccggcgctgagctaagctcaggctgttccagggagccacaaaactgcaggtagtgatgtgcaagagtccatcctgcagttttcctaaggagaaaggcggggcggggaccgacaagcagcttgtgattggctgagctgccaagctgccaaaggcccggccttctgatagactgaaattggggtggtccccatttccagtgggaccattcccatcagagcctcgccccctcgtggttgctaggccgcgccccagggactggttggtgtggcacagggcgcggggacggtgcctcaccagcaatgagaaactcctcgctgcggttgtgggacctgtggaagtatccgcagacactctccatggcgggggtgtagacgaaccggatgtcagcggcatcccctaaggcttggaaccctttatacatctgttgatggatgaggggaagtgtctcttttactgacataatcctcccactccaggttcttccctgaagtcatatagcatcccaagatcacagccaactttctcgcaccaaccagtggccagaagtttctgttttgaccaggaggaagatgttagaaaatgctgggaaagaggcgggggcaggggataccttggtcatcttgatctcataacgctggtataaggtggtctggttgacttctggtgtccccacgaacttggccctgatgactgcaggagaggagggaaatatgagtcaaatggactgcatgagccaataaaaataagatcatcatcatcatcatcatcataccagcaaagcgcatacataaataggggttattggatgccagacagcacacaaagtgatttacacatttgttcattgattcatctgtatgttgagtgtctctctttgccgggcactgcttaagccattttcatacattgatttgttcatttactcctcaaatatttgggagtgcccactgtgtgccagacattgttctgggtgttagggacacaacagtgaacaaaacacagaaatccctttccttgtggagttcacattctagccaggaggagacaggctaagaacaaacaaaataaggatatggaatgttagacattaagtataatggggaattacagacctgggtaaggggctgacaaagattctttgcttgaccaaactttactcaggctcctgaacctcctcctaggcccatctgtgcacttccttgtaaaatccagttttagccgagagccttgctaagtcagtttagcaagaacccctatattctatatctgatcatcctcaatctctgatcatcctcaatacctgatcatcctcaatctctgatcatcctcaatacctgatcatcctcaatctctgatcatcctcaatacctgatcatcctcaatctctgatcatcctcaatctctgatcatcctcaatacctgatcatccttgctatctgactgggttcttcatcttccaccatcccccaggtgatgtctgattccccttggcctgccttcagcaagaatcctgttacgtcggtttagccagaatcccccttacccctgatgtttcttcttagtaatttccacccacagaccctcacactgctccttagctacacattcccactggcccatgctatattcagtgttgagcccaatctctcccaccgactgcaagatcccattgcagtggttcctatacccatcaccatggtcctgaatatggtcttccttactgtgttataacaagtatcactgaatatttttctgtttaacaggagatcaggagtactaaggggcaggggttaaaattttaaacaggatggccagggaaggccatcctgagaaggtgacgtttgaggcagccacccatgtggatacctggggggaaagtgtaccaggcagagggagcagccagcatgcagatcctgtggtgggcttgggcacagagtactcaaggaagtgtgaggatgccagtgtggctaaagcagaggaagtgcaggggcgagtggaatcattctagaggtaagtgccatggtgagccccactggactgaaagggaaaccaaggcagagtgtgtgggctgagtggggtgaggactcaccgaggtcggaattgcagaaggccgtctgtgggtggggtgggacacaggtgcaggccctgctgggggctatcagccacagcaacaacaggatgccagaagccaggggctcaaagggggccatggtgggttctgtggggaagggggatgtcaggcaggccccggcccagctgatctgctgacctgggcaggtcatccaccccatcttgccccggggcagcctatgggggggattagggggctggatttgggcttgaggggttggtaagcttagggattttaaggggattggggagcgcagaggaatttagggtttagagagttgggagagtttaaattattgagggactgagtgagttgcggggttatggggttgtggcacttgggggagaagggggctgaggaagtttgaggaatgaggggattggggaattctggaggttgaggagtttgggggtgaggaatttgggattgggggctggaggagtttggagacggcagagtttaggggttgtgtatattaagagatataagaggctgggggaatttagggaggttgaggaatttggaggaggttgggggtttagggagctgggggagtttggaggttgaaggggttgggggaatttgggggcttaaggcaatggggatacttgaggaatttgagggcaaaagaagtttgggagctggggaactggggattggggagctgggggagtttagggagctgcaggggttagcggtgggtatttagggggcgatgagggaaatttcgggatgaaggaatttgcggggggatttggaaagcatttgtgatattagggggtcatgggtttgggggaattgggggcggatgtcaggggttctagggagtttggagcctcggggttgggaaagcagttccagcctccgaccctcttccccctagactagcccagggtcctggtacccgcaggccaagctgagtagacaggcatctggcacgggagtgcacgggcctggtggccagcacccaagctgcagcccagctccggtccctgctgggccaccccgggccctgcttacctctggtgtctctctgggcgctggatctgcggcgatggcggcagggcctgagcgctagaggataaatgtccacgctaggggcgggggtggcagcgggtgcggaaaccacaggcctccaggcttcctggatgcattactcatccacccaccatcagtgcagaagccaaggggcgggccgacgaaaggagatacaccctcctcctctcccacccgcctcctctccctctccctgggcctcgcccgggccagccacctcccccacctccacgtcagtcactattccttccaagccgcctcagcggagagcttagaggccgcatttcccccggcccagtcccctaaagtctccagaatctatccaatcacccacatcccccaagctccctatgactcaaacccaaattagttcagcccttcaacatttattgtgcatctactgtgtgccaagcacacaaaaatcccttgttttgtatgtctgacatgctggtgaggggtggcagagaggaaacaaattaagtagcagcagtggagggagataaggcaggtgaaaggggaggaatacaaaatggggaaactgaggcacggagtggttaagtgacttacccaggatcacagagtcaatacatggcagaactgagactggaactcaggtggccaggagccaaagccagggtctcaaataacacaggcaaatagccggcatttatacagcacctactgtataccaggcactcagcatagtttatctcactcaaagctcacaacaaatctctgagatgggtaccggttcttattcccgttttacggatgaggaaatatggggcgtagaggaactgtagaattttcctaagatcacagggcatggccgggattcaaacagaggctacctggcaccagggttgtaactcaggagtggcaccgtcctagcaagcagggaatggtgcgggtgaatgaatgagcattgggaagggggtggccatgaatgatggtgaaagaagcaagtgagtgggtcagtagaaaactaatccccaccccatcctgccctgccccctccccatggacctgtacccctggtggggggtggggtggggcaatccttgcccaccagctttctgacaatgcaggaaccttccctggggttctgattaacatccttaattcgaggaggatagatcaataataataattgtagtgatgatggcagccacttattgagcactttctgtgtactatgtgctaaagtgtttgtataaattatctcattcactcaccatactcccttgctaattaagtttgattaactcagggatgatagcccaataacaagaacacaacaaaaactaccagcagcccttatggagtgcttactgcgtatccagcactattctgggtgggaggaatgtgagggatgagaaattgcctaatgggtacaatgtacactatttggttgatggggacactaaaagcccagacttcaccactatgtaatatatccatgtcacaaaactgcagctgtaccctctaaatctattttttttttttgacaagagtcttgctctgtcacctaggctggagtgcagtggcgcgatctcagctcactgcaacctccgcctccggggttcaagagattctcctgtctcagcctcctgagtagctgggattacagccacaccaccaccacccccagctaatttttgtagttttagtagagacgggggtttcaccatattggtcagatctcgaactcctgacttcaggtgatccacctgcctcgacctcccaaagtgttgggattacaggcgtgagccaccacacccggccttctaaatcttttttttttttttagacagagtttcgatcttgtttcccaggctggagtgcaatggcaagatcttggctcactgcaacctccacctcctgggttcaagcaattctcctgcctcagcctcctcagtagctggggttacaggcacacgccaccacgcctggctaatttttgtatttttagtagagacggggtttcaccatgttggccaggctggtctcaaactcctgacctcgggtgatccgcccacctcagcctcccaaagtgctgcgattacatgcgtgagctacggcacccagcctaaatctattttttaagaaagcacttggccgggcatggtggctcacacctgtaatcccagcactttgggaggctgaggcaggcagatcgcttgagctcaggagttcaagaccagtctgggcaacatggtgaaaccctgtctctatttaaaaaaaaaaaaaaaagcactgttctaaagtctttttacagacattatctcatttaatcaatcccgattgcctctttgttcattaatgttagttaaggaagagatgttaagccaataataagagtacccaacacttcttgaggatcgaggcttactgtatgcccgataccatgtagagcatttttcccaaaataactaacttatttctcacaatatccctgtgagttagatatagctcatgttctcattatacagatgaggaaacttagacacaaaagggctgagtgacctacccaggaatgagaatgaagaaatggctctgctgcggggtggtggggggagggtgggggggcgacaaaaacagggaggaagggaagtaaaccaaaaaaatctgtaggagctgattatgaaagtgggacagtgagagtgaatgagacggggctgagtaacctggtgcctccgagggagaagtgagggcaggggaagtcctgccttggcccctcgctgactctggttctgacgccaactctttgaaacctgagtcagcacagagtgttgccgactgtttacatgaggagtcgtgtggatccggttattgtgcagttttgaaatggagagtgggaggggtgttcatggaggggtgtgtgaccatctggggagctggatgggtgtgggggcccatgggggtccaggaggcatgtgcaaagcggacacctgacaatgcccacagcataccaggtgcttgggcctcattgtgctctttgtgcagatggggaaactgaggctcagggagaggttgtgtccttcatggccttaggaagaagaaaggccaaaattcagacctagggctttccaggagctcccagagtcagagttcaaagcactctgcatgcacacatgtatgggcacacacacatatacagagcgttgtgttcaggctcaagtccagagaaaacaaggacagttaacgaaaagaggcacctagaaacctcagggttgttgggggaggtatgggtgtgtacgcacagctctctggtgtgttgtgtgtccattgctaagagtcgagcatgtgcctgtgtgttttgtgtgttacttctgggagttgtctaccagcctcggcaaagcggatctgggttgcatatgtaactgagtgcattatgcacttctgtgtgctgtgcgcacacctgggtggtactgtatgcatccgcctcggcatcgtttccctggcccgctgcccagagatgccccaaacccccgtcccaacatcgtgcctctcagcccacctcataatgacgccagtcatttgggaaatgaggaagggggggtgtgcagagggaggccttaaggtcaatcggtcaccctgagtctgcgggcttcctgtgcctgtcgggaactgggaaccaccaccgccccagcagcccctccgggaatgccatctctctaccttgtcagcgagagggagggccaccagaggggcactgtgcagctgtgctgtgggggtgggggtggagggagcggggagcctagggccgtccaacctggtttcctctaccccatccaggagcgggggagacttgaggtatccctctcgcctgaatgtgtgactgtatgtgtgttggggtgggagtgcccaggaatgttttctgcaaactgagttgtgggtgtctctggttgtgtgtagcctctctgtattgtatatgtggcaaggcatgttgtgtgtgtgtctagatatactttttgtatgcccaggaatgtggcgtgggtctcttacgggtcccagtggtgatgtgaatacctagaagtgcatacacctctgtgtgttgtgtagggccttatttgctgtgcatttgcctaggggtgttttatgtgtgcctgtgtgttgagtatgtgcccggttctgtggagtgtgcctgtggagttgtgtgtctcttgattggacgggtaatcttttgtgttgtgtgtgttcccctgatggtgatgtgggtttgggtgaggggagggaacctgggtgtgtgcccaagtattgattgtgtgcctaagggtgtccagtgtgtgctgccctggagtgctggctgctgacccacgctatgggcacctggctggctgaatgactgtgtgggtgtctgtgctgctccagagctcatgtgctttgagcctgtgttggctgtcagtctcaatgtcactggcatctctgggtttggcgatgtacatctgagttccaagggctcatgcctctcaatagtttatgtgtgcaggtgaggcttacatacaaggtttggctgaggggttcagtcactacatgctcaccaccactccccaccccccccacccccacacacacgcactggcacacacttgcctcactatcatccatccactgtaaaaacaaactttctttttactggaacagtcccccacgctcataccatgcctctgcccgggaaagcaggggcgggacgtctggaacttgttggtggggtggagtgagggacagacagacagggctctgggttcaattctgggcccggaggtggagacactgtgtgacccccagctgctgcctgcctgtctctgacctgtgtgtcctgggaagtgactcataatgcagttcccactggctgggatcccctcagtgccgccccacccctggaggtcaccctttctgccctgagcatgtctcctctgccttttccccaccagctcagcagtacaacgtaccccgtggttgtgaagatggggcacgcacactctgggatgggcaaggtgagtctctggctgggctgtgcataggtagatgtgtatttgtgcaatgcacaccagtcattctgtgtgatcgcgtctcctggggtgtcgttatctatcaggttggtgcaaaagtaattgcgggttttgccagttcttatggtaaaaaccacaattacttttgcaccaacctaatagatttttgttttctcacattcagctgacctcatcgacccctttttcctcctgcattcagccaattttgtgtgtcctgttattttgcttgtctccagcatcgtgtctgtgtgtacatgcatgcctgtgccgaacacacatgatgtggtgtgatcttttatgttccaaagtcttggggtcctgtgtgctttacatccatctgattttgtctctgtgtacgtagaaagtagacttgtaatttgtgtccgagtttctgtatcttagcatgttgtgtgtacaattgattttgtgtctggatgcctatattagtatattgtacatacacagttttttcacagctttagtgagagatagttcacacaccctacaactcacccatttaaagtagacaatccaatacattttggtatgctcagtgttctacacacccaactttgtgcctgtgtgctcacatacaaaacaggagacccatgatcgtgcctgcttgagcgccttggcatgtccacctaatttttgtgtactcgcctcacctgtgtgtcatgtatacatgctcccccaggcacccccactccccacagctgccctatcctgaccaggccctgatccttgcccgcacttccacaggtcaaggttgacaaccagcatgacttccaggacatcgcaagtgtcgtggcactgaccaagacgtatgccactgccgagcccttcatcgatgccaaatatgacgtgcgtgtccagaagattgggcagaactacaaggcctacatgtgagtggagagaccaaagccctggaaggggtcccctgccttgcctcatgcagctgaggcacccctgagcttctgtccccttgtcccccaggaggacgtcagtgtcagggaactggaagaccaatactggctctgcgatgctggagcaaattgccatgtctgacaggtgggcagcccgaactcagggtgtgaggggaagcgggggtgggagcacgacagctcaggtgagagactgacaggcttccccaccctttgtcttggcagatacaagctgtgggtggacacgtgctcagagatttttgggggactggacatctgcgcagtggaagcgctacatggcaaggacggaagggatcacatcattgaggtatgagcacccaggggtaggtggggtagagggaggaacagatgccaggcagcagcagtgcaaactgaagcactccatggcacagaggtcctcagccaacagcaatgtgcttagtacactgtaaggtgcctgacgaactttcgaaggggccatcccttgcaatggcagaacactagactgaacttgcacgtccctggtgactagcaaaacccttattagattgtttagtgctctgcgaatcgagacatcttggtgaatggcgaggcacttagtaacctttaaagtattctgcgaactggaccgacagcaaagcattttggaaaggacaaagcacctagaaaaccgtgaagcagggatcggcaaacattttctgtaaaggagcagacggtacatattttaggctttgtaggccacgtagcctctgccgtaactactcaactctgcaaaagcagccatagacgatatgttaaaaaaataagtgtggctgtgttccaataaaactttgtttatggacattgaaatttaaatttcatgccattttcgcatgttataaaatctttcgatttttttcaactgttacaaaatttaaagacccatccttagctctgggtcatacagaaccaggtggtcggccaggttgggcccatgggccctaatttgctgagccctgctctgaagcaccttctaagctgtaaggtaccttggaacagacaagccttcctcaccgtgcacaatcagtgcctcagacactggggctcagcggcggccatgcccttggccaactgaaagcacggtgttactgccgcctcaggtgcgaggcctgcctctcccctcacggatcctttccttcccccaggtggtgggttcctccatgccgctcattggtgaccaccaggatgaagacaaacagctcatcgtagagctcgtggtcaacaagatggctcaggccctgccccggcagcgacagcgggatgcctcccctggcaggggctcccatggccaggtcaggcccctggcgctgagctagtggcttgagctagtgtggggaggccggccctgggtcatgctgtgccatgaagctgataatctgtaggctcacagcatcacctttgcacacatgtggctgcgattgccaattgtttaaaacattgataagcagctgctgccctgacttccctgagcacctccctgccccgcccctgggaacaggtcccccaccccacaacccagagtaccctcagctcagccacaagtggggcaacacccagcgcacagggaacctgtgtcatcactggctgatgctccactggctggtaactatttttaacctctcctgctccattcctctgccgcagactccgtccccaggggccctgcccttgggccgccagacctcccagcagcccgcagggcccccggctcagcagcgacccccaccacagggtaagcgagaggctggcggtcgcagtcccctccctcagcccgccatctcttacccgctcactctcacgtgtgctctttctctccctctgtcccccaggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaagtaaggggacccctacagcagccttcgccttgctgctcacaaagcgggccgctgccccagtagagcagccctagctcccttgctcctcagacccaggtcctatgcaggggtcccacgaactctctccagcctgagccaagcccttcccccaagctttcgctcctcccggcccaccagaggctccgcacccccaccccaggaatttggtgccagaatcccagagaaactgcactcagttcgaattcctcctcaaaggccctgggaaagtttcctcctccagggcctcccaggcacctggctgacccaccctctgcaacttcctgcccagcccagagccttccctgccaaactcgcccccccgccaccaacccatccctaaaactcctggcccgagtcctagtcctcctatcatctggctcttcccactccatcctcatacttttcctcctccttcacatccttctggcccatctcagtctccccgcgaatcatcacccatctgccttttctggtccattccaactcccatcccagctcagacgtcctccctgccccacccagctgctctgccttaggctgacttgcccaacagcctgtccttggtccaagccctttctatgccctcctagacacctcacccttagattggaaacttccctgctcatcttcccctttgtatcaaactagccaagaattcacagagaaggttctgcccaggactcttgccacgaatcccacacttcaccctggatccaagtcctcccagcctgtcccagatctcgcctccctggcccaggactccacccactccacctgagtgctcccagccttgagaacctgttagggtccaggcccatggtggcaggtggggaggtcacaggcacagccccaggatcagaggggcagggctggggctgggcctggggtaacgttgtgtttctctccccttcctccccttcctcttcccccttcctcccacgcctccaccttgtctctctctagcaaatcccagtctctgaccaatgccttcaaccttccagagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggccc

SEQ ID NO: 4499 - DNA, 47949 bp, human; identical to SEQ ID NO: 4498

SEQ ID NO: 4500 - DNA, 29437 bp, human
ttgcaggagggccaggaaggggttccggccatctgttcactctgtggagggagttttccccaggaggccgtctggcctgtctaataactgcagtatgatcatgagagggaaatacaccccttagcagccagtcaaggtctctacgtatggggttacagatggccaatgatctctccaactattctctgaacttggtaagtccttctgaaagtgggggcaaaattgctttataatttaaaatatctgttgctctccaggagacgtgaattctttgagaagggagtccaggatacatttacagagggcattgcatagagaggtctggagctgatggagtctgattacaaagccttgggaaataagagaggtttcaaggcacagaaaaacaagtcttgttgggtgtccttggagcctgtgccagatttattttgtggtagtcagttcttacataaatgacctctaagcttcaggttttaagaccaggcctgatttgggcttttaagatcaggagggtttttgtaaatcatccagggaaagagagataaaagaaggcagctggatgtctaaggagtttttccggggtttggaggagcagagagaatttgttgagaagatagaggaggagggagaggctgaggagatggggctggatcttgaggagggggggttcaattcaggggcccagagagtgaatagatcctctggtgggtcagggacatggagttggggtgtgagtggagaagggtgatttatagtgggaagggggatttatagtgggagcagatttcaacttttgttctaggtctgcttttgttctttaattttgttaaggaaatttttagggctagtaataatacttttctgaattttttgttctgcctgatcttcccataaatacaataagcaaatagtttagaataagcgttctctaaaattgttttcaaataaatttgaaataaaatttttctttctaattcaaaggatctgtcttctggtcattgacaattaggatcttcattggtgtatagattccaattgcgacttaattcaataaggcttttatggaaggaccacgtggtaactttccaggcttaggagaaatctttactagggatgcaaggagtgttcctggagtgggtgcagaagatgcagcccccatgattcaaaaattcattctcagagatagattaagaaagcaaagaccttggctggtgcagtggctcatgcttgtaaccccagcattttgggaggccgaggtcagaggattgtttgagcccaggagtttgaggacagcctgggcaacatagtgagattcccatctctataaaaaatgtgaaaattagctggatgtggtggtacgcttctagtctcaggtacttgagaggctgaggtggaggatcacttgagcctgggaagttgaggctgtagtaagctgtgatcatgccaccgctctccagcctggactacagagtgagaccttgtctcaaaggaagaaaatgattacaaaataaataaagttttaataagttttaaaaaagaaaaaagaaaacaaagaattttgtggctacaggcagttaagggtctctgggctgatgggattgctcctgggattgcagtcaagtagagatttagctgggccacatggttgctagctgggtatgcagtggggtctgcagttggtggttctagtaccagagtcctaggcaggtgtggatcctgcatggtgtctgggccaatagaattgcttccaggaccttggtcagtgggactggtgttgggacaaggatccacttcaaggtctgcagttgagtacacagacagcagccctgttaccaggtgtgtgaatgcacatgactcccaccagttccctgggccatctcctgctgggttactgggtaggtcactaaacaggcaggattggctctggaatgtggctgagagaggctagaaccaagtcacagggctgcttcagggtccaccgctgggactgacatctgcagttctgcctctggaaatatggataggtgtgcctcctgctgggttcctgtatggtcatgactgctcccagaccatggctgacaggtctttttcagggatggtttctgttagtttattttttcccttgaatgggccatactttcctgtttctttgtatgccttctgatttcttgttgaaaactggacattcaaatgtaataatgtaataactctgtatatcagatgctcccctttcctcaaggctttctattatttatttacttgtttatttaattgttgtaggctgtctctgtgctgagaatcaccctgaggtgtaaattcagtcttctcaggtctttactaagcctgagtcccttcccctgggcatgtgtggtgactttctaatttcccccatatgtatggttgcttttgagtgtactatggctggctcccaaaaaagggaaaaagagaaaaatgagagagaaaggcactgaccctttaaatctcctggaaatcacatcagtgggggtgggtggatgggaggtgaggttgtttgtttgtttgtttgtttgtttgtttgagacagagtcttgctctatcacccaggctggagtgcagtggcatgatcttggctcactgcaacctccaggaggtgaggctttcaacagtagtgggaggtgtaacaacaatggctgctaattcattttctgcaattctgtgatcagaagcagtgatcagtgatccaagcacagatccctgatactggaagatagagttctttttgcctactctgctcctgcaagttgtgtgcaagctgctccaggaacatgcgcacggctgtttgccatagggctgaaaagtcagggatggggaactgctactgtgctaagagcttaaattgactgaaattaactgcaactcaccatttaggcttcccctggaaattgcaagcctttgacagactccagagttccaaaatagttatgtcagacagattatgtcagtgtaactgttatttctgtggggaggtggattcctggtgcttcctactccaccaccttcccagaatcctcctctagtcaacacttttgtttttcacagagtttcactctgttgcccaagatggagtgcagtggttcaattatagctcattgcagcctgcaactcctgggctcaagtgatcctcccacctcagcttcctgagtagctgggactacaggcaaatgccaccacacccagctaattttttattttttgtagagacagggtctcatgatgctgcccaggctggtgtcaagtgatcctcctgccttggccttgcaaagcactgagattacaagtgggagtcgccatgcctggccttagtcaactaattttttttttatgaagtacaaagccatttcaatggagaaagtattgtctttttaataaaggatgctggatgttctcacttgtaagtgggagctgaacaatgaggatacatggacacggggagggaaagagcatacactggggcctgtgctgggggatgcggggagagggagagcatcaggaaaaatagctaatgcatgctgggcttaatacctaggtgatgggttgataggtgcatcaaactaccatggcacacatttacctatgtaacaagactgcacagcctgcacatgtatcccggaacttaaaataaaataaaataaaaataaatgatgcttgaacaatggactatccatatacaaaacaaaacaaaaaacaaggcaaacttcaacttaacctaacactttacatgaaaatcaattcaaatagaccatagacctattggtaaaatataaaattataaaacttctagaagaaaacataggaggaaatctttgtgaccttaggttaggcaaagagttttagacatgatacccaaagcatgatccataacagaaaatactgatacattggacattataaaaatcaattacaagtacagaaacagtctgcagaaaaaggttaaattcagagtatctgctcctggaatggttcatgttcttgttccctcgaatctggatggacaatctagtgtttgcctctaaggacatgccagtctgccaacaaagcacttaacatctagtgtatctgggcagtcagaagagaccaaagctgtaagtcagtaatcaccagcaactgttgtaggagcactgtgctgggaggagagaaacctgtaaaatacacagcaacactgagcagaatgacagaaatgctgtgggaaaactgaggaaggaggagcaaagggtctgaaaaaggcttcccagtggggcaggcatctgaggtgagtcttgaaagataagctgaatgttgacaggcaaaaatagacaaacacagatgtgagaggttcaggcaacactcccccacccattataattccaagaaaataaaaggaatacccatcactgttacaattatgcttacaagtgcattcagaagaggggcagttcacccagttggaaaggaaatagagttttccagatggcgatgccaaagcttagtcttgcagggtaagcaggaattagcaaaagtaaaggaaaggcaagcctcagtaaagaccctgaactcggaagcccatgctggatcaacaagagagcgaatactccctgattgctcgacgtttagagaggctgggaaccggacttgttttacaggcaagtggggccctgtcatagagaacttggaaagacacgctatagagtggagccctgatcctgaacatcttggagatccaggaaagattcctaaggaggatggtgacattttttttctttctttctttcaacagggtctttctctgttgcctgggctggagtgcagtagcacggtcatggctcactgccacctcagtctctcaggctcaagccattctcctgcctcagcctcccaagtagctgggaccacaggtgtgcaccaccatgctcactaattttttgtattttttgtagagatgggaactcactatgttgcccaggctggtctcgaactcctgggttcaagcgatccacccatctcagcctcccacagtgctgggattaaaggtgtgagccactgcgcctggctgatggtgatatatttcttaatccatggccctttgggaagacgaccttggaggcaaactggattagccatccacatctcagagacaggagttcatcatgatgtaaaatatgagaaacctgagtgaaagaaaaacagcagtaaagagacaggagacattagagaagtaggtttgaagtcagaagtgaagaggatcaaaaagttattgatgatgcatctgagagggccacaacaatggctgctgtttcattttctgaaacttcgtaatcagaagcagtgatcagtgatagtagcacagatccctcatattggaacaatgcaaaggaaaataattcaaaggaaagttaaagtacaccttagcttggatactgcaagtactatttatcaactttcacagccacagagtggtaacactttctttagagtgacacagtaggagcaccatcatattggacaaacactgccattttaagttccagctgcctttccagctttgtgcatttcaaggaaataatttctcttctaacaacaagcagccagaaagagcagacagtaaaacacagataagacagcttgggcacagagggaggagcgggggaagtctcttgagtaactgccaaacttcaccctcatacaatgggccccagtaaaacagtgggccttaataagcacattcctttcccttcaggtgcactaagataaggaagctaaaagcagaccaggggcggggaggccggggtggtgtatgcctgcggctgcaggaagatgtatgggaacagacacaaaactctccctcccagataagcacagcaaagagacacagacaatccaagcctctgataaactctcccaccctgaatccttaaaaactcttcgtctgacaacagcaaaaagagaaaatttcaggccagtatccctgatgaacatcaatgcaaaaatcctcaataaaatactggcaaaccaaatccagcagcacatcaaaaagcttatccaccatgatcaagtcagcttcatccctgggatgcaaatctggttcaacatacgcaaatcaataaacgtaatccatcacataaactgaaccaatgacaaaaaccacatgattatctcaatagatgcagaaaaggcctttgatagaattcaacactcctccatgccaaaaactctcaataaactaggtattgatggaacatatctcaaaataatgagctatttatgacaaatccatagccaatatcatactgaatgggcaaaagctggaagcattccctttggaaactggcacaagacaaggacgccctctctcactgctcctattcgacatagtattggaagctctggccagggcaattaggcaagagaaggaaataaagggtattcaaataggatgaaaataagtcagattgtctctgtttgcagatgacacgattgtatatttagaaaaccccatcatctcagcttaaaaactccttaagctgataagcaacttcagcaaagtctcaggatacaaaatcaatgtgcaaaaatcacaagcattcctatacaccaacaatagacaagcagagagccaaaccatgagtgaaccccattcacaattgccacaaagagaatataatacctaggaacacaacttacaagggacgtgaaggacctcttcaaggagaactacaaaccactgctcaagaaagtaagagaggacacaaacaaatggaaaaaaattccatgctcgtggataggaagaatcaatatcatgaaaatggccatactgcccaaagtaatttatagatccaatgctattcccatcaaattaccattgatgttcttcacagaactagaaaaaactagtttaaatttcatatggaaccaaaaaagagccagtatagccaagactatcctaagcaaaaagagcaaagctggaggcattacactccttgacttcaaactatactacaagcttacagtaaccaaaacaggatggtactggcatcaaaacagatatatagacaaatggaacaagacagaggcctcagaaatgacaccacacatctacaaccatctgatctttgacaaacctggcaaaaacaagcaatggggaaaggattccccatttaataaatggtgctggaaaaactggctagccatatgcagaaaacagaaactggactccttccttacaccttatataaaaattaactcaaggaggattaaagacttaaatgtaagacttaaaaccataaaaaccctagaagaaaacctaggcaataccattcaggacataggcatgggcaaagacttcatgaccaaaacaccaaaagcaattgcaaaaaaatgctaaaattgacaaatgggatctaattaaactaaagagcttctgcacagcaaaaaaaactatcatcggggtgaacaagcaacctacagaatgggagaaactttttgcaatctatccgtctgacaaaggtctaatatccagaatctacaaggaacttaaacaaatttacaagaaaaaaacaaacaaccccatcaaaaagtgggcaaaggatatgaacagacacttctcaaaagaagacatttatgtggccaacaaacatgaaaaaaagctcatcaccactggtcattagagaaatgcaaatcaaaaccacagtgagataccacctcatgccagttagaatggcaatcattaaaaagtcaggaaacaatagatgctggcgaggatggagaaataggaatgcttttacactgttggtgggagtgtaaattagttcaactattgtggaagacagtttggtgattcctcaaggtctagaaccagaaataccccttgacctagcaatcccattacggggtatatatccaaaggattataaatcattctactataaagacacatgcacacgtatgtttattgcagcactatttacaatagcaaagacttggaaccaacccaaatgcccatcaacgatagactggataaagaaaatgtggcatgtatgcaccatggaatactatgcagccataaaaaagaatgagttcatgtcctttgcagggacatggatgaagctggaaccataattctcagcaaactaaaacaagaacagaaaaccaaacactgcatggtctcactataagtgggaggtgaacaacaagaacacatggacacagggaggggaacatcacacactggggcctatcagggggtggggggtaaggggagggagagcattaggacaaatacctaatgcctgcagggcttaaagcctagatgatgggttgataggtgcagtaaaccaccatggcacatgtatacctatgtaaaaaacctgcacgttctgcacatgtaccccagaacttaaagtaaaataaaaaaaaagcaattcttttctatttgttttttgtaaaggccatgatgaacccttctttgtaagcatgtagactttttatcataaacattgaaagaaaattgtcctatgtacggccttgtagtcttagttcctgaataaaaataaaacaaaatgaaaaaataaaaaataaattaaaaaaactctcagtctgtaagagagagtacctctgtcctaactcagccagaagcccctctcaggtttattttccaaagtaaacctgtctttaactgctgagccgcttttcatgtttctttcctctttctttaattcttacatagagctcacagtgtacttctgagttcagcttggatttctcacttcatgctccaatccctaaactgagtttgacacaagctgtgaagatttagatttagctggggacgctgtcattagacaccaggcttgaatgagggaaaatagcttcttaacaaagatcttaacattttttgaatgttcactttgtccatggttagttaaatgtaactttagtgtaaattatagcatttatttgcttttatctctaggaaataatatggagccacatagattacagtaatttgccattttgcaaaaacaccagaaggttagagtccctgatatatttctttaatcaccaattgctactggacacctcccttgtgccaggcagtaaactgggcactaggcatctgacagtgatgaagaccgacattgtcccttccctcatttctagtggggaagacagacacaagacagttgtaagaggttcaggcaacacccatattttcttcctaatttcaagattaaaataaaatgaacagcccttgctatattataattaatccacaagttcattcagaagagaggccagacacccagatggcaaagaagaaaagagagcttcccagacagagatgccaaggcagcggcttgaagggtcagtgggaattagtggagcagtatggttataatcttccacaatgataatatatttttgctattttaccatttgttctaatatattttctttgtgtttattttacatcattttcttaagtgtatataagattagaatttttacattcattgtgaattgaatcattatggaagggccctctcaattccaatgaatactttttgtcttagtcttttcagtttgctagtaatatcactgaccttgctttattttgattagcatgggcctggcaaattttcttccatccctttatttcaaacttttctgtattcttatgatttgctaggtttggcataaacagtatatgactggatttgtcaatttttacacaaaatgacaaccattaactggagcatttactccattaacaactttttttggggtctcttttgtaatttgaattaaagcaattgctattcattttttttaactctctcttataagcaccaaattttatttatttatttatttttattttttattttttgaggcggagtctccctctgccacccaggctggagtgcaatggtgtgttctcaactcactgcaacctctgcctcccaggttcaagcgattctcctggctcagtttcccaccccgagtagctgggattacaggcgcccaccaccacacccggctaattttttttttttttttttgtatttttagtagagatggagtttcaccatgttggctaagctggtctgaaactcctgacctcaggtgatccacccacctcggcctcccaaagtgctgggattacaggggtgagccaccacgcttggctcttattatttgttttaaaaaaatgctttaaaatttttttattttatcttattttaagttccaggatacacacgaaggatgtgcaggtttgttacataggtaaacgtgtgccatggtggtttgctgcacctatcaacccatcacctaggtattaagcctcacgagcattagctatttatcgtgatgataagcaccaaactttaatatgtaagtcaattttgggggaaggaaacatcatcaagaacttccttctgaaacaaaacaatgatgttcattccttcaaacatccaaattgaaggtgtaccaaaatgaaaacaaaaaaagtccacagagaaataaaaaggaacacaaatcacattccagggggttagtgcatttagcagtcttagctgtgctgtctaaccatccttcaactgactttcaaaaaaaaaaccctatactcatcaaaatatacattttccatttgctgttttaaaattaaaaataataattgaaaaaggaaaactctaaggaagtcacaattaattgcgtgactcattttgatgtcatgtatagcatatggaggtcaggaaggctatttgcagcacacaggattagaggatatttgtcttcgaggtttagctttcttccaaatggtgtaaaatacccacaattccaagtatgaagagacacggactatttcctttgagaattccaaaggacaatacaggcaccccagctgttcttcatagagagacagggcttccgtcagattgacagagttccccttgtgtaaaatatttcacatcttgtttcaatactttcattgagaggtcaggaatcagtctgagaaactcccatgtggaatcttctggagacatggagattggaacagctatcaaatcattaatcacataatcaaattatctcccttctttggcataccttttcagtactggaatgcagtactgaacctcatatagcagtctcctttaagattatctaagacatcaccacaagtttttcacatatatttcctacatccatcaatcaccatttcgtcaatctctatcatagtgaccatctttagttttagttcggctatttcacacaatatgcccccatctcggcctcccagaatgagtacatctttgccgatgcaaactttgccactgcccatgatggcccaggtatatgtcaaatcactctatgccaaattaacattcccactaaggatgagaatatttccaaattgcttcgagtgtagaattttaatgttctgataaggtgaatcttcatcatataccacttcatctatgttgtattcaaccaggagtccatctgcggtgggccagtatctgtcgatggctcctcctggaactataggtggtaattgcctcatctgccaactactgtcctgactcaattctttcattctttcttctcctttgttcaaaagactgtcgatctcttctttgccttgtgcatcaccatcgtaactctgaaggtccaataactccaatctatgtgagtaaattctcaaattggcaaagctgccgtttttttgtgtgtgtgcaggttgctaaacagcggtgtggtcctgcccggtgtccaccggttctgccatcccctgctcctggaaaatggactggagcccttttagaatggtctcgccatcagctttggcgctgagcatgaagtcgagtgtgctgtgccatgccgctgccatagtgaggcgagaccctgagccatgcctggggaaggcggccgtgggagactgaggggccgcgcagcatgtcaggcttccgccccattaacaactttttaaaaagttactgatcatgtaataaaggatgaacttcaaatgtgaatttattcctactttcatacatttcgctattttcctgcacttttaataaatcttttcctagtttcctgactttaaaaaaatgatgtgatttttgtttgttttttctcattgcctaccttataattaaaataatagcagatagtctgtaatcccagctacttgggaggctgaggtgaaagaatcgcttgagcccaggaattcgaggctgcagtgagctttgattgcaccactgcactccatcctgggtgacagagtgagactccgtctctaaaaataatagtaataggccgggctcggtggctcacacctgtaatcccagcactttgggaggccgaggggggcagatcatgaggtcaggagattgagaccatcctggctaacacgatgaaaccccgtctctactaaaaatacaaaaaattagccgggcgcggtggcgggcgcctgtagtcccagctactagggaggctgaggcaggagaatggcgtgaacccaggaggcggagcttgcagcgagccgagatcgcgccactgcactccaacctgggcgacagagcgagacaccgtctcaaaataataataataataataataataataataataataataattttaatataaatagatagtaaaatagtgataatattaaattattcaaaataattggaaattataagaggagcaattttcttgttatatatgatactgcaatgatcaatcacctacaaaatgtaatgcatgagtccaacaggacccaaagagggtaacaatagacattggggtctacttgacggtggagggtgggaggagggtaaggattgaaaaactccctgtcaggtactatattcactatctgggtgatgaaatcttttgtactccaaaccccagcaactctcaatttatccatataacaaacctgcacatggacccctgaacctaaaataaaagttggaagaaaaaaaataaaaataagccaaaacaaaatgtgggaactgtgcacacatggctgtactgtttctctgtaactatgctcttgaacttgggtggtacaacagctccgtccaagtgttgagcaagcccgaattggacacatttagaaaggggcgggacaagggtgcttcccgaagcttctctttcgcagctttttggctgcacctcacacgaggctccgtggttcagcacctacttgatgctgaggtattttgcaagagctttgatgagagactgagtttcatgattggagagtggatgtaggatctttgaaggaaatttgggggttgataatggaggtttttggaatcacaatagggacttgctgtaagttgagttgaatgctcccagtcagatcctctgatgggtaatttgtttccatttttcttcttttctcatattaagatgagaaaagaactttaagatggcttaaagttccatctaagacaataagttgagtattattgttttcataatagttaagtgttttctaatttctttttaccaagagttatttatatgtgtttccaattaacaaaagctaagccttttattgatttctaatgcaccttatctgtgtgctgtgtggtgcttattcatcggaatgtgtttagagtccctttaagactaagttcaaggtccatttttattaatattgtatctctagcttgaagatagtatgagttctccaactgatactgttttgttcaagatgcgtattggtcctgtgtgtgttcttgtttccttaattgccgagagtagtgacttgtttgcatgtgttgatatatatgatgcacacagaaatatgtacatatgtacgtatatattttgagatggaatctcgccgtgtcgcccaggctggagtgcggtggtgcgatctcgcctggagtgcagtggcgcgatcgtggctcactgcagcctctacctcctgggctcaagagatcctcctgccttggctttctgagtagctaggaccataggcgcgcgccactacacctggctaatattttttaaaatttttttctagagatgagatctcgcgatgttgcctcaggctggtctcgatctcctgggccgcaaaagtatatttgtatatttatgcattttatgtggcgatattgggcacaggtaggagtacttttcagaataaagactgtaaaatttcgctaggtgggtgggtcagggccggtaggccccgatgtggcctgtgcaggtagggaggagggtcagggcttggcgtcttaacatgtttcagcgggctgtgaggtgaggccgcgtcctttctgtcccagaatgcggaggggcttgtggtgctgtaagagtctgggaagggggtggagcctggcaaggggcggggctgggtatgaccggacgccatgtgcactggaggcccacagggcacgaagggtaaggtgagtctgagcgtccctaaacccgtccgcccatccatccaccgtttgatcatccctcaatccatccgcccatccatccaccattcgatcacccattcactcttgccccaggcgcgcaggagtgggtaggcggaacctggggagactagcggaggaggccaggcagtgaggcagactgaatttgtctgaggggcggggccaagtgtgtttgggcaggcagaggtggacttgtctgggtccatcgtgttgggtaagcagggtagcctgtgtgtcttggagggaggggtggatcaggctgagcagagcaaatctgaaggggtggcacccagattttctgggcggataggcaggccgttatgcatggaggtaggcaagttgggggcagatgtgtccaggtggaccaaccaagtgtgtctggataagggataaggtgggcaggcaggaccagatggtatcagtcattcccaggcaggcagggcctagtgtgtccagcaggtgcagttgccccaggctagattggcctgagggtgaggccaggagtgttggggaagggtggtttttccctacccacttagggctgaccaacagccctctttctaagagcatgggaatcctactagtaatctctggcccctggtgagtccaggacacagggtagacagggagtcgggctgatgctgagggtctgcccctcagaccttgcctgtaacacccccagagaccttgctgtggtcccactggacactggccacttgacagctgcctcaaacgcagaagtccgggctagcccagaagtaccagatggcagtggtgccactggcagtaagggaggcacctgggcaacagccacacctcagctgttgtctgaagaggacctgccttggcactgtgacctgtaccaggacacttgcagaggggatttttggcaatcagagcctggcaagtgtgagggagggccctggggtagaaggttggggacaatgagggcagtgaggttcagcagtgaggtgacaggaggcagggagtatccaaagaccactttgagaaaacagttgtgtggagtgtgtcagtatttcctgatctgcagccttgggtgagtgacatcaagaagctctagctcatggatcccacaggcagaagcaggcaatgaatgtgaagcacatgaagagtttgaagaaaaaggtagagcagaaggtgacgaattgaatggggagcatgaaggcaggtcgggggtggaatgcagggcaggggtgcaggattgggggttgatatcaaccctcctgatcctgccctgaccactcttgtcctgaagaaggagaagcagcagacgcagaaaaggaagcacacaggcaagtggaagcatccggagcatgtcaaggacccagcctcaccacggcagtgcctgggacccggctgtgtgtatcccacctggccaggctccaagtactgttcagatgactgtggcatgaggctggcaggtgcgtgagtgcacctcgaggttaagggacaaaggcaaagtaaggtgtgatctatgccatctgtaattccactcagccacccacccatccaccgtcatagtcacccactcactgaactgcccatccacattacatccaccaggatgctcatccacccttatagccactcatccacctgctcattcaccctcatagccactcacccacctgctcatccacccttatagccactcacccacctgcccctccacccatccacccacccgtccactgttcaaccacccattcaccaacgtgcactcatccaccactcagtaccctatagagtcaccatttggtagctcatctttctcattcctctgatgtccccatctacccatttcatttcttgctctctcttctttcagccacatcaataacatccttccccagcacatccagcagtggcaaaggagcccctgcattgccaatgagcatggcaagaaaatgctcgagcacatccaccataagcaacagaacacctatacttgcctgaaggacatggagcaccatttccatgaacttgaggccatcattctgcatggcaaacagcaggctgtgtgcacggattactaggcgagagggcattggcgaggtagagcttaaaggtaccgggcctctggtcctgtcctccccatcctgtactgcttccctggtccctccattgtcctgtgcagagcaacaaaggtgaaaagggcagcaaagacctgcagatcttttgcgcctcctgcaggcggcccatctctaagcgtgtcacctttcaccacatggagcactgctttgccaaggttggaacattggctgggagtcagatgggacgagggtgtttttggttgggtggggtggcacatgggtggggtccatgtggtgggggcagatttggcgcctggatatttgtcataggaggaatgcaacacacatccatggcttcccctgtgtgtgctcttcccccatgcccagtatgaaagccaaggtcagggcattaaccagtgatgaaggggacactggctgtgcagacgggagcatagggtctgcaggggacaacagacctggtgtttggagctttattgtaggaggacatgcagcatatgtccacagttcctcccatttgtgctctttcttctccagtatgagtgccaattgcccgttgggtccctgtaccctacttgtattgaaaggtgagtgtgggggctagtaagggtcgaaggcattacgtggacagggtcagaagcaaggttgagcaaggtcaggggcaggatgtgggtgggctcagaggcagaggcgggtgtaattagaggcatggtatgggtggggtctgggacaaggtacaggtagggttctggggtgggacctcactcctcctgactcttagcacctcacttttccaccccccatccagggccacatggctcttctgtgatgtctacaatctgaaaagtaagaggtactgtaagcgcctccaggtgctgtgtcctgagcactcttgggaccccaaggtgagacccttccttacctcatcaccctccattcctccaatcctccctgcctgactgccctcctcatctcctcagcaactcctgtgtgtcctccttcccttcccgaccaccccacattccatgctcattgctgcctctcaccctctcttcttccttttctctctacctggctgtctgtgttcatgacctccttgcccgaccaccttctgggtggtcctgcccctcctcactgcataagcaccccctaattctgctcctcttcttgctcaaccatcctcccttcctgccccaccccctgcctggccaactccctcttccctcctccttgtgtggcgccctcaacttctcttcctcactttctgactttcctccattctgatcattctctctgcctgactgtccccgattctattttctgcctgtcatctacatcctttcttcctccctgtttgactgctccccattctctccctccaccctcctctccttcacctcagccctcacctcccctctgcctcaacaagccccactcatctacttctcctccttggaccaccctcaaccctcccctcctctgccggactgctttccagccttccagctctccagctctccctggcccacctgccctccagccatccctccttctgttggatctctttctgtgcttctgttctttctgcctgatcacctgcattcttccatccctgcttagtctacctcattcctctatcctctatgcctgatcacccgctatttgtcctctcttctctgaattcctctcttcctcctgcctgatcactccccatccctctcctctctgtcctccatctccctattgttcccctgtgcctgatcattccccagggcttcgctccttcataactcatcctcctttgttcttcaccatagatgtcaaaggatgaggtgggtggttgtccgctcgtgcacaatgtctttgagttcacgggtaatttttgttgcctccccaaatgcctgtgcaaccaccactacagctgggagaagctgaggcgtgccgtggacctggagtgcatgcaggctgttaggtgccatgccgagggggctgagggatggggtaggatcctggactccctctcgcatattcaggtcccacagttgcacaagctggaacagctgtttgagcaggagcagaaggtgcgcacgtctatgatgaaccgggtggggctgctggctctgatgctgcacgggacgatccagcacgacccgttcaccagtgacctgtgctccagggtggacatttaagccttgctggacctaggtcccgtattccacactctgtgtaaaggtgacacctcatgaatctctcctcccacatctgttgctccatccatctttttctttcttttttttttttttttttttttgagacggagtcttgctctgtcgcccaggctggagtgcagtggtgcgatctcggctcactgcaagctccgcctcctgggttcacgccattctcctgcctcagcctcccgaatagctgggactataggcgctcaccaccacgcctggctaattttttgtatttttagtagtgacggagtttcaccgtgttagccaggatggtctcgatctcctgacctcgtgatccgcccgcctcggcctcgcaaagtgctgggattacaggcgtgagccaccgcgcccggcctccatgcacctttttcttagggcatcttggagtttctctctgtgcttctctgtccaccacttggtctcttgtctctctgtctaccactccttggtggtggtcagggggattgtttaaaattccccattcccatccattcctccatccctttccctttcttccctgaacctgggtgaggccaagggatctgccctgccgttacatccactgtctagagttttcttcaccgactttggaagaacaaggattttgatatctcatgatgttccctaaacctgtctctctggctgcaaacccaattccaaacctccaatagtcggtgggtgacaggcctcgcctgtcatgaccatcatgcccccacacgcacccatcttgtcccattcctgaccatcccacgaggtccttgccctgtcagccttggcccatctcagtccaaccctagtctgtcctgcctttcacttctgggccccctccccccaccaccctgctctgagtgtgccctgtcctttccagcctgtcctgtcacacctatttcacacctgtaggtttgccagaaggtgacttctgccacatctgcctttgccagcccctagccaggccttctgtgccattggaggtgcgtccagtagtgttgcttgtgggtgctggtatgtctccaatgacagacctgaacgacctttcctattttttttcctatgctcactgattccttatgatttttttttgttgttgttgtttttaagacggagtctcgccctgttgcccaggctggagtgtggtggcccgatcttggctcactgcaacctctgcctccagggttcaagtgattctcctgcctcagcctcctgagtagctgggattacagatgcgcacctggcatttttttgtatttttagtagagatggggttttaccatgttggccaggctggtctcgaactcctgacctcaggtgatccgcctgcctcggcctcccaaagtgctgggatgacaggcgtgagccaccacacccagcccttatgatttttttttaatctgcttttataattactctcctcccaggaactcatatagttctaaatgtttaagtgtgttgctctagactttatacctcatattccagtacaactactttacattactacttgtctggtacaatatctcctttctcattactaatattgtgtttctttcttttttttcaatttgatcagatttcccagatcagctttttatttatttataggtcctaattttatatttattttatttatataaacttctatttgtattatttatcacttcttgactttttgttctgtatttttattttacatttttttgtttaattttgctgttctttttctaatttcctaagtcatgttcccaactcgaccattttggggcttccagttttttgtttttttttttgatagtaaagtatttgagattatacactttcctctacatgtagctacgtttccaacactctggtatggaaggtgaaactacaaaattgacttctcattttgatcctaggtattgaagaaagcttcttaggttcttactggttaagatagtttagtggtcttttttttatttttatgtaattatgtttttttattatggtcagagaatgtagcctgcagaatatgaatttgtaaatgttattcaatattttctctgtggcctaggtatgtgacataattttgtaaaactttcatggatataagagaagaaactatattctctgttagatattaggacttggtggggacttttcaatctagttggattatttattttttgtctttctgtctacttcagctgttatattatcaaaaggtagaataaatctaccttttaaaacaaatttcttctgtggttttgtgttttttggggagagatgaatcctaaagtatatatcttagaccatttcacaccatgtcacgtattttcttttttttttttcttttgaaatggagtcccgctctgtcacacaggctggagtgcagtgacctgatcttggctcactgcaacctctgcctcccaggttcaagcaattctcctgcctcagcctcctaagtagctgggattacaggcatgtgccaccacacctggctagtttttgtatttttagtagagatgtggtttcgccaaattggccaggctggtctcaaactcctgacctctagtgatctgcccgcctcagccttccaaagtgctgggattacaggtgtgagtcactgtgcccggccagtttctgttcatttttgtccctactgttttcctcattagtttggaaagttttacttttattaattgtcccattatatacttttcccatttccaacaggcatgatttatttcctttactattttatccgaacataaccggaccttattttatagaaaaagatgaatagtattactttcttatttttctagaaaaatttaagctgtgtatttaaagactatatttttcttacaggttgagttaatcctgcttcaagaaatctcacttaacatttttattcaaaatccccagtgacttcatgtattataatttaacttttaactgtatgagtgtgtgctcaggggtgtgtattttacctcaacagtaattgtgaaccattgttttgctctcttattttgcgatctctcttatgatttcatattcatttatttagaatacatccctaagtgttttctttaagcagaataaatcagtgaaacactcttcaaattatttcatgtctgaaactgtcattcttttgccctgaccaaggaatggtttcttgggatggggtacaggattggaattcttatctctccgtggcctatggtaggcgtgtccagtcttttggcttccacgggtcacactggaagaagaagaattgtcttggaccacacatacaatataataatactaacaatagctgatgagctaaaaaaaaaatagcaaaacaaatctcaaaatattttaagaaagtttaccaatttgtgttgggctgcattcaaagatgtcctgggctacatgtggcccatgggccgcagattggacaagattggtctatgggaagtagcttctaagataaccctcagtgatccctgcctcctggaattcatcaccctgtgtaattccctccatttgagtaacttgcttctaaccaatacaataccttaacattgagaggatgccacctttgtggttagatgacaagagatcatagcttctgtcttggtgacaggctctttcccttgttggttttggcaacatgttgggaaggcccatgtagcaaggatagcctccaactatcagaaactgagactttcagtacatcccaacatccccaaagggatagaatcctggaacaaccacataagtgagtttggaagtaagtctttccccagttcagccttcagatgaagccacaacccctggatgacaccttgattgtagccctatgagagactctgaaacagaggacccagctaagccataccaagattcctaacctacagaaaccatgagatgtgtgtgtttttaagcccatcaagtttgtggtaatttataatacagcaatagataactaatacatggtctgtagatgttaaatgacatctgaattcaatttttgtcaatgagatatctgctgctggtcttattcctctcccttgtataaaacttgtttctgcatggaagtgtttaagaatttctcctcatctttggactataagactgtaacctttatctgcaaaacagagagagatttttaaaaaggctgtaatcaaatttggtcattgcaagggttcctgtggtgattaattatttttagcagctttgcaggggaggatcagtgatttagtcatcaccttttactgtacatcagaatcttctgtggagttgagatggaagagatggggggatgtggagggttcatccccatggcctaggggagagggggaggcagctccctgcagggtgtctagggggagatccgagtgggagcagccaccagccatagccagggagatgctatcccccaccccagcacggatccttccctctccattgattctttacagatgtcagctgattctcaccagcactccctttcccccctcctctggggatgtgccgatttctcctctatcttaatttaggtatagaaaaacccttttttctttggaacttagagactggcagggtagtagggccaccacagtctccggggtccttccggctctctctcctcccttcaaagataaataaaatggccccagaaggcaagtgactcgcccaggcctctcaggttggcagtgacagcactagactggagccaggtctcctgactgtgtcttctaccttcacccaccacagctgagatcaactttcccactcagagttcccgttgagattctgtaaactgaggaggacgatgagtgagccaggctctggctgacagctccctcctttcagacttgcctgtggatgctgtcggctctggaagggttcatcctctcaggggctcaggatcatgcagtcaataagcccgtatatattctgaaactctgttgttttagttttgtttattatataaataattatattcctaatattaagttatgcattatgaataaatacaaagaagaaagtaaaaatgacctctaactctgccatctcctaaatataaattctatcaacaatttgatttatttgcttccatatacttttttctgggcatgtgctttggtgcttatgtttgcaagtgatcagtatattcatatgtgcacttttagtttaaatgaaaactggaatcatgttgtttggttaccttgtttttttacgttgtattttaacttaaatatttttccatggcagcatatatttttctaaacaattttaacagctgcaaatagcgtatctttgaatatatcataatttatataaccaatatgctgttaataaatatttatgaaagttggttttggttttaactgttatgaacatcgccgtggtaaaattcctacatttaaatctttgtgcacatacatgattattttctacagatatagttttagaaattgtactcttgggtcagggtgtaaggacaggtgttaataataaatgggctgggcgctgtgctcatgcctgtaacctcagcactttgagaggcagaggtgggtggatcagttgaggtcaggagttgcagaccagcctggtcaacatggtgaaaccatgtctctactaaaaatgcaaaaattagctgggcttggcggcacacacctataatcccagctacttgagaggctgaggctggagaatctctggaccccgggaggcagaggttgcagtgagcccagatcgcgccactgcactccagcctgggcgacagagcaagactcttgtctcaataaataaataaaaatacaaaaattagccaggcatggtggcacgcgcctataatcccagctacttcggaggctgagacactagaatcactggcaccagggaggcggaggttgcagtgagctgagatcgtgccactgcacgccagcctgtgtgacagaacgagactctgtctcaaaaataaataaaaatacaaaaattagccgggcatggtggcgcacacctgtaatcccagctactccagaggctgaggcatgagaattgctggaacccgggaggtggaggttgcagtaagctgcgccactgcactccagcctgggcgacagagcgaaactgtgtctcacataataataataataataataataataataataataataataataataaatgaattgggaggggacaattgcacacttagtcccaatgagaaatctgcctttttccaaatgccacatgatcaaatcagtcacacatatgcagcttgtgatcacagaggcatggagttctctggctttccatggggtgcagcctcttgtccagcggaagtgtggagatttccagcctgcttaatctgagcaacacaaccttgacttcacagacctatgtccctacccaagaaagtcaggaaataaccacgtttctcatgagttatcgttaattcatgtatttgttgcacccgttgcagttcagcagcttttgtgagcttttaagaatccctgtagtaaaatgtacaagtatagctccataaaaattagatcagagaaaatatagaaagaatggatgaagtcaggaccagaattgatttgggctgtaggcatttgggccctagggttctgcagagtaaaattaaactgccagtttccttctgagcttcctatcagacatagctggaaagaaaatgcagttatttgtaggatttaccttggcctcagggagaaaaatgactacaagggtgaagaaaacattttccagggtaaagatttcctgataattgaatgtaaaccatctcccgccccccttatttttgagacagagtcctgctctgttgtccaggctggagtgcagtggctcgatctcggctcactgcaaactccgcctcccaggctcaagcgattctccagcctcagcctcctgactagccgggattacaggcacgtgccaccatgcctggctaatttttgtattatttatttatttattagagacagagtctcgctctatcacccaggctgcagtgcagtggcaccatctcagctcactgcaaactctgcctcctgggctcaagggattctccagcctcagcctcccaagtagctgggattacaggcatgcaccaccacacccagctaatttttgtatttttttgtagagacagggtttcaccatgttggccaggctggtctcgaacttctgacctcaagtgatccactggccttggcctcccaaagtgctgggattacaggcatgagccactgtgctcggctccaaaacccctttttgatctcattatggattataggtgaggtgaccttatactttatcatccaaattcagaaactttggaaagtgaaagaggtatcattaataatcatgctggaacagcaggtgtaaactggacaggtggtcaacctaatgataaatgcgcaatagagtttgccatggccatcttctggagcagtggttcttccagtgtgttccctggaccaccaccaacagcacctgagatattgttagagatgcaaattcttggaccctatgccagacctacggaatatctaacttttgggtgtgaggctcagcagtctgtgtgctgacaagccctctgggtgattctgatacacgctcaatgttgagaaccactgatttagagctgtcttccaaataagtcaaaggcacagggccagtgcagaactcagcccatcgggttcttcatgtgcacacctctctaattatcttgtttcatctaggtacaaactatcctacatttttatattcctctggagccttttgacacttcttatgccttaaatagttcaaaattaaaggaatattggatcatacaatatgtgttttcagtctggacttaaaactctgtgtgatggccctgctcgtggtcggttcctcaaaaaaaaaaaaaagtctctatttttaacatgttatcctgaagtacaaaatacaacggtaacgtggaatttattctttcaagatacaaaagttagtttatatttatttcctgtatatagaatcccttagtggtgatccattagttcaagtaaaaaatccatgcttttcccatgattgtagtccagcatttgtccttagtttttattaattaattaattaatttatttatttattattacttttgcctcactctgtctcccaggctggagtgcagtggcatgatctgggctcactgcaaactccacctcccgggtttctaacctcctgattctcgtgcctcagcctcccgagtaattgggattacaggtgtttgctaacacgcctggctaatttttgtatttttggtagagatggggtttcgccatgttggccaggctgatctgtatctcctgacctcaggttatccaaccgccttggcctcccaaagtgctgggattacaggcctgagctactgcacccagtctgtccttagatttttaaacttattttgcttccctaacatgagacatagactcctgtccttttgcatagagctatttgcacttccatgatgtcagatactttattttttttattttatttttttttactcccatgcttttgcactttgcctcacatgtttcactttccatgttaagcttccccaacactggcaggcaaacctacttccccatggagaatttatctttccctcttttgtgctctccatgtttcctacatgtacttaagccttggaattttttgttttaatcatctcagtaaacttttttttttttttttttgagacagagtctcactctatcacccaggctggagtgtagtggcatgatctcggctcactgcaacctctgcctcccaggttccagcgattctccagcctcagcctccgaagtagctgggattatatgtgcgtgccaccatgcctggctaatttttgtagttttgtatttttagtagagatggggttttgccatgttggccagactggtctcgaactcctggcctcaagtgatccacctgccttggcctcccaaactgctgggattacaggtgtgagccaccactgacttccatttaggaagtcaatctcatgttttctgggagagcttgatgcctttgaaatgccctgaaagtgtattagtcagtgttctccagagacacagagccaatagggtatatggatataagaggggatttattatgggaatttgctcacaccattatggaagccaagaagtccccaacatcttctttctgcaagctggagaactagaaaagctgaagctgataatataattcagtttgagtctgaaggcctgagaaccaggggagttgatggtacaactatcagtcctaggccaaaggcttgaaaaatggggtagggggtgaggggatggtgttggtgtaagccctggagtctgaaggcccaagaaccaatagcctcaatgtctgagagcaggagaagatggatgtccacagctcaagcagagagggtgaatttgcccttcctccatttttttgttctattcagtccctcaatggattagatgatgcctgcccacattggtgaggacaaatctttacatagtctgctgattcaaatgttaatgttttctgggaacaccctcacagtcacacttagcaataatgttttaccagctatctgggcatcttagcccagttgagttgatataaaattaaccgtcacagaaggtaactcatcttgaaagttctaaactcccttaactcacttcttctctaaaagaaggtttataacttcaatttttctctatcttgaattggaatgtctacgacttttattatatgtctgcccaaccattgtatgttcagtgttttgggggaagataacctgtctcttctgttttcacaggtccacatacagaaagagaggaattgtgcctcagaagctgtatgtaatggatgacacccaggagcctcatctgcacctggacctaatatggtgataaaattttaggcttggagctgatactgtaatgaggtgagccttttgggaccttggaatggggtgaatgtattttgcatgtgagagggatataaagcattggtggtcagagggaagactctggtggacacacactaaggtgatacatagtgagtcacacaatcttgtataatttcctctccttgggtgcagatagaatctctgtgacttgtttctaacaaatagaatatggcgaaggtgatgggatatcactcccttgatcaggttatattacagtcaaagatgatatgatataactcccatgatttcattacattatctaacactctgctttagtagactggcacaagagattctccttactggcttaatgaggtaagcgtctatattgaggaaacccacatggcaagaaactgcaggcagcctctagaaaccatgggtggcctcttcgatttgaaggtagcttccagctgacaaccagtaagaagccagggccctcagtcatgtagctgcaagaaaataaaatctgccaatgacgtgaatgatcttggaagtggattcttccccagtcaagtttccagatgaaaatatagcctggctgacaccttgtgagatcctgaacagaggacttagttaagctatgtgtgaacttttgacacacagaaactgtgaaataataaaagtgtgttgtcttaagctact

SEQ ID NO: 4501 - DNA, 1493 bp, human
tgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctccggtaagctcccttgctgagagggtcgatggactacaagttaaagtcactcagctggatcccaaggaagaagaagtgtcactgcaagtaatcaacacccgaaaagccttcagaagctccaccattcaagaccagaagctttttgacagaaactctctcccagtgcctgtcttagaaacatacaatacctgtgatactcctccccctctcaacaatcttaccccttacagggacgatggaacagaggcactcaaattctacacagacccttcatacttctttgatctttggaagaagaagatgctgcaggacaccagggatatcatgaaagagaagagaaagcacaggaaagaaaagaaagataatccaaatcgagggaatgtaaacccacgtaaaatcaagacacgtaaggaagagtgggagaaaattaagatggggcaagaatttgtggagtccaaagaaaagctggggccttttgggtatccacccaccttggtgtaccagaatggcagcattggctgtgttgaaaacgtggatgcaagtagctatccaccaccatcacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaagctctaaacccgggtttgctccaccacctgcccctccaccacccccgcctccaatgataggcatcccacctccaccaccgcctataggatttgggtctccagggacgcctccaccaccctcaagcccatctttcccacctcaccctgattttgctgcccctccacctcttcctccaccaccggcagctgactacccaactctcccaccacctcccttgtcccagccaacaagaggagcacctcctcctccccctcctcctcctccggggccccctcctccccctttcactggtgcagatggccagcctgctgtaccaccaccgctttctgacaccaccaagcccaagtcctccttgcctgccataagcgatgcccatagcgacctgctttcagccatctgtcaaggttttcagctgcgcagggttgaggagcagcaggaacaagagaagtgggatgtcgtgggcaatgacgtggccaccatcttgtctcgtcgcattgctgttgagtacagtgactcagaagatgactcctctgaatttgatggggacgactggtctaattaa

SEQ ID NO: 4502 - DNA, 6863 bp, human
tgcctagaaacaagatgtccttcagttctccaggacagcaagtcatgtatcccccagggtacaaaacccagggtgagttgctttctggggtccctcagctgtggggcaagtgaggcatacacagacaagactccttccttctctggcagctttcctgagcctcaggggacccgctcataatgattcctaggcttccattgtcccttgctgcctgtctgtaagtaataaacctgattcatgtaacttgtgtgtgtgtggatgttctgtcccactggactcagagaagttggtaatcagtgcacagtgaacctgtttcgtatctatgttactaaaattcattcaacactgcatgaatatttacagtccactgatgctctgttgttgactgtgtcaacattgtctgtgttttccctgatcatattatagattcacatgtattcatgttactattctgattattataaacctcctaaatccaatggtaaatggaagcaataactaaacaaagaaacaaatgatgacttagcagagaccaggtcttttctggttcttttgtagagaagaaaagggatctatgaagtcagagttggggaagtgaggatgtacaagtgaggggataccttgcagagtctagaatcagcagggagctgcctcccttctcctctaggccatggggctgaaccctccacatcccccctctcctccatcaactacattatacagtccactgaaacacgcaggtctctggataagctgctgaaaggggacatagacattggaagtcagaatggaactgatctatttggatttggaaatactcatgagtacccagacttacagatgatattgtctggagcattatggtgcaacatccataaggtctctgggaaagcctgccttatattcccacacagagggtacaacagcagtaaactccacaacagagggatatgcctatccctgcggtccaggttaatgttataagcaacttttgccattagaattgtcctgacctgaatcaggatgctaagcattagtctagagacaatgtgtggccagacatagctttgatttgttggtgcatgtcttgtggggctatctgaggcatttcctgaattcttaattataaagcagtttccccactgccaatcacaaccagatatgatgataggttggctaagtatatatatttaacaggctacagagagagctatgaatactcatgaaagtagtgataagccctgtccagttcttgagactggatcagcttaaatagctgtgtctcatccaggaggcggcattacagatgggctaggcctctgcctctgatggagacaaacaaatttttaataagaggcatttctatggaaacagaagaaaaacaaagattaatgttgggcacaatttattcagatgttagactccaggatcttaattatagaggaggaaggaagaggcaatctgacacttttttctcacctatgttacaaggaataagctgcagcttgcagggcttcaggaaaaaggtactagcaatttcattgaatccaagtcagaaaagtaaaagaaaaaattggaaaacattagtttggggactcatagcccggaaataatttaggattcactccaaattgtagaaaataataaaaactcaacaacagtgaacaaaactagaatctaacaataagtgtactacatttttttccaaaacatactttttctctctccagtccctgtttttactaaagacaaatcacagtaggacaaatgtatttgcaaaataaattttagtcttactattcttggcctaagtgtttgcataaagtcagcaggaataattatttgtcatataggctcttttgaaaattggctttgctggaactttattccataaggaatcttggattagactttcaaagccttgagcccagccatggattcatctgtgcctgcaatacttgtatgatttgggtgaattcctcacttcaggtcccaagataacttggagctcctaggcctgtcagagaatgacattctttacttaccacaggtcaaaaaccctatacagggactgcatagacaatgcatgaggccagtttttccaaggggcttttatgggctttataagtcaactttgattccttaaagcagtatgaaagtgtgccattccaaccaaagccttggtaaagtaaccagtatctccagttgtgtcttgttagataagaaaacagattcttattgaacttatgcaaataacttaagtatactaacaaatggttttaaaattctggagaaagcaagtagagggaaagaaatgtgtttcaagttttgctcacaggagtgtactttatgcaattgttaaaagctgcaaatagctcaaaagaaaaagtttttctggattctgaaaaacaagagttagcaatgttttaaacaaaatgccataaaaagattttggtcttctgttggttcagtctatgtaattaagtcctgttccactcaatattcatgaacacattagctctctatgggagtcttggaagttttgcctctattctgatgccacaatctctgaagttatcagaaacctgcattcaagagcagctctcagagtcctatagctgattacaaaatcgtttgaaaataatcaaagtaaaacaattgtggatgacaaaagtcttagaataaccatgattaaagtctgaacatctctgtggcatgcagcaatttaatataacaattataattattacttatatactgagacataacagaattgcaagaatcatatacaattttggaacacacaccaataacacatttatacaaatacaacccaaagagatctgaaaaccattttgtacttgacaatacttcctgtatgattttaatatacagaacaagctgaatatgtccctattggactttaggggacccaatatctaaaagtgttaaccagatcaaaaaagggggcttaatttaaaatctgactgtggaaagtttgtcaaatatcaaaggtttaaacacttagtattataaaataaaattctaggtcaccattaataaaagggaaaaatctgtactcattaatagaggggaaacagctttccaaacaggacccaataaagatgcatgaggccagttgaatctgtctcctctcctctcgcttttttctgtcatttattccaaaggtaaacaaaaatatttcactatcttttaatattacatgcaaatcttgttcaaaagagaaagctaaatttcacctttgtttgcattagtgtactattaatgttaaacccaattcttaataaaaccttataaacaaaatctatccaatcttaattagtttgactataaggtaaaatttccagaaaccttttataatcctttacagctttctattaaacagcagatcaattctctaagaaaaccctgttactcagacacaggggcccagattccggccctgcatcagtgtgctttcatttcaatgttcaacccacaaaaaaactaaatcatccctttcaaatcttaggcaacttgcttatacccactgaacttcgtttataagatccacccttcacaaattcttcacaacttgcttaaactttcagttttgtcccattactcctctatgttaggacaatcttaacctctgaacaagacaaaattacattccctttaacaaaaaccatgttttcatgccttcttataatcttttaccaaaaacacattctactttccttacacaccttgcatgtaaaactatttttccagtagtcgcaagtacatattacaatgttaactcttagcaacttttattgttggtgaaaacctggcgagtaagcaattttaaccatgtataagattgcagaacacatgacttcccagcctagccagggggcctggctaacttcatatgtccccaggccttacctaggatctaattgctgtaaaacaggcaagtcaagcaattactaaaagtcgtagaagcagtttatgaccttaaaacatctagcaaacagtatccgatccccccaatttagaccaaatatctaaattttgaagatatttttattttactttaccaataatctttaagctgtctttatttttcaaagattgttagagacattgtgacttaaaaggcattaaagtctatttttctgacaaaatattttatttaagtgcttatcattcttaagccaataaattagaccactatcatatattctggtagcgaaacatcacacacatcatatataaatacacagatatggagatgatttggtagggtgacaaaagattagatgcaagaggaaggaggaacagacaggagcaggtgcagaattagacagatatccatcaactgaggaggttttagaggcagagcaggggctttaaaacaatatccatgcacatatagtgcaaatatcagccttaattaagttgatttcgaactacagagctctccaaaggagaatcattttaaaatattttattactagattttagtcaagagaaatggccaatatttctggcttttgaattcttttacctcctacatgaaatcaataagccttaactaacggtatgactttaccacaggtgcatgaagtatcttcaatgagacagcaagcggtttttacaagatctagaattgctccaaaggtagctcagagaaaagaaaatttcaagacaggaaatcagaagctgtccatggaagggaaaagaaccaataaatggcaaaaagtcacacacatagcgaatgggaaaggactaattacctaagctgggaattgaacccaggctgccagtgtgaaaggccagaatcttagctcctgaactattgcacaaggtgacgactactgcttcttcccaggagtctagagcagtcatttttgagcttgcaaatgattttaactattcaagaaaatttagactagatataacacaatcatgtgtcctttttagtctcaagagtcaaagccctgtaacttaacggcgcaaggactttaaagacaatacagaaacttacatggatacaataacctttttaagtccataatttgaattagcttttaaataacttttgaattagacaaaatttttttttgtcaataagaacatattttccttgtcacattttctataaaactaggaagcaagaaattctttttttgaaaaagtgaaagcaattttattaagaaagtaaaggaatagccggctgtgtggcagcccgcgaggcggtccgcgggagcacactctgtgcagagactgggcggccagcctgcccttgctgtcgctgacggtgactgcgggaggccaggttgtttttcatcattcagaacattgcctgaagcaggtccaccgtgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctccggtaagctcccttgctgagagggtcgatggactacaagttaaagtcactcagctggatcccaaggaagaagaagtgtcactgcaagtaatcaacacccgaaaagccttcagaagctccaccattcaagaccagaagctttttgacagaaactctctcccagtgcctgtcttagaaacatacaatacctgtgatactcctccccctctcaacaatcttaccccttacagggacgatggaacagaggcactcaaattctacacagacccttcatacttctttgatctttggaagaagaagatgctgcaggacaccagggatatcatgaaagagaagagaaagcacaggaaagaaaagaaagataatccaaatcgagggaatgtaaacccacgtaaaatcaagacacgtaaggaagagtgggagaaaattaagatggggcaagaatttgtggagtccaaagaaaagctggggccttttgggtatccacccaccttggtgtaccagaatggcagcattggctgtgttgaaaacgtggatgcaagtagctatccaccaccatcacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaagctctaaacccgggtttgctccaccacctgcccctccaccacccccgcctccaatgataggcatcccacctccaccaccgcctataggatttgggtctccagggacgcctccaccaccctcaagcccatctttcccacctcaccctgattttgctgcccctccacctcttcctccaccaccggcagctgactacccaactctcccaccacctcccttgtcccagccaacaagaggagcacctcctcctccccctcctcctcctccggggccccctcctccccctttcactggtgcagatggccagcctgctgtaccaccaccgctttctgacaccaccaagcccaagtcctccttgcctgccataagcgatgcccatagcgacctgctttcagccatctgtcaaggttttcagctgcgcagggttgaggagcagcaggaacaagagaagtgggatgtcgtgggcaatgacgtggccaccatcttgtctcgtcgcattgctgttgagtacagtgactcagaagatgactcctctgaatttgatggggacgactggtctaattaa

SEQ ID NO: 4503 - DNA, 2286 bp, human
tacctgtagccctggagagacgaaaatgtatttacttaacgggatgtgattgtggtattggttacatccgccttggccaatcttcccgcctcggtctcgtgactacaggcgggaaccaccccacccccactcatatttttcgttttttgattttttaaaagagacagtttcgctatgttggtcaggctggtctccacgtcctgggctcaagcgatcctcccgcctcagcctcgggactacaggcatgcaccaccttgcccaggctttttttttttttaagtagaaaccatgtttcgctatgttgaccagactggcctcaacctcctgggctcaagggatccttccaccacagcctcgggacttcaggcatgcaccacccggcccacgctttatttatttatttattttttagtggaaaccaggtttcgctatgttggcctgggctcaagggatcctcccgccttggcctggggactacaagcatgcaccaccctgcccaccctattttttttttttttttttttgcttctttgtttgtttctttctttagtagaaaccgggtttcgctatgttgcccaggctggcctcaatctgctgggctcaaatgatgctttcacctcggcctcaggaatacaggagtgtgccattcttcctgctcattttaattttatttacttatttataggaaagacaggctttcgctttgttggccaggctggtattgacctcctgggctcaagcagtcctcccaccttggcctcggaactacaggggtgagccatcccacccacgcaatttttttgttgttcttgttgttagtagaaatggggtttcgctatgttggccaggctggcctcgacctcccaggctcaagcaatcctcccgcctcagcctggtgactacaggctcacaccaccccaccaccactaatatttttaatttttctagtagagacagttttgctatgttgtcctggctggtccctacctcctgggctcaagcgatgctcccgcttcggccttgggactacaggcatgcaccaccctgccttttgctatttttcccaggctggtcttgaccttctgggctcactcaatgatttgaacctgggaagccgaggttgcattgagctgagatcacaccactgcactccagcttgggcgacagagcaagactgtcaaatagataaatacatccatacatgaaagaaagaagaaagaaaagaaagaaagagaaagaaagaaggaaggaaggaaggaaggaaggaaggaaggaaggaaagaaagaaagaaagaaagaaagaaagaaagaaagaaagaaagaaagaaagaaagaaagaaagaaaccagctgaatctccgtaaaaacagtaagctttgtggtatattaacttaccctcatcccatctcgtgctcccagcttggttctgttcattgctgatgaaatacacataggattggccagaactggtagatggctagctattgatcatgaaaatgtcagacctgatatagtcctccttggaaaggccttttctgagggctgatactctgtgtctgcagtgctgtgggacgatgacataatgctgagcattaagccaggcgaccatgggtccacatacggtggcaatccactaggctgctgagtggccatcgcagcccttgaggttttagaagaaaatcttgctgaaaatacagaacaaaatgggtattctcttgagaaatgaacccatgaagctaccttctgatgctgtaactgctgtaagaggaagagaattattgtgtgtatgtgtgtatgtatgtatgtatttagagtcagaggttcactctggttgcccaggatgcaatggtgcgatcttggctcactgcaacctctgcctgctgggttctagcgattctcctgcctcagcctcctgagtagctgggattacaggcacgtgccactatgcccagctaattttcatatttttagtagagactgggtttcaccatgttggctacgctggtcttgaactcctgacctcaggtgatgcacccacctcggcctcccaaaatgttgggattacagacgtgagccactgtgcccgggaggaaaataattattaatttctattgttattaaagaaaccaaagattgtgatgcttggaaggtgtgtctacgacttcaagattatccacttctggccaagccaacccatggcgacatcatcaggtttcgcctccgctggtggtgaagggggatgagattcaagtccagtgaaatcattaacaaggccatcttgtcgttc

SEQ ID NO: 4504 - DNA, 9359 bp, human; identical to SEQ ID NO: 3379

SEQ ID NO: 4505 - DNA, 10790 bp, human; identical to SEQ ID NO: 3380

SEQ ID NO: 4506 - DNA, 764 bp, human
caccataatttttttttttttttttgagacggagtctcacactgtcgccaaggctggagtgcagtggtgagatctcggctcactgcaacctccgcttcccgcgttcaagcgattctcctgcccaaacctctcgagtagctggggctacaggcacgtgacaacatccccggctaattttttgtatttttagtagaggcggggtttcaccgagttacccaggatggtctctatctcctgacctcatgatctgcccacctcagcctcccaaagtgctaggattacaggcatgaaccactgcacccatccaaactgcatacattttaaggaacaagtctcgtgtctgatgtatggaccacacaaagagttcgccaaactgtcgaatgccataaccagagacattcgaaccacaaatcaggatgagaagttgacgattccacattgtagacagcttttccgaagacatcagaataagtcttcatatcataatgagacccttatccccttaatgtctacatttttcacttggcagaccatgactcccaaatcctttgattcacctagtgaatcctttttatagagtggtcccttttatagagttggcactctgctttaattcaacccagtcctcaaatgctactcaaagactataagaggtctcattcaattcccccatagtcttttgatttgtttagctggtggcccttaggcttgggatcttagttcaaaatcattgtacaaactaaatttattctactattgctaat

SEQ ID NO: 4507 - DNA, 2982 bp, human
atgttttccaaactagcacatttgcggaggtttgctgtacttagtcgtggagttcattcttcagtggcttctacatctgttggaactaaaaaaacagtccaaggccctccaacctcttttattcttatttttttttcttttttttttttttttgtagttttcttttttttttcttttattattatactttaagttttagggtacatgtgcacattgtgcaggttagttacatatgtatacatgtgccacgctggtgcgctgcacccactaactcgtcatctagcattgggtatatctcccaatgctatccctcccccctccccccaccccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcaatttttatggctgcatagtattccatggtgtatatgtgccacattttcttaatccagtctatcattgttggacatttgggttggttccaagtctttgctattgtgaatagtgccgcatttttggaagggaatgtaagtgtggtgcgcacaattaccatcctttacctgtagccctggagagaggaaaatgtatttacttatgggatgtgattgtggtattggttacatccgccttggtcaatcctcccatctcattctcgggactacaggcatgcaccaccctgcccaggtttgtttttgttattattattattattttttagttgaaactgggtttctctatgtaggccaggctggcctcaacctccagggctcaagggatcctcccacctcctcagcctggggaccacaggcatgcaccaccctgcccacggtattttttttgtttttcagtagaaaccgggttttgctatgttgcacagactggcctcaacctcctgggctcaagcaatgcttccacctcagcctcgggaccataggcgtgtgccattctgccctgataattttttttaggagagacaggctttcgctatgttgaccaggctggtatcgaccttctgggctcaagcaatcctcccacctcagcctgggaactacaggggtgagccaccccgcccatgctatttttggttgttcttcttattagtagaaatggggtttcactatgttggccaggctggccttgacctcctgggctcaagcaatcctcctgcctcggcctcgggaccactggcacacaccacccagcccccactaatatctttaatttttctagtagagacagtttcgctatgttgtccaggctggtctctacctcctgggttcaagtgatcctcctgcctcggcctcgggactgcaggcctgcaccaccctgccttttgctatgtttcccaggctggtctcaacctcctgggttcactcaatgatttgaacccgggaaggggaggttgcattgagctgagatcccaccactgcactccagcctgggtgacagagaaaaactgtcgaaaagaaaaggaagggaagggagaagggatgggagaagggaagggagaagggaagggaaaggagaagggaagggaagggaagggaagggaagggaagggaaaggagaagggaagggaagggaagggaagggaagggaagggaaaggaagggaagggaagggaagggaagggaagggagaagggaagcgaaaggagaaggaaaaggaagggaagggagaacggaagggaagaaggaagggaagaaagggaagggaagatgggaagggaagacaggaagggaagatgggaagggaagaagggaagagaagaaggaagggaaggaaagggaagaaggaagggaagggaagaagggagggagggaggaaggaaggaaggaaagaaggaaggaaggaaggaaggaaggaaagaaagaaagaaagaaagaaagaaagaaagaaagaaagaaagaaagaaagaaagaaaagaaccagctgagtctccgtaagaacagtaagctttgtggtattttaacttaccctcgtcccatctcgtgctcccagcttggttctgtttattgttgatgaaatacagacaggagtggccagaactggtagatggctggctgttgatcatgaaaatgtcagacctgatatagtcctccttggaaaggccctttctgggggctgatactctgtgtctgcggtgctgtggaatgataacataatgctgaccattaagccaggggaacgtgggtccacatacggtggcaatccactaggctgccaagtggccatcgcagcccttgaagttttagaagaagaaaaccttgctgaaaatgcagaaacaatgggtattctcctgagaaatgaacccatgaagctaccttctgatgttgtaactgttgtaagaagaaaataattattttatttatgtatttatttgcttaagtcacaggttcactctggttgcccaggctggattgcaatggtgcgatcttggctcactgcaacctctgcctcctgggttcaagtgattctcctgcctcagcctcccgagtagctgggattacaggcacgcaccactatgcccagctaacttttgtatttttagtagagacggggtttcaccacgttggccaggccggtctcgaactgctgacctcaggtgatccacccaccttggccccccaaagtgttgggattacaggtgtgagccaccacacccggtgtggaaaagaattattaaatgctattgttattaaagaaaccaaagattgtgctgcttggaaagtgtgtgtctaagacttcgagataatggacttctggccaagccaacccatggcgacatcatcaggtttcacctctgctggtggtcaaggaggatgagattccagggtcaattgttatcattaacaagaccatcttgtcgttctg

SEQ ID NO: 4508 - DNA, 3315 bp, human
tgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattgtgagcgttctggggcaggcgcgtgggcaaaagcgggatggggtggctggaccatgcggaactggatggtccgggtgaggcaggcacttggccggggcgctcggcagtggggtgcaggtgggtgggttcacggtggaggcccgaaacccggggcgcagggcgagtcggtggggtttgacgaaggttgttgagatctggtggtccccggggtgaagcaaggagcctataacgcatacggagggctacgtggggacagcctgcgtgaactcatcagtggacgcatcgaaggggtcccagggtgctgggaagtgggggcctcctgtggcagggcgtggcgcggcctgggcacaggagggcgggctggcagcgcgcccaggggcagggcctgttggggtggggcccccccgccccgcgctagtcccgcggtgtagagcgccccgcccttcgccagttcttcctcgcccttcagaggccgggcgggatgtccttagcttttcggggtttccacccttctcaaagtgggcgccgcctttgagtcacttgtaaaaggggtgcggcgcctttaacggagtcctgcctctctggtgtcactctcaccgcttcccaaaggggttgctgggggaaccgcgtgttccgccccggtcaaggccacaaagctggcgtcagcggggctcacaaaacacctggcagcgccactcccctcaggctgcccgtaacctagaagggaaaagaggaaactgaggcacccaactctactccttacttgttgggtgaccctggccaagccattaaacctctctgtgcctcagttttctcgtctataaattagaaagagtaataatagtacccagagcattagattgtcgtgatgattgaatttggaacacagtgagcacataaaaagtgtttagctattattgtatgtcatttccccagccctcgtaggcatcttagtatgggacccccaatttaaaccaatcttctcagccctggttgctgattgaggtcccctttcccatgtcacccttccagatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgtgagaaggggtccacaatggcaagaccagggaggggtctgggcagttaggattgtcggggaactgtggttgctgacttccctcttctcctccctacacctcacaggatttcttccgaaccctcatagcggcaatcctctacctgatcacctccattgttgtccttgttgagagaggaaaccactccaaaatcgtcgcaggggtaaaggccatgggagcagctctgaagcacagagcgaagggtttgaggagccagggaccatttctgcctttgcttctggcagaaatcgtgtgacccacagcaagtcacacttgtcctcagacatggaggaaagtctggcccaggacttggttttgcctcccaaggtcttcatttgctgtgaagggaagtcccttgtcagacacaaggaccttggtgagaggtacaaacaggcggcccctttgtcaacgcactagactaccatctgcaagaactttgtcccaaatgtagtagaaattggggccgggcgcagtggctcatgcctgtattcccagcactttgggaggctgaggccgaggcaggcagatcacttgaggtcaggagttcaagaccagcctggccaacatggcgaaaccccatctccactaaaaatacaaaaatcagccgggcatggtggtgggcgcctatagtcccagctactcaggaggctgaggcaggagaatcacttgaacccagaagacaaaggttgcagtgagccaagatcatgccactcactccagccccagtgacagatgggtgacagagtgatactgtgtctcaaaaaaaaaaaaagtatgacttgaattgtgccccctacgggtagggccacagtgtggcctccctgtgttgagaggtataggaggagggagagtggggtaggatgcactctcttggcctttccctggcttaccaacccggtgcttgagtcccatcctgcgtggggcaggtgctggaggtggtggatacaagaagataagagactgagtaacctgaccagctaatctaaaccccctcactcctatcctgtcccccaggtactgggcctaatcgctacgtgcctctttggctatgatgcctatgtcaccttccccgttcggcagccaagacatacagcagcccccactggtaagtgtgtgtgtgtgtgttggttgggggtaagggggttgctgagagggcagagggaaaaaggaaagggatctcttaaaggcacgaatgccaactctggtctcgtattggtacttagggcttttgtaccaataggtaccataagcttcggtattcttgtgtgtaaaatgttcatggactttggatcttgttttaaaaaatgggcatatagattcagccaatgctttctctcttttcctcacctgcagaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaataaagtaatcctttcatcaaatgtgggtaaatttcaagcatcaggagggggaaatggagtggaaacagctggggcaaggaggcaaagaagccaggcctgttttacaacaaatattaaattacttcaataatacaaacgag

SEQ ID NO: 4509 - DNA, 1757 bp, human
tgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattgtgagcgttctggggcaggcgcgtgggcaaaagcgggatggggtggctggaccatgcggaactggatggtccgggtgaggcaggcacttggccggggcgctcggcagtggggtgcaggtgggtgggttcacggtggaggcccgaaacccggggcgcagggcgagtcggtggggtttgacgaaggttgttgagatctggtggtccccggggtgaagcaaggagcctataacgcatacggagggctacgtggggacagcctgcgtgaactcatcagtggacgcatcgaaggggtcccagggtgctgggaagtgggggcctcctgtggcagggcgtggcgcggcctgggcacaggagggcgggctggcagcgcgcccaggggcagggcctgttggggtggggcccccccgccccgcgctagtcccgcggtgtagagcgccccgcccttcgccagttcttcctcgcccttcagaggccgggcgggatgtccttagcttttcggggtttccacccttctcaaagtgggcgccgcctttgagtcacttgtaaaaggggtgcggcgcctttaacggagtcctgcctctctggtgtcactctcaccgcttcccaaaggggttgctgggggaaccgcgtgttccgccccggtcaaggccacaaagctggcgtcagcggggctcacaaaacacctggcagcgccactcccctcaggctgcccgtaacctagaagggaaaagaggaaactgaggcacccaactctactccttacttgttgggtgaccctggccaagccattaaacctctctgtgcctcagttttctcgtctataaattagaaagagtaataatagtacccagagcattagattgtcgtgatgattgaatttggaacacagtgagcacataaaaagtgtttagctattattgtatgtcatttccccagccctcgtaggcatcttagtatgggacccccaatttaaaccaatcttctcagccctggttgctgattgaggtcccctttcccatgtcacccttccagatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgtgagaaggggtccacaatggcaagaccagggaggggtctgggcagttaggattgtcggggaactgtggttgctgacttccctcttctcctccctacacctcacaggatttcttccgaaccctcatagcggcaatcctctacctgatcacctccattgttgtccttgttgagagaggaaaccactccaaaatcgtcgcaggggtaaaggccatgggagcagctctgaagcacagagcgaagggtttgaggagccagggaccatttctgcctttgcttctggcagaaatcgtgtgacccacagcaagtcacacttgtcctcagacatggaggaaagtctggcccaggacttggttttgcctcccaaggtcttcatttgctgtgaagggaagtcccttgtcaga

SEQ ID NO: 4510 - DNA, 28310 bp, human
ctccaaagctgggggaagagaggggggttgtgtgcagatggcccttcaatctcgaaagaaagatgtcggaatctgaaggcgggaaaggtgagagaatccttccatccctgcagacccttggagcaaggtagagcccctctgacccacccattgcccacccagaccccacccccagagagcctctaggggacaagaaccacatcaccctgttccccatcccagccagccccaaacagcctctctgccaccagagccctaacgctcagcctgacccagacaccaccccccatggcctctcagcctcatccacagccttagttcccaaaggaaacccaacctcaatcctggctctgacccctatccaaacgcccacctgaaacctaacacaaactctaccagccagaaggcaaacccctgttagagtctaaaccccaccccagatacagacctaaagtgacctaacctcaacctcaaccccgggatgtcaatactgttagtgattgcagtctctgactttccagaaagtgcacagaccctttaaaaaaaaaaacaaaaacaaaagagagaaagagagagaagacatacttgatggtggtagtaagccatgagggctctagagttagactgagtgtgactccccattcagccacttcagcaagtcacttaactttttcttctcaattttctcatctgcaaaatgggaataactctatgtgccaggcattcttttgattctgaactcatttaatcctcataacaccgctatattttaggtactgttattatcatccttattatacagataaggaaactgaggctcaaagagattacataatttgcccaaggcaacacatagctaccaagtggtaaagtcaggatttaaactcaggcagcttgtttcatccaaagctgggaatcttaaccaggccaatctaccgccctctgaggctgaaacgagaccatgggaactgggagtggccttagctgaaaaccccaatgcaaaattcaagtcccactcaaaactcaacttcgaccctaacctgtatcctaattctaattccaattcaaaatacccagtcctaacccttagacaaaactccactcctacctatgtctaaacccatccccaccctaacccaaaacccaccactcaaatttaaccttaaattcgcccaccccatggcaatttaaactctacccccaacttaaacaccaaaccctacttcacttggaaatgtaatctcaccttcactcccctataaactctcactctaatcttaattcgaacactcttacttcccagtccttaacccagctactcccagttctccctaattttccatgctcttctctccttccttcaaacagagggacaggatcaggtaggaagcagccacaattgccccaataccctgtccctccctgacacagtttctccatatagacaccaccccagagcccagtccagccaatggggcaggccctggtcccgaatgggggctgtgccccgggcccccagctgtggaaggtgaaagcagtggggcatcaggcctagggacccctaagcgaagaaaccagcacagcaagcacaagacagtggcagtggccagtgcccagcggtcacctcgggcactcttctgcctcaccctggccaatcctctgcgacggtcctgcatcagcatcgtggagtggaagcatcctggaaggcaggggcagggcccaggggtaagggtcatcagggtaccaggagtaaagaattgggtcagggctggaacagaggagggctgagatcatcaaggtcaagagtcaagaactgggttggggggcaggttcagaaaggcaaaggtcaccagggttcaagagtcaaggactgaatcacagcaagagttggggatggttaaggtttccaggagggacaaagtcaaggccttgtcagggcaggggtcgagaatgccaggacctgtcaccttgggcgtcaagggtcagcactgggtgggaggttcccaagggagtaggggggttccaatgccactctgccagggtccttgactgtgtccacctgaggcccttcgacatcctcatcctgctgaccatctttgccaactgcgtggccctgggagtttacatccccttccctgaggacgactccaacactgccaaccacaacctggtaaggcccgccccgccccagccagttcccagccaaatagagccccagtagagctcactccttccagccagaccccgccccctctctgacccggatggccctgcctggctcagccccaccctcggtcctgactatgctccccacgcccccgtcaaacctcgccttcaaataactccccgacttcccgacccgccccccggtcccacccccaggagcaggtggagtacgtattcctggtgattttcactgtggagacggtgctcaagatcgtggcctacgggctggtgctccaccccagcgcctacatccgcaatggctggaacctactcgacttcatcatcgtcgtggtcgggtgcgcgtctgcgggaggcaccccaccctagtcgccttcctaccgtcaggcccgctgaattctgggctcaggaaagcgactctttcagaccgcccccattcggcagccagaatcaggaatattattaaaacccatttctatttctagttacagggacttgtgcttttctgagaaggttagggtggaggggggaatcccaaggcctgacctccgcctccctgcccggtgctcccccatcaggctgttcagcgttctgctggagcagggccccggacggccaggcgacgccccgcacaccgggggaaagccaggaggcttcgatgtgaaggcattgagggcgtttcgggtgctgcggccactgaggctggtgtctggggtcccgagtgagtggcacatcccccgaggtcggaggtggagggtgggggtggggctgagctgaccccgcccttatttctgcctccccctccctccccgcaggcctgcacatagtgctcaattccatcatgaaggctctggtgccgctgctgcacattgcactgctcgtgctcttcgtcatcatcatttatgccatcattgggctcgagctgttccttggacgaatgcacaagacgtgctacttcctgggatccggttagtctgcccgcccctcctaggcagaacatgccccctccttcggttcctagatccaatgctgcactcagggaaacccactgaaatgcacaagattcggcccccaggctcaggttccatccccagataaccaagtcccacccatatattcaagactctgccctaaatcagactacaaccccacctcgctaatagctccgccccatcacgagactgtacccacaggctaaggtcctgccccgcacttaagacttaagtgcaagtgccccgcacttaagacaagactctgcgcctgtaatcccagcactttgggaggccgaggcgggcggatcacgaggtcaggagatcgagaccatcctggctaacacggtgaaaccctgcctctactaaaaaaatacaaaaaattagctgggcatggtggcgggcgcctgtagtcccagctactcgggaggctgaggcaggagaatggcgtgaacctgaggctgaggcaggagaatggcgtgaacccaggaggcggagcttgcagtgagccgagatgcgccactgcactccagcctgggcgacagagcgagactccgtctcaaaaacaaaacaaaacaaaacaaaaactctgcgccttggcttacacctgtattcccggcatttgggaggccgaggcgggaggatcacttacgcccaggagtttgctaccagcctgtgcaaaatagtgagatccagtctccaaaaaataataacaaaaacaattttaaaaaactttatcctcggctgggcgccgtggttcacgcctgtaatcccagcactttgggaggccgaggcagatggatcacttgaggtcaggagttcgagaccagcctggccaacatagtgaaaccccatctctactaaaaatacaaagttgagccgggcgtggtggtgcatgtctgtaatcccagctactcgggaggctgcggcatgagaatcacttgagcctgggagatggaggttgcagtgagctgagatcggatcgcaccactcactgcgctccagcctgggcgacagagtgagactcggtctcaaaaacaaaacaaaaacaaaccaaaaaaaagctttattctccacgactgttctcatacactcagaccatttacccagactcccgcccatgccttgcccctcccctattttcaagagacgcgtccaaattcacaagactccgcccccaggctcttgcctcattgttatttacaagactccacgccaggatttaaatcccggttggtgggatccctagcttcccagtggttcagaatacggagctcgcagggttctgccctagaagtggagctaagtgttgccttagaaaaatctaggactggccgggcacggtggctcacgcctgtaatcccagcactttgggaggccgaggcgggcggatcacaaggtcaggagttcgagaccaacctgaccaatatggtgaaacccccgtctctactaaaaatacaaaaaaaattagccgggcgttgtggcacacgccggtaatcccagctactcaggaggctgaggcaggagaattgcttgaacccgggaggcggaagttgtggtgagccgagatcgtgccactgcactccagcctgggcgacagagggagaccccgtctcaaaaaaagaaagaaagaaagagagaaagagaaaaatctaggacccaagtcgagcttcctaagtgggcggggcttcagggtggcagcgactgagagtgggcctgcttcgaagccccaagctccagtcttcctgcagacatggaagcggaggaggacccatcgccctgtgcgtcttcgggatcagggcgtgcgtgcacgctgaaccagactgagtgccgcgggcgctggccagggcccaatggaggcatcaccaactttgacaacttcttcttcgccatgctgacagtcttccagtgtgtcaccatggaaggctggaccgatgtgctctactgggtgaggtggactgtgggcacagagctcaaaggctgcacctgcctttcctccctgacactcacgcaggagtgtctgcctaccctgagggatgcatgccttttctctccccagatgcaagatgccatggggtatgaactgccctgggtgtactttgtgagccttgtcatctttgggtccttcttcgtcctcaaccttgtgcttggcgtcctgagtgggtgagggacctagacactccctgcttcccacccctcagccactgcccacttctttgtgcctggcaaactcctagacatccttcaaaacccatctgaaatactccttcattcaatcatgagcatctattgtatgtgaggcaccattttaggagtggaacaaaagacaaaaatctctgccttcctggttttacattctgatggggagagacagaaagtagcaacatatgcaataaaataagtgtgtgcatttatatattggcacacacatatatatagtgttttatatggaatatgtactgtggaaagaaaggaaagataaaagataagaatggagagatcttgtgattataaatagggatgtcaggaaaggctgtcttgacaaggtgttatttgagtaaaaatgtgaaagaggccaggtgcagtggctcatgcctgtaatcccagcactatgggaggccaaggcaggaggatggcttgaggtcaggagttcgagaccagcctgggcaacatagtgagacttcatctttacaaaaaatgaacaaaaatagctgggcatggtggcgcacacctgtagtcctagctactcaggaagctgaggtggaaggatcgcttgagcccaggaggtcgaggctgcggtgagctatgatcacaccactgcactccaccctgagtgatagagtgagaccctgtatctggggaaaagaaaaaaaaagagatgaggtgggtgcaccatgtggttatctgagggaaaagcattccaagcaaagagaatggtcagtgcaaaggccctgaggctagaatgtgcttggcatattcaaagagtagctaggaggctagtgtggctggagtgatgaaagcaaggtgttcagattggctcctccccctagccctctatcctcctccctcagggagttctccaaggagagagagaaagcgaaagctcgcggggacttccagaagcagcgggagaagcagcagatggaggaagacctgcggggctacctggactggatcactcaagccgaagagctggacatggaggacccctccgccgatgacaaccttggttctatggctgaagagggccgggcgggccatcgtaggcaactccaatctggcccattccctgcatgccttagatgtggtctgccctcctgagacccacccaggcctgatctgcaacaactctagccccagcccccaagttatggctcaaaatgcagaatcaagaccagcctcagctataaagactccaaatgacacccctaccctagacatggccctaaccctgcccccagtatgtcctccctaattgtcctttctctccctgcagggccacagctggccgagctgaccaataggaggcgtggacgtctgcgctggttcagtcattctactcgctccacacactccaccagcagccatggtgggggtccagccaggctggggtgggggtgggtaggcagaggtgaaagccaaagattggacctcggggtcttcaggtcctgaccactatccccaccttgcctacagccagcctcccagccagtgacaccggttccatgacagagacccaaggcgatgaggatgaggaggagggggctctggccagctgtacacgctgcctgtgagggcccccagcccctgacccagcccagaagccagtccaaaccctgactcaagtcctttctttagcctcaagcctcgatctcagtccttgacctctggccccagtcactgacaccccttctgccctttacgacacacacctcccatcccccttctttttcagaaacaagatcatgaaaaccagagtctggtgagttgggaaagttgtgcaaatccttgactccataactttgaaaccccccacctccaagccctcatgacctttggatcccccacctgagccccccagggcaggcttaggtaggtgatctcagcctgtgggctccccttcccccagccgccgcctccgccgagccaaccgggtccttcgggcacgctgccgtcgggcagtgaagtccaatgcctgctactgggctgtgctgttgctcgtcttcctcaacacgttgaccatcgcctctgagcaccacgggcagcctgtgtggctcacccagatccagggtacacccccagcctgctagtcgtctcccccagcctcctattccttctaccccagaagcttaaatccaaaacctctagggcgcctcagcccccaagacactgccttcccccctacccaaataaatccagagcccttagcctgtcccatcccaccttgtagcttacacaggtagcacttgctgtgtgcctcaagctcctttctcagcacctttctttatgtgtactgacaatttcttcaccacaaccttatgcgaattaaatactaaggcacagaacactgagcatcaaggcactgaggggttaagcgactaatctcgggacccagctagcgagtggcagagccagaattagaacccaggcagcctggctccagaatccaggctcttatcatcacactgtctggaaaagttctccacatctacaaaatggagatgatagatagtagtatccacttcatgaagcagcgaagaggagtaaatgatgtaaagtgaaaagtgcttaggacattgtatggcccaccatatagctaacactttataagtgtcagctcttactattattcattataatctcagccccagcctgaataccgagcacatttctaacccataacccacaaaccagccccagtcccgaagaaaccctagactctaactctacttgtgaatttgggtcttctggactcatagacactgactctggcccccaccccgactctgcccctcatccccatctccaagcccctcaaaacttcacctactctgacctacaaactcaccccaatccctagccctaagccttccctcagccagcacctggcctgataccagctaccgtgggtcaccccatggtccctagttacctccccacatgtcaccacagaaactggccagcccgatcatccctgcctctctccccacagagtatgccaacaaagtgttgctctgtctgttcacggtggagatgcttctcaaattgtacggtctgggcccctctgcctatgtgtcttccttcttcaaccgctttgactgctttgtggtctgtgggggcatcctagagaccaccttggtggaggtgggcgccatgcagcccttgggcatctcagtgctccgatgtgtgcgcctcctcaggatctttaaggtcaccaggtttgtattaggggagggggaagacaagggcctcaaacacagcctcaacacccccacccaagctccaatgataacttcatctgcttcaccattcattgagcagacatccattgagtgcctgctgtgtgccaggcaccctaccaagccctagggaaacaccaggaatcaaagcagacacaagttcctgtcttcatccactggggagaatgtctactccatttccattgccttcctcaacctcaactcctgctctaacgtttttccccaaccctgtctccgatttcaatgccatactattcccagcccaaaccccatcccaacccccaaccacaataccatctctgatcccaacccccaaccacaggtcacctatgagcccatttacaacgctaacacccattcccaagcccaactccatctcccacctcatccctaactcccagccccatccctgtcactaaccaccaaccataataccatcctcaatccccaaagagaactcccacgtccctaacccttaaccatcaccctatcttcaactgcaactccatttccagcctcagccccagtctcatcccatcccctcctctatcccagccctcaaccacaacttacccttaactccatctccaaccccaaatacatcacaaccccatccccaacaccaggcccagtcccaagctgaaacccaattctagcttcaccaacttccattaaacctccatcctaggctggacgcggtggctcacgcctgtaatcccagcactttgggaggctgaggcgggtggatcacaaggtcaggagttcaagaccagcctggccaatgtagtgaaaccccgtctctactaaaaatacaaaaaaattagccgggagtggtggcaagtgactgtagtcccagctactcgggaggctgaggcaggagaatcgcttgaacctggaaggtggaggttgcagtgagacgagattgtgccactgcactccagcttgggcaacacagtgagacttcatctcaaaaaaaaaaaaaagataagaaaaaaaaaaactccatcctaacctcatctcccagtctcccattatacccctaccaccaaccctaaccccaaactctcaactttcccctacctctttacttcttcttctttttttttttttttttttttttttttttgagacagagtctctgtctatcgcccaggctggagtgcagtgcaatcctggctcactgcaagctccgcctcctgggttcacgccattcttctgcctcagcctcctgagtagctgggactacaggcacctgccaccatgcctggctaatttttttttagtagagacggggtttcaccgtgttagccaggatggtctcagtctcctgacctcatgacccacacgccttggcctcccaaagtgctgggattacaggcgtgagccaccacagggcccagcttcccccacttcttactctcatctcaccccaactccaaaatcatttctaaccctgacaccaaagcctatttgagcccaacctgccgaggtgcatctcaagctggagccctgccctggctcctgatgctccagccatgtccagtggacatggcatcgaccctgccccctcccatttctgctgcagacactgggcttctctgagcaatctggtggcatccctgctcaattcaatgaaatccatcgcatccttgctgcttctcctcttcctcttcatcattatcttctccctgcttggcatgcagctgtttgggggcaagttcaactttgaccagacccacaccaagcgaagcacctttgacacgttcccccaggccctcctcactgtctttcaggtaggatctggagaccatgggatgggtgggtcggggagaccctggagttggagggggtccaagagctccacagtgacttcccacccccagatcctgacaggtgaggactggaacgtggtcatgtatgatggtatcatggcatatggtggccccttcttcccaggaatgttggtgtgcatctatttcatcattctcttcatctgtggcaactgtatccttggagctttgtggggctggatgatggtggagtcggggtgggtaaggggaactgggtggtctataggcagggtgcttctccatcctttgcagcctaagctcatcccagacatcctgttgaacgtgtttcttgccattgctgtggacaacctggccagtggagatgcaggcactgccaaggacaagggcgggtgagatctggctccacccctaacacagtctctctctgggatccctgactgggaacccctcagacacccccaccaccagagatgcctctagtcaccctggtaatccccatctccagataccatctgccagtcctcattcattcaacatgcatctattgactgcctactgtgtgccaggtcctgttctagatgctgaggagacaacaggggtcaaggcagacaagagtccttgccttcatggaactaacattctagttgaggaaggcaagaaaaataaaacaaatgaatatataatatatgttaataatatgtaataaagagaaaacagaatgaaaggatagcaagaaatgaagattgctctttggggttaaggtcagcaaggaaggtctctgtgaggaagtgacatttcaccagagacctgaatgaagtgagggagtgagccatgcaaatatctgggggaagagtattcaaggaaggggagtggcaagtgcaaagcttctggggcgctaatgttcttagcactttttttttttattctgatatggagtttcactcttgtcatccaggctggagtgcagtggtgctatctcagctcactgcaacctccgccacccaggttcaagcaattctcctgcctcaacctcctgagtagctgggattacagacgtacaccaccatgctcagctaaatttttttgtatttttagtagagatggggtttcaccatgttggcaaggctggtcttgaactcctaacctcaggtgatccacccgcctcagcctcccaaagtgctgagattacaggcgtgagccaccgcacctgaccacattcttagcactttcaaaaaataccagcgatgcccgggagcagtggctcacgcctgtaatcccagcactttgggaggccgaggagggtggatcacctgagcttaggagttcgaggccagcctggccaatatggtgaaaccctgtctctactaaaaatacaaaagaaaattagctggacaagctcgcttgaacccaggaggcggaggttgcagtgagccaatatcgcaccactgccctctagcctgagcaatagagtgagactccgtctcaaaaaaataaaaacagtgaggctggaatggagtgaggaaggaggagagtggtatggagtgaaggtcagtggaggaaatggagggccagattgagggcattctgggccagggtgaggactgtagtttttcctgaattaaggagacatgggagggttgtgggcagagttgggatatcccagacagggtttaacaggctccctctggctgctttgagaacggactgttgggaggggcagtggggaagagcggaagcaagaaagttctatgggacccaagaaaggtctgttctgactgtagtgatcccccttagcccatctgcagcaatcacccctatttcctcgcacagggagaagagcaatgagaaggatctcccacaggagaatgaaggcctggtgagttagatgcctgggcactgtctacacctcccactcccaccactacctgtctatgtgtgcatatctgtttttttgttgttgttgttttattttgagatagagtctcactctgtcgcccaggctggagtgcagttgtgccatctcggctcactgcaacctctgcctcctgggtccaagagattctcctgcctcagcctcccaagtagctgggatttacaggcatgcgccaccacactcggctaatttttgttatttttgaaagagacagggtttcaccatgttggccaggctggtctcgaactcctgacctcaagtgatccacctgcctcagcctcccaaagtgctgggattacaggcatgagccactgcgcccagccatatgtgcatgtctttaaccttcatcctctgcctattctttcccctattattacatttcttccatgcctcccctgtgtccattccctgtgtctccctcaccattgatgactcccgtcttcctgtcctcaggtgcctggtgtggagaaagaggaagaggagggtgcaaggagggaaggagcaggcaagtgggcagggccaggtggagcaggtgtgggaccttggggaaagagctcaggcagacagctcctgacccctgagaccctcctctccagagatcagccttttccaagatcatcctgaaaataacagacttggtatgtggtcagcaacatttgggaacattgaggttaaagaagggaaatgcagcctgggcaacatagcaagaccccatctctaaaaaagaaattaattagccaagcatgatgatgcaagcctgtagtcccagctactcaggaggctaaggtaggaggattgcttgagcccagaagttcaaggttgcagtgagccatgatggcaccactgaagtccagcctgggggagcagagtaagaccctatctttaaagaaaaacaagaagaagagaaacacgttttgtttactgctgaacttctcagagcctttattataaaatagtctgtatatacaacattctttcaacacacatttactgagctcctactgtgtcccaggcactgttctaagtgctgtggacatagcagcatacaaaacagactaaaataccttcctggaggagctgacattctagcagggaaatgggaagaattgaccacgtggcaaacactgttctgggtgctttacatcaacttgctcaattaatttttttttgcttttctctggtgccagacatggaggaggaggaggaggaggaagaagaggaagaagaggaagaagaggaagagggtgcagggggtgtggaactcctgcaggaagttgtacccaaggagaaggtggtacccatccctgagggcagcgccttcttctgcctcagccaaaccaacccgtgagtgccggaagtggcagggggtgaggcaggaggggctagggcaggtggaggagcatggaggagcagccaaggtgggagtgggggcatgggtgttgtgtcagggccagaactgtatcccttggaatccctgaacaattctgtggtcctgagttctgaccatggcccactccctctccacaggctgaggaagggctgccacaccctcatccaccatcatgtcttcaccaatcttatcctggtgttcatcatcctcagcagtgtgtccctggccgctgaggaccccatccgagcccactccttccgcaaccatgtgagcctttggctgggagctaggagctgaggggacactcccaggggtgtcctagtgggcacaagctgggtcagggtggagataaggagaagagccctaggtgagccgagagaggggctcattaacgcagctgatgcaatgccagcctttacggcatgtgcaacacacggggaagcaccagggaggagatcaatatttgactgaggaggaagctgtgctcagagaggttaagcaggccaaaggcgcccatgtagctgggtagaggcagaagggtccaaatttgaaccctaatctttctgatggccaagccttttgagaagtcacctaggatccccctcagccgtgactcagtggctccccgctctttctcacaccccagattctgggttacttcgattatgccttcacctccattttcactgtggagattctactaaaggtgactaatgggaccccagtcctaccctcagttgccctggcactctccccaccggttcttgcagcccacctctcctgtccccatccccacctcccccaacccccaccatccccaggtctgagtctagcctcttgtcctgtccccagatgacagtgtttggggccttcctgcaccgcggctccttctgccgtagctggtttaatatgttggatctgctggtggtcagtgtgtccctcatctcctttggcatccagtaagtgacagatccccagcccaccccattcctctcacagccagggcccagccagggccaatgcctgaggattgccccttccccagctccagcgccatctcggtggtgaagattctgcgagtactccgagtactgcggcccctccgagccatcaacagggccaagggactcaaggtaaccccaccccacccaaacccacaggacccaggccctgccctgcccctggggccaggatcactgatcaaactgaccatttgcacggatgcatgaccatacggcctggacccgacacataaatacacatctctgaccactagccatgtggcctgacccatgttccttccaagtgaccatatgtttctaccagtggccacatttctcagacccagctccctgacaggtggccacagatccccacccggcaaacacttattcctggtggatgcccacacgtctctagcccataacactgcctcttgaacacatgttgctaaccatacatccctgacccatcaccacatgtccccagcccaagtccctcagctgcatctatgaccagagtccctgccccatgaccactgtggcctgtagtgttcagtagccatatgcttgggtgcccgcagcatgtggtgcagtgtgtatttgtggccatccggaccatcggaaacatcatgattgtcaccacacttctgcaatttatgttcgcctgcatcggggtgcagctcttcaaggtggggcaaacactggagggaatgccaggcaggggtctgggcgggagtgtgatgaagggtgaacctacttgacagacatcctctctacaggggaaattctacacctgcacggacgaggccaaacacacccctcaagaatgcaagtgagtgcccaagaccctgccgtccacggagctcaggacccctcccaaagactttagagcctctagatctcaccaaggcccaaagatatagtcccagaattgtcccaagaactgcagaggccctcagatctcaccaagtcttcggcggcccccgatacctcccccaaatccctctccgcattccccaagtgacctacattccactccagacccattagcaatcaccattcccaccctgagcccccagcttccatcttgagactcctgtagagggtagtagctaaaagcctgggctgtgaagtcagacattacggttcaaatccacttcatgagacttaggtacatttcttaaacttactcagttccatttcactcaactgaaaaacggggctaaacagtgcctatctcacaaggctgttgtgaagagtaaatgagctactacatggaaaatgtactttgtacaatgtaaagttgctacacagaaaacctagcttgggccgggcgctgtggctcacgcctgtaatcccagcactttgggaggccaaggcaggcagatcacctgaggttgggagttcgacaccagcctagtcagcatggtgaaaccccgtctccactaaaaatacaaaaattagctgggcttggtgttgtgcacctgtaatcccagctactctggaagatgaggagggagaatcgcttgaacccgggaggcggaggttgcagtgagccaagatcatgccactgcactccagcctgggcagagtctttttcaagactccgtctcaaaaaaaaagagagaatagaaaagaagagaagaaaaagaaaatctagctcagtgcctggcatatagttactgctaataaacgttggctattattcgttttactttttcctggtgggcgatgatgaggatgataatggtgatgatgaaatgatgccaactatgtgccagacactagtctcatttattgacttgtgacatttattaatccttgtgacaagccaggaaatcgattctgttattatccttatttcttagaatggggaaacagaagcacagaaagggtaaatgcgcaaggtcacccagccaggacatggagggacaggatttgaacctagaacatattgctccaccactatgtcctgctgcctccatgctggagaccccagaccctttccccagttcctcacccctcctcacccatctaacctgtttgcacatccacaggggctccttcctggtatacccagatggagacgtgtcacggcccctggtccgggagcggctctgggtcaacagtgatttcaactttgacaatgtcctttcagccatgatggccctgttcactgtctccacctttgaaggctggcctgcgtgagggacagggccctgggtttatcaggggatgaggcaggggtctctgcaggattgggttgggatctcctgggaatgggtgggagtgtaccttggggatgtgacgaaggtctctcgagactggatagggttttctggagagtggtgggtgtatcagaggactgtagaggtggagttcccagaagctgggtgggggttctttggggacttgagtgaggggtctccaggaattggacagcggtttctaagggactaggtagctagatagaagcctggaaaggattggagatggtttggggggacagagtggaggtctgaggggactgggattggtctctgaagagatgaagcagggattcagcgatttctagaaagctgtgcaggtctttgggatactcattgtggggctctgtggggagatggagtggggattcaagttgatgggacagggataaatttacagatcgttgggggcttgtgtggaagttctggggaggcgcatgggggtctccaagtggttggagaaggggatttgaaggtctgtggaaacttaggggatttctgggtctttgaggttctgaatggagattctctggaggactctatgggggtttctgagggcatgggacagaggatttggactctttgagggcctggtagaggtctcttagagtatgtatggaggtcccaggtggttaggtcaggagatttaggggtctttggggtgccaggcaggaaactctggggtgtctgtgataagtagactgggggcaggtctgagggggctgggatatcccctcacctgcccccacctctaccccccctctggctcccacagactgctatacaaggccatcgatgcatatgcagaggaccatggccccatctataattaccgtgtggagatctcagtgttcttcattgtctacatcatcatcattgcgttcttcatgatgaacatcttcgtgggcttcgtcatcatcactttccgtgcccagggcgagcaggagtaccaaaactgtgagctggacaagaaccaggtgacctctgacccctgaccccctatggatggtcaccaacccttccctccttgcctcaggaccccactgctcactcatgccctgccctggtatgcagcgtcaatgtgtggaatatgccctcaaggcccagccactccgccgttacatccccaagaacccgcatcagtatcgtgtgtgggccactgtgaactctgctgcctttgagtacctgatgttcctgctcatcctgctcaacacagttgccctagccatgcaggtctgagatccctgcctgacccccgccagactcctgaccctattatctccacataatcccttgggaaccattgggaacatttaaggctgcaaataacaaaccccctgccaactaacagcaacttaagctataaagacatttgccacatttctttaagtctatggccagtacttgtaagttgcattctgatttcggagatgtaagaatgtggaaaaaaaaaaaaaagtagccagtggccattgtaagttgccatttgttataaaatgcgccccaatttcagagattctaaaatgtaaaaagatgtgcctcctggagtcaatgaactgtggtaattacctcatgtattgagaagtgcagaggtaggctgtttgttcattgttcatccgggacccatgctctatctttctgcttcaccattcttagcaagttggcattcattttcatgattgttgtttcatgatcacagctccaggcatcaaaaccacactcaaggcagggagagctgcacctggggcctctccttatttgatcctttcatcggaaagcaaaattttttttacacaagctgctaaccaacagcagatttatgtttatgtctcactagtcaacctggccttgcctaactacaagaaaagctagtaatcaagaactaaactttccagtatccataatgggaggcagacagtgcaagaggtttgaccaatacacagtgcaatcaagtccccagactcgcctcagcccaggccagggaatatttggttgggtgtggcggcatctctgcctcaggctccatctcaacctgattttctcctgcagcactatgagcagactgctcccttcaactatgccatggacatcctcaacatggtcttcactggcctcttcactattgagatggtgctcaaaatcatcgccttcaagcccaaggtggccccccttctctagccccacccaccagtggatgaattccttgggagtggagctcattgcagagctctggggttggcgatgcgggcagcagccagggagtgtgagtctagggagtgagagggactcaggtgcaggcccatcgtgtgatccaagcgaagccctgcccccctccggcgccccctactactactggccccctaccctggcttgcgagctttgagaagacagggcactgcttttctcctacttgcagcattacttcactgatgcctggaacacgtttgacgctcttattgtggtgggcagcatagtggatattgccgtcactgaagtcaatgtgagaactggcctttccactaatccactctcgccctatacaccttccctcacctctatcccggggttccctttcacgtgggtgggtggctcccacgcacatcctccctactcctggagactcagtcctcattctagctctatctcttctgagtccctgttgggttcagcaaaagtccccctctactggctttctcattccattttgtaacctatctactggctccaccatctcctgaaatgcctctcctgttatttctgttatctctttcattgcctctacatcccccatccattggctccgtcatgttcactggctcctgctttggctccatcttttctgatgacttcattggcttcatttctccaccaacttcatcatctctgacactggctctttcatggctctgtcatcaccattgactatatcattggctccatcacctccattgggtactacatggttctgtcacctcaactgacaacgctgctggttccctatctccatcactggcttctccattggcttctccatcggttctctcatctccatcatctctatgacaccactggttccatcatttcctctattggctccaatgtctctgatccatcacctcctttactctctcctctcccttccattcccattacccactttttcctaatcctaatccactaccatataaactttcccattgtcccctgtgtaatgaccccaccatcaccccctatatctgctccatcatatctcaccttgttcatttgggcctatgatgtcatcatctcctgtatcacctttttcttggccatatctccctccagaatggtggccaccttggcgaggtagcccaccctaataacagggactctctgcttcttttcccatgtccctctgtccctccatccctccggattaccctagggcctgagtgatttgggtactgggagggccaaagcatgagatagggagatagctggagtaaatgcaaactgagcatccctactgcacccctcaccccagagctctgaggacagctcccgcatttccattaccttctttcgcctcttccgagttatgcggctggtcaagcttctcagtaagggtgaagggatccgcacattgctctggacattcatcaagtccttccaggtaatcccctaccccatccctttgaccatacctcgcccccatttcacacttctcagcctgcccctttaccaccctcagaactacatctcccaacatgccatacccatttccaaattattattccaattttctcttttttctgggctctcagtttccaacacacctctggtctcactgaccttactctatctacttaacactatgttcacatttgagagacaccacagtccttggcactttggagatggactgcatctcccagtaggcccaggccagggaaagcagtgcattctggggcttatagttctttgcctgagcctgtgcatctattctctgcccccctcccccatccctataggccttgccctatgtggctcttctcatcgcaatgatattcttcatctatgccgtcattggcatgcaggcaagtggggaccctaggaagcatcccttaagcactcctctgctggcaggggatgggttaagaatagccccaaagtaggggtggcaggtagacagacaagctggacggccctgggtcaatctacacatctgtgaaatgagatcagcagtgatgccctgtttgtcagggttatgaggctcctttaggtattaggaggtgtgaaatgggtggggcatgggttcaccccactgacacagccttgatgtgtccacagatgttcggcaaggtggctcttcaggatggcacacagataaaccgaaacaacaacttccagacctttccacaggctgtgctgcttctgttcaggtgacatctactcactcccctgccaccttatgcccgtgggtgcccacccaccctctctgagccccagactgcttgagctatgggaataatatggcagcatggggctccatacagcccgagatgtttcctggctatgatgtgaggagtctgttagagtattctagcctcagccattttctttctgactgtaagacgcctccccttctcaggtctcagtgcctcatctgtaagatgcaaacatgactgtcgtcaacatggccacactggctgttaaaatattgaaatgttatctgtgccagatgtagcccctggtgagaagtaggtcatctcctcattccccagtcctcccccaactccatttaccatgacttcatagcctccccttcaggatgctacccctgtgtgactcccaccaggtgtgccactggtgaggcatggcaggagataatgcttgccagccttcccggaaatcggtgtgatcctgagtctgacttcggccctggtgaagagtttacctgtggtagcaattttgccatcgcctatttcatcagcttcttcatgctctgtgccttcctggtgagaaccatttcctcacaaccaccaccaccgtcacgggggctggccctgaggggctcagggatgtgacgtgggcagcccagatcttcatagtgggtgagagggctggtctgatgacaagatcaacccagagactcatgaccatataagcccgccccagcctcccaccatccgtccatgacagtgttctgcccttcacctaactgctcccttgctcactggcccacagatcataaatctctttgtggctgtgatcatggacaactttgattatctcaccagagattggtccatcctgggcccccatcaccttgatgaattcaagaggatctggtctgaatatgaccctggggccaagtatgccctctatacccttacctagaatccaggggacaatgtattgccctacacagtcccctagcccccaaacctccgactgctgcatctcattacccagtcaatagatgccccaaagtttccactgccccatcctctgccctctctgactgccctccagttcttccctggcaagctctggggtattggtaggaggaggtagtgatgagctggtggggccttgagaaagggctagtgggggcatcgccaatccagtggtacctccccaactcctccaggggccgcatcaaacacttggatgtggttgccctgctgagacgtatccagccccctctgggatttgggaagctgtgcccacaccgagtggcctgcaaggtctgtgcacctgcccacccccaggctcctgagagaactgtctatcacatggcaagggtgggaagggatctgccttgggtggggaggggtgtttgatcgcatcctcagaggtttctgccccttgacattcgttcctgcatacccggcattttcccagagtgggtttcatgtctctcgtgtttgcagagacttgtggcaatgaacatgcccctcaactcagatgggacggtgacattcaacgccacactctttgccctggtccggacatccctgaagatcaaaacagaaggtgtaggggaggggcaggagtgggatcgttcctggggagggtgcaaggagcaaactcattgaatcatgggccccactcctagctctgaaccccagaatgggtgacaggattctccaggcctgtttccccccaccccgtccaatgggggcggtgtgcatctgcggtagcagcttgtgaagttccccccacccaacagtgagggggcagctgtggaggttcttcctattggctcatgccccacatcctcctccaacgcagggaacctggagcaagccaaccaggagctgcggattgtcatcaaaaagatctggaagcggatgaaacagaagctgctagatgaggtcatccccccaccagacggtgagctatccccgccccagttccccgcgccagcccctgaatggcagatgatcgctctccaccacaaaaccagcgctgggcagagggcgaggggaagtccatgctggtgggtagagaggcggcgaggtgggctgggtcagagggcccctgtgtgatcttgccttctctcccttgcccctagaggaggaggtcaccgtgggcaaattctacgccacatttctgatccaggactatttccgcaaattccggcggaggaaagaaaaagggctactaggcaacgacgccgcccctagcacctcttccgcccttcaggtcttcggggcagggcctagtgtggatgggcacgtgtggcagtgctgtggctgaggctgacccccattttgatcttgtgaaacccatgtcacagataaggaaactgaggccccaggcctcacggagggccagggtggctgaaggactccttcccccaccctacccgcctgcaggggaaacagagggaaagttcagaccctgagctgcctgcttacctatttctccacccccacaggctggtctgcggagcctgcaggacttgggtcctgagatgcggcaggccctcacctgtgacacagaggaggaggaagaagaggggcaggagggagtggaggaggaagatgaaaaggacttggaaactaacaaagtggggacaagttttcactctcccaggaacttgattgtaaaatacttcgtcaatcccctgagtgattttgacactgcttctgggaagaagctcccccagagaagccccctctgcaatagaaaaatatttatttgaggctgggagtggtggctcatgcctataatcccagcactttgggagtccagggtggaaggatcgcttgaaccctagggttcaagaccagtcctggcaaaatagtgaaaccgcctctctacaaaaaaatttaaaaattagctaggagtggtggtgcaagcctgtagtcccagctacttgggaggctgaggcaggaggattgcttgaacctgggaggatgaggccacagtgagctgtgatcatgccactgcactcccgcctggtgacaggacaagaccctatcgcaaatatttatttatttatttacgtatttatttatttgacatttaccattgctgttggagggcaaggcccacattcatggacctgtgggggagacatgttatatgaccaaatgacttagccacaaagtgcatgcaacactcagtcctgtgactctccacaggccacgatggtctcccagccctcagctcgccggggctccgggatttctgtgtctctgcctgtcggggacagacttccagattcactctcctttgggcccagtgatgatgacagggggactcccacctccagtcagcccagtgtgccccaggctggatccaacacccacaggtattatcaagtgtctggaagtagattgtgagggaaggcaaggactagacactggatagaggcaattcaggaggcaggaagttgaggggggtgggagggagggcctagaggccttcaagcagaaatttgggaagaatggaggtgtttcaagggctcaggtaagaatagagggtgataagagattcatatgagaaaggcaatacaaaggtttaatgcaaaaagcacattgtgtgaaaccaagagtttcagttcacattctgcctctgccatttgctaagtgaccttgagctaatcacttttttttttttttttttttgagacagagtcccgctctgtctcccaggctggagtgcagtggcacaatttcggctcactgcaacctctgcctcccgggttcaagcgattctcctgcctgagcctcccgagtagctgggattacaggcgtgcgccataatgccaggctaattttttttttttttttcagtagagacgaggttttgccatgttggccaggctggtttcgaactcctgacctcaggtgatctgcccacctcagcctcccaaagtgctgggattacaagcttgagccaccgtgccctgcctagtcacttcgtttctatgagcctcagtttcctcacctgtttaagggggatgacaaagcacttacttcacagggataaagaaaggatgaaatgaggtaatgcatgtcaaacacttagctgctagacaatacataagcagattaaagaaaaattttaaaaaaaaatttcagagtgtctagcttgcctaggcacggtggctcacactcgtaatcccagcactttgggaggccaaggtgggaggatcgcttgagcccaggagtacaagaccagcctgcacaacataatgagaccccgtccatacaaaaaataaaaaaatagccgagcatggtggcgcatgcctgtagtcccagctacttgggaggctgaggtgggaggataaattgagcctgggaggttgaggctgcagtgagctgagatcatgctgctgcactccagcctaagtgacagagtaagacctcgtctcagaaaataaaaaatagaaataaaaaaataaagtgcctagcttttacaggctccccccactcctaatacatgcccagttttgtgttcaaggtgtctctctacaggtcaactttgatttttttgaaactttcagtcctaattagatgaacatctattaaacaaaagcccatggtcactttaaaatggttaatggttaattttatgtgacttgtcctcaacaaaaaaatccaaaagcccagtgtttctgtaagggttggggcatgggatgagaggaaccaggggtccagggccacatattgagggatctggtctgcctaacgtgcctccctttccccaggagaggctctggggctctcattttcaccatcccagaagaaggaaattctcagcccaagggaaccaaagggcaaaacaagcaagatgaggatgaggaagtccctgatcggtacactggccatgccacatgggatgaacccatgagctggggtggaggaggggtgggaactgggtcggggaggactgtttgtgccccatctcccaggcccaggtccaggcccagacccaagttcacccctggccctcccacccacacaggctttcctacctagatgagcaggcagggactcccccgtgctcagtccttttgccacctcacagagctcagagatacatggatgggcacctggtaccacgccgccgtctgctgccccccacacctgcaggtgagagcagggatggatccaaggggcccccacgggcctgcaggacagagatctggggaagcactgacattgctatttgcccctggtgccccacccacccccaggtcggaagccctccttcaccatccagtgtctgcagcgccagggcagttgtgaggatttacccatcccaggcacctatcatcgtgggcgaaattcagggcccaatagggctcaggtgaggctgtggaggtggtgctggggtctggggtctggagagatgggggcagcctaggctgaatttctcaaacacagcacatatcaggcccttttttttttttttttttttttttttttgagacagagttttgctctgctgcccaggctggagtacagtgttgagatcttggctcactgtaacccctgcctcccgggtccaagcaattctcctgcctcagcctcccaagtagctgggattacaggtgctcaccaccatgcctggctaatttttgcatttttagtagagatggggtttcaccatgttggccgggctggtctcaaacccctgacctcaggtgatccgcctgtctcagcctcccaaagtgctgggattacaggcataagccaccgcgcctggcctcagagccttctgaagaacaggacacatatgaatgaatgcacacaatgctcactgtacttgtgaggaaactgaggtcctgagaggtttaccccagatcatgcagctagtaagtggcagagctgacatttaaacccaggcctcctgcactcttacataaataaactcaagcctgacttatacccattcaatttcactccagttgtatactgagggaaagaagtaggcacagcggtgagtcctagaccctcataccctactcatccatccctgcccctctgatgtttattctggctcagggttcctgggcaacaccacctcagcggggtcggctcctgtatgccccgctgttgttggtggaagagggcgcagcgggggaggggtacctcggcagatccagtggcccactgcgcaccttcacctgtctgcacgtgcctggaacccactcggaccccagccatgggaagaggggcagtgccgacagcttggtggaggctgtgagtccagagggcatatagacaagacggatgggggagaaggggaggaggtgggtactggaggaggacggaaaggagtccccaggtcctgtgttgtgcatgtagatatccctttgccctacgacctctgctcacccctgtcccccactgacttccctacatgccctcatgggcacgtcatttatccacactgaaccttctgtgcacactgtgccgtccgtcaacactgatcccacctgtgcccccaggtgcttatctcagagggtctgggcctctttgctcgagacccacgtttcgtggccctggccaagcaggagattgcagatgcgtgtcgcctgacgctggatgagatggacaatgctgccagtgacctgctggcacagggaaccagctctctctatagcgacgaggagtccatcctctcccgcttcgatgaggaggacttgggagacgagatggcctgcgtccacgccctctgaattcccacccctccccaactgctcaataaacctcctgccctcccctccccagcaggaggcaggcatggaccac

SEQ ID NO: 4511 - DNA, 28310 bp, human; identical to SEQ ID NO: 4510

SEQ ID NO: 4512 - DNA, 28248 bp, human
atgtcggaatctgaaggcgggaaaggtgagagaatccttccatccctgcagacccttggagcaaggtagagcccctctgacccacccattgcccacccagaccccacccccagagagcctctaggggacaagaaccacatcaccctgttccccatcccagccagccccaaacagcctctctgccaccagagccctaacgctcagcctgacccagacaccaccccccatggcctctcagcctcatccacagccttagttcccaaaggaaacccaacctcaatcctggctctgacccctatccaaacgcccacctgaaacctaacacaaactctaccagccagaaggcaaacccctgttagagtctaaaccccaccccagatacagacctaaagtgacctaacctcaacctcaaccccgggatgtcaatactgttagtgattgcagtctctgactttccagaaagtgcacagaccctttaaaaaaaaaaacaaaaacaaaagagagaaagagagagaagacatacttgatggtggtagtaagccatgagggctctagagttagactgagtgtgactccccattcagccacttcagcaagtcacttaactttttcttctcaattttctcatctgcaaaatgggaataactctatgtgccaggcattcttttgattctgaactcatttaatcctcataacaccgctatattttaggtactgttattatcatccttattatacagataaggaaactgaggctcaaagagattacataatttgcccaaggcaacacatagctaccaagtggtaaagtcaggatttaaactcaggcagcttgtttcatccaaagctgggaatcttaaccaggccaatctaccgccctctgaggctgaaacgagaccatgggaactgggagtggccttagctgaaaaccccaatgcaaaattcaagtcccactcaaaactcaacttcgaccctaacctgtatcctaattctaattccaattcaaaatacccagtcctaacccttagacaaaactccactcctacctatgtctaaacccatccccaccctaacccaaaacccaccactcaaatttaaccttaaattcgcccaccccatggcaatttaaactctacccccaacttaaacaccaaaccctacttcacttggaaatgtaatctcaccttcactcccctataaactctcactctaatcttaattcgaacactcttacttcccagtccttaacccagctactcccagttctccctaattttccatgctcttctctccttccttcaaacagagggacaggatcaggtaggaagcagccacaattgccccaataccctgtccctccctgacacagtttctccatatagacaccaccccagagcccagtccagccaatggggcaggccctggtcccgaatgggggctgtgccccgggcccccagctgtggaaggtgaaagcagtggggcatcaggcctagggacccctaagcgaagaaaccagcacagcaagcacaagacagtggcagtggccagtgcccagcggtcacctcgggcactcttctgcctcaccctggccaatcctctgcgacggtcctgcatcagcatcgtggagtggaagcatcctggaaggcaggggcagggcccaggggtaagggtcatcagggtaccaggagtaaagaattgggtcagggctggaacagaggagggctgagatcatcaaggtcaagagtcaagaactgggttggggggcaggttcagaaaggcaaaggtcaccagggttcaagagtcaaggactgaatcacagcaagagttggggatggttaaggtttccaggagggacaaagtcaaggccttgtcagggcaggggtcgagaatgccaggacctgtcaccttgggcgtcaagggtcagcactgggtgggaggttcccaagggagtaggggggttccaatgccactctgccagggtccttgactgtgtccacctgaggcccttcgacatcctcatcctgctgaccatctttgccaactgcgtggccctgggagtttacatccccttccctgaggacgactccaacactgccaaccacaacctggtaaggcccgccccgccccagccagttcccagccaaatagagccccagtagagctcactccttccagccagaccccgccccctctctgacccggatggccctgcctggctcagccccaccctcggtcctgactatgctccccacgcccccgtcaaacctcgccttcaaataactccccgacttcccgacccgccccccggtcccacccccaggagcaggtggagtacgtattcctggtgattttcactgtggagacggtgctcaagatcgtggcctacgggctggtgctccaccccagcgcctacatccgcaatggctggaacctactcgacttcatcatcgtcgtggtcgggtgcgcgtctgcgggaggcaccccaccctagtcgccttcctaccgtcaggcccgctgaattctgggctcaggaaagcgactctttcagaccgcccccattcggcagccagaatcaggaatattattaaaacccatttctatttctagttacagggacttgtgcttttctgagaaggttagggtggaggggggaatcccaaggcctgacctccgcctccctgcccggtgctcccccatcaggctgttcagcgttctgctggagcagggccccggacggccaggcgacgccccgcacaccgggggaaagccaggaggcttcgatgtgaaggcattgagggcgtttcgggtgctgcggccactgaggctggtgtctggggtcccgagtgagtggcacatcccccgaggtcggaggtggagggtgggggtggggctgagctgaccccgcccttatttctgcctccccctccctccccgcaggcctgcacatagtgctcaattccatcatgaaggctctggtgccgctgctgcacattgcactgctcgtgctcttcgtcatcatcatttatgccatcattgggctcgagctgttccttggacgaatgcacaagacgtgctacttcctgggatccggttagtctgcccgcccctcctaggcagaacatgccccctccttcggttcctagatccaatgctgcactcagggaaacccactgaaatgcacaagattcggcccccaggctcaggttccatccccagataaccaagtcccacccatatattcaagactctgccctaaatcagactacaaccccacctcgctaatagctccgccccatcacgagactgtacccacaggctaaggtcctgccccgcacttaagacttaagtgcaagtgccccgcacttaagacaagactctgcgcctgtaatcccagcactttgggaggccgaggcgggcggatcacgaggtcaggagatcgagaccatcctggctaacacggtgaaaccctgcctctactaaaaaaatacaaaaaattagctgggcatggtggcgggcgcctgtagtcccagctactcgggaggctgaggcaggagaatggcgtgaacctgaggctgaggcaggagaatggcgtgaacccaggaggcggagcttgcagtgagccgagatgcgccactgcactccagcctgggcgacagagcgagactccgtctcaaaaacaaaacaaaacaaaacaaaaactctgcgccttggcttacacctgtattcccggcatttgggaggccgaggcgggaggatcacttacgcccaggagtttgctaccagcctgtgcaaaatagtgagatccagtctccaaaaaataataacaaaaacaattttaaaaaactttatcctcggctgggcgccgtggttcacgcctgtaatcccagcactttgggaggccgaggcagatggatcacttgaggtcaggagttcgagaccagcctggccaacatagtgaaaccccatctctactaaaaatacaaagttgagccgggcgtggtggtgcatgtctgtaatcccagctactcgggaggctgcggcatgagaatcacttgagcctgggagatggaggttgcagtgagctgagatcggatcgcaccactcactgcgctccagcctgggcgacagagtgagactcggtctcaaaaacaaaacaaaaacaaaccaaaaaaaagctttattctccacgactgttctcatacactcagaccatttacccagactcccgcccatgccttgcccctcccctattttcaagagacgcgtccaaattcacaagactccgcccccaggctcttgcctcattgttatttacaagactccacgccaggatttaaatcccggttggtgggatccctagcttcccagtggttcagaatacggagctcgcagggttctgccctagaagtggagctaagtgttgccttagaaaaatctaggactggccgggcacggtggctcacgcctgtaatcccagcactttgggaggccgaggcgggcggatcacaaggtcaggagttcgagaccaacctgaccaatatggtgaaacccccgtctctactaaaaatacaaaaaaaattagccgggcgttgtggcacacgccggtaatcccagctactcaggaggctgaggcaggagaattgcttgaacccgggaggcggaagttgtggtgagccgagatcgtgccactgcactccagcctgggcgacagagggagaccccgtctcaaaaaaagaaagaaagaaagagagaaagagaaaaatctaggacccaagtcgagcttcctaagtgggcggggcttcagggtggcagcgactgagagtgggcctgcttcgaagccccaagctccagtcttcctgcagacatggaagcggaggaggacccatcgccctgtgcgtcttcgggatcagggcgtgcgtgcacgctgaaccagactgagtgccgcgggcgctggccagggcccaatggaggcatcaccaactttgacaacttcttcttcgccatgctgacagtcttccagtgtgtcaccatggaaggctggaccgatgtgctctactgggtgaggtggactgtgggcacagagctcaaaggctgcacctgcctttcctccctgacactcacgcaggagtgtctgcctaccctgagggatgcatgccttttctctccccagatgcaagatgccatggggtatgaactgccctgggtgtactttgtgagccttgtcatctttgggtccttcttcgtcctcaaccttgtgcttggcgtcctgagtgggtgagggacctagacactccctgcttcccacccctcagccactgcccacttctttgtgcctggcaaactcctagacatccttcaaaacccatctgaaatactccttcattcaatcatgagcatctattgtatgtgaggcaccattttaggagtggaacaaaagacaaaaatctctgccttcctggttttacattctgatggggagagacagaaagtagcaacatatgcaataaaataagtgtgtgcatttatatattggcacacacatatatatagtgttttatatggaatatgtactgtggaaagaaaggaaagataaaagataagaatggagagatcttgtgattataaatagggatgtcaggaaaggctgtcttgacaaggtgttatttgagtaaaaatgtgaaagaggccaggtgcagtggctcatgcctgtaatcccagcactatgggaggccaaggcaggaggatggcttgaggtcaggagttcgagaccagcctgggcaacatagtgagacttcatctttacaaaaaatgaacaaaaatagctgggcatggtggcgcacacctgtagtcctagctactcaggaagctgaggtggaaggatcgcttgagcccaggaggtcgaggctgcggtgagctatgatcacaccactgcactccaccctgagtgatagagtgagaccctgtatctggggaaaagaaaaaaaaagagatgaggtgggtgcaccatgtggttatctgagggaaaagcattccaagcaaagagaatggtcagtgcaaaggccctgaggctagaatgtgcttggcatattcaaagagtagctaggaggctagtgtggctggagtgatgaaagcaaggtgttcagattggctcctccccctagccctctatcctcctccctcagggagttctccaaggagagagagaaagcgaaagctcgcggggacttccagaagcagcgggagaagcagcagatggaggaagacctgcggggctacctggactggatcactcaagccgaagagctggacatggaggacccctccgccgatgacaaccttggttctatggctgaagagggccgggcgggccatcgtaggcaactccaatctggcccattccctgcatgccttagatgtggtctgccctcctgagacccacccaggcctgatctgcaacaactctagccccagcccccaagttatggctcaaaatgcagaatcaagaccagcctcagctataaagactccaaatgacacccctaccctagacatggccctaaccctgcccccagtatgtcctccctaattgtcctttctctccctgcagggccacagctggccgagctgaccaataggaggcgtggacgtctgcgctggttcagtcattctactcgctccacacactccaccagcagccatggtgggggtccagccaggctggggtgggggtgggtaggcagaggtgaaagccaaagattggacctcggggtcttcaggtcctgaccactatccccaccttgcctacagccagcctcccagccagtgacaccggttccatgacagagacccaaggcgatgaggatgaggaggagggggctctggccagctgtacacgctgcctgtgagggcccccagcccctgacccagcccagaagccagtccaaaccctgactcaagtcctttctttagcctcaagcctcgatctcagtccttgacctctggccccagtcactgacaccccttctgccctttacgacacacacctcccatcccccttctttttcagaaacaagatcatgaaaaccagagtctggtgagttgggaaagttgtgcaaatccttgactccataactttgaaaccccccacctccaagccctcatgacctttggatcccccacctgagccccccagggcaggcttaggtaggtgatctcagcctgtgggctccccttcccccagccgccgcctccgccgagccaaccgggtccttcgggcacgctgccgtcgggcagtgaagtccaatgcctgctactgggctgtgctgttgctcgtcttcctcaacacgttgaccatcgcctctgagcaccacgggcagcctgtgtggctcacccagatccagggtacacccccagcctgctagtcgtctcccccagcctcctattccttctaccccagaagcttaaatccaaaacctctagggcgcctcagcccccaagacactgccttcccccctacccaaataaatccagagcccttagcctgtcccatcccaccttgtagcttacacaggtagcacttgctgtgtgcctcaagctcctttctcagcacctttctttatgtgtactgacaatttcttcaccacaaccttatgcgaattaaatactaaggcacagaacactgagcatcaaggcactgaggggttaagcgactaatctcgggacccagctagcgagtggcagagccagaattagaacccaggcagcctggctccagaatccaggctcttatcatcacactgtctggaaaagttctccacatctacaaaatggagatgatagatagtagtatccacttcatgaagcagcgaagaggagtaaatgatgtaaagtgaaaagtgcttaggacattgtatggcccaccatatagctaacactttataagtgtcagctcttactattattcattataatctcagccccagcctgaataccgagcacatttctaacccataacccacaaaccagccccagtcccgaagaaaccctagactctaactctacttgtgaatttgggtcttctggactcatagacactgactctggcccccaccccgactctgcccctcatccccatctccaagcccctcaaaacttcacctactctgacctacaaactcaccccaatccctagccctaagccttccctcagccagcacctggcctgataccagctaccgtgggtcaccccatggtccctagttacctccccacatgtcaccacagaaactggccagcccgatcatccctgcctctctccccacagagtatgccaacaaagtgttgctctgtctgttcacggtggagatgcttctcaaattgtacggtctgggcccctctgcctatgtgtcttccttcttcaaccgctttgactgctttgtggtctgtgggggcatcctagagaccaccttggtggaggtgggcgccatgcagcccttgggcatctcagtgctccgatgtgtgcgcctcctcaggatctttaaggtcaccaggtttgtattaggggagggggaagacaagggcctcaaacacagcctcaacacccccacccaagctccaatgataacttcatctgcttcaccattcattgagcagacatccattgagtgcctgctgtgtgccaggcaccctaccaagccctagggaaacaccaggaatcaaagcagacacaagttcctgtcttcatccactggggagaatgtctactccatttccattgccttcctcaacctcaactcctgctctaacgtttttccccaaccctgtctccgatttcaatgccatactattcccagcccaaaccccatcccaacccccaaccacaataccatctctgatcccaacccccaaccacaggtcacctatgagcccatttacaacgctaacacccattcccaagcccaactccatctcccacctcatccctaactcccagccccatccctgtcactaaccaccaaccataataccatcctcaatccccaaagagaactcccacgtccctaacccttaaccatcaccctatcttcaactgcaactccatttccagcctcagccccagtctcatcccatcccctcctctatcccagccctcaaccacaacttacccttaactccatctccaaccccaaatacatcacaaccccatccccaacaccaggcccagtcccaagctgaaacccaattctagcttcaccaacttccattaaacctccatcctaggctggacgcggtggctcacgcctgtaatcccagcactttgggaggctgaggcgggtggatcacaaggtcaggagttcaagaccagcctggccaatgtagtgaaaccccgtctctactaaaaatacaaaaaaattagccgggagtggtggcaagtgactgtagtcccagctactcgggaggctgaggcaggagaatcgcttgaacctggaaggtggaggttgcagtgagacgagattgtgccactgcactccagcttgggcaacacagtgagacttcatctcaaaaaaaaaaaaaagataagaaaaaaaaaaactccatcctaacctcatctcccagtctcccattatacccctaccaccaaccctaaccccaaactctcaactttcccctacctctttacttcttcttctttttttttttttttttttttttttttttgagacagagtctctgtctatcgcccaggctggagtgcagtgcaatcctggctcactgcaagctccgcctcctgggttcacgccattcttctgcctcagcctcctgagtagctgggactacaggcacctgccaccatgcctggctaatttttttttagtagagacggggtttcaccgtgttagccaggatggtctcagtctcctgacctcatgacccacacgccttggcctcccaaagtgctgggattacaggcgtgagccaccacagggcccagcttcccccacttcttactctcatctcaccccaactccaaaatcatttctaaccctgacaccaaagcctatttgagcccaacctgccgaggtgcatctcaagctggagccctgccctggctcctgatgctccagccatgtccagtggacatggcatcgaccctgccccctcccatttctgctgcagacactgggcttctctgagcaatctggtggcatccctgctcaattcaatgaaatccatcgcatccttgctgcttctcctcttcctcttcatcattatcttctccctgcttggcatgcagctgtttgggggcaagttcaactttgaccagacccacaccaagcgaagcacctttgacacgttcccccaggccctcctcactgtctttcaggtaggatctggagaccatgggatgggtgggtcggggagaccctggagttggagggggtccaagagctccacagtgacttcccacccccagatcctgacaggtgaggactggaacgtggtcatgtatgatggtatcatggcatatggtggccccttcttcccaggaatgttggtgtgcatctatttcatcattctcttcatctgtggcaactgtatccttggagctttgtggggctggatgatggtggagtcggggtgggtaaggggaactgggtggtctataggcagggtgcttctccatcctttgcagcctaagctcatcccagacatcctgttgaacgtgtttcttgccattgctgtggacaacctggccagtggagatgcaggcactgccaaggacaagggcgggtgagatctggctccacccctaacacagtctctctctgggatccctgactgggaacccctcagacacccccaccaccagagatgcctctagtcaccctggtaatccccatctccagataccatctgccagtcctcattcattcaacatgcatctattgactgcctactgtgtgccaggtcctgttctagatgctgaggagacaacaggggtcaaggcagacaagagtccttgccttcatggaactaacattctagttgaggaaggcaagaaaaataaaacaaatgaatatataatatatgttaataatatgtaataaagagaaaacagaatgaaaggatagcaagaaatgaagattgctctttggggttaaggtcagcaaggaaggtctctgtgaggaagtgacatttcaccagagacctgaatgaagtgagggagtgagccatgcaaatatctgggggaagagtattcaaggaaggggagtggcaagtgcaaagcttctggggcgctaatgttcttagcactttttttttttattctgatatggagtttcactcttgtcatccaggctggagtgcagtggtgctatctcagctcactgcaacctccgccacccaggttcaagcaattctcctgcctcaacctcctgagtagctgggattacagacgtacaccaccatgctcagctaaatttttttgtatttttagtagagatggggtttcaccatgttggcaaggctggtcttgaactcctaacctcaggtgatccacccgcctcagcctcccaaagtgctgagattacaggcgtgagccaccgcacctgaccacattcttagcactttcaaaaaataccagcgatgcccgggagcagtggctcacgcctgtaatcccagcactttgggaggccgaggagggtggatcacctgagcttaggagttcgaggccagcctggccaatatggtgaaaccctgtctctactaaaaatacaaaagaaaattagctggacaagctcgcttgaacccaggaggcggaggttgcagtgagccaatatcgcaccactgccctctagcctgagcaatagagtgagactccgtctcaaaaaaataaaaacagtgaggctggaatggagtgaggaaggaggagagtggtatggagtgaaggtcagtggaggaaatggagggccagattgagggcattctgggccagggtgaggactgtagtttttcctgaattaaggagacatgggagggttgtgggcagagttgggatatcccagacagggtttaacaggctccctctggctgctttgagaacggactgttgggaggggcagtggggaagagcggaagcaagaaagttctatgggacccaagaaaggtctgttctgactgtagtgatcccccttagcccatctgcagcaatcacccctatttcctcgcacagggagaagagcaatgagaaggatctcccacaggagaatgaaggcctggtgagttagatgcctgggcactgtctacacctcccactcccaccactacctgtctatgtgtgcatatctgtttttttgttgttgttgttttattttgagatagagtctcactctgtcgcccaggctggagtgcagttgtgccatctcggctcactgcaacctctgcctcctgggtccaagagattctcctgcctcagcctcccaagtagctgggatttacaggcatgcgccaccacactcggctaatttttgttatttttgaaagagacagggtttcaccatgttggccaggctggtctcgaactcctgacctcaagtgatccacctgcctcagcctcccaaagtgctgggattacaggcatgagccactgcgcccagccatatgtgcatgtctttaaccttcatcctctgcctattctttcccctattattacatttcttccatgcctcccctgtgtccattccctgtgtctccctcaccattgatgactcccgtcttcctgtcctcaggtgcctggtgtggagaaagaggaagaggagggtgcaaggagggaaggagcaggcaagtgggcagggccaggtggagcaggtgtgggaccttggggaaagagctcaggcagacagctcctgacccctgagaccctcctctccagagatcagccttttccaagatcatcctgaaaataacagacttggtatgtggtcagcaacatttgggaacattgaggttaaagaagggaaatgcagcctgggcaacatagcaagaccccatctctaaaaaagaaattaattagccaagcatgatgatgcaagcctgtagtcccagctactcaggaggctaaggtaggaggattgcttgagcccagaagttcaaggttgcagtgagccatgatggcaccactgaagtccagcctgggggagcagagtaagaccctatctttaaagaaaaacaagaagaagagaaacacgttttgtttactgctgaacttctcagagcctttattataaaatagtctgtatatacaacattctttcaacacacatttactgagctcctactgtgtcccaggcactgttctaagtgctgtggacatagcagcatacaaaacagactaaaataccttcctggaggagctgacattctagcagggaaatgggaagaattgaccacgtggcaaacactgttctgggtgctttacatcaacttgctcaattaatttttttttgcttttctctggtgccagacatggaggaggaggaggaggaggaagaagaggaagaagaggaagaagaggaagagggtgcagggggtgtggaactcctgcaggaagttgtacccaaggagaaggtggtacccatccctgagggcagcgccttcttctgcctcagccaaaccaacccgtgagtgccggaagtggcagggggtgaggcaggaggggctagggcaggtggaggagcatggaggagcagccaaggtgggagtgggggcatgggtgttgtgtcagggccagaactgtatcccttggaatccctgaacaattctgtggtcctgagttctgaccatggcccactccctctccacaggctgaggaagggctgccacaccctcatccaccatcatgtcttcaccaatcttatcctggtgttcatcatcctcagcagtgtgtccctggccgctgaggaccccatccgagcccactccttccgcaaccatgtgagcctttggctgggagctaggagctgaggggacactcccaggggtgtcctagtgggcacaagctgggtcagggtggagataaggagaagagccctaggtgagccgagagaggggctcattaacgcagctgatgcaatgccagcctttacggcatgtgcaacacacggggaagcaccagggaggagatcaatatttgactgaggaggaagctgtgctcagagaggttaagcaggccaaaggcgcccatgtagctgggtagaggcagaagggtccaaatttgaaccctaatctttctgatggccaagccttttgagaagtcacctaggatccccctcagccgtgactcagtggctccccgctctttctcacaccccagattctgggttacttcgattatgccttcacctccattttcactgtggagattctactaaaggtgactaatgggaccccagtcctaccctcagttgccctggcactctccccaccggttcttgcagcccacctctcctgtccccatccccacctcccccaacccccaccatccccaggtctgagtctagcctcttgtcctgtccccagatgacagtgtttggggccttcctgcaccgcggctccttctgccgtagctggtttaatatgttggatctgctggtggtcagtgtgtccctcatctcctttggcatccagtaagtgacagatccccagcccaccccattcctctcacagccagggcccagccagggccaatgcctgaggattgccccttccccagctccagcgccatctcggtggtgaagattctgcgagtactccgagtactgcggcccctccgagccatcaacagggccaagggactcaaggtaaccccaccccacccaaacccacaggacccaggccctgccctgcccctggggccaggatcactgatcaaactgaccatttgcacggatgcatgaccatacggcctggacccgacacataaatacacatctctgaccactagccatgtggcctgacccatgttccttccaagtgaccatatgtttctaccagtggccacatttctcagacccagctccctgacaggtggccacagatccccacccggcaaacacttattcctggtggatgcccacacgtctctagcccataacactgcctcttgaacacatgttgctaaccatacatccctgacccatcaccacatgtccccagcccaagtccctcagctgcatctatgaccagagtccctgccccatgaccactgtggcctgtagtgttcagtagccatatgcttgggtgcccgcagcatgtggtgcagtgtgtatttgtggccatccggaccatcggaaacatcatgattgtcaccacacttctgcaatttatgttcgcctgcatcggggtgcagctcttcaaggtggggcaaacactggagggaatgccaggcaggggtctgggcgggagtgtgatgaagggtgaacctacttgacagacatcctctctacaggggaaattctacacctgcacggacgaggccaaacacacccctcaagaatgcaagtgagtgcccaagaccctgccgtccacggagctcaggacccctcccaaagactttagagcctctagatctcaccaaggcccaaagatatagtcccagaattgtcccaagaactgcagaggccctcagatctcaccaagtcttcggcggcccccgatacctcccccaaatccctctccgcattccccaagtgacctacattccactccagacccattagcaatcaccattcccaccctgagcccccagcttccatcttgagactcctgtagagggtagtagctaaaagcctgggctgtgaagtcagacattacggttcaaatccacttcatgagacttaggtacatttcttaaacttactcagttccatttcactcaactgaaaaacggggctaaacagtgcctatctcacaaggctgttgtgaagagtaaatgagctactacatggaaaatgtactttgtacaatgtaaagttgctacacagaaaacctagcttgggccgggcgctgtggctcacgcctgtaatcccagcactttgggaggccaaggcaggcagatcacctgaggttgggagttcgacaccagcctagtcagcatggtgaaaccccgtctccactaaaaatacaaaaattagctgggcttggtgttgtgcacctgtaatcccagctactctggaagatgaggagggagaatcgcttgaacccgggaggcggaggttgcagtgagccaagatcatgccactgcactccagcctgggcagagtctttttcaagactccgtctcaaaaaaaaagagagaatagaaaagaagagaagaaaaagaaaatctagctcagtgcctggcatatagttactgctaataaacgttggctattattcgttttactttttcctggtgggcgatgatgaggatgataatggtgatgatgaaatgatgccaactatgtgccagacactagtctcatttattgacttgtgacatttattaatccttgtgacaagccaggaaatcgattctgttattatccttatttcttagaatggggaaacagaagcacagaaagggtaaatgcgcaaggtcacccagccaggacatggagggacaggatttgaacctagaacatattgctccaccactatgtcctgctgcctccatgctggagaccccagaccctttccccagttcctcacccctcctcacccatctaacctgtttgcacatccacaggggctccttcctggtatacccagatggagacgtgtcacggcccctggtccgggagcggctctgggtcaacagtgatttcaactttgacaatgtcctttcagccatgatggccctgttcactgtctccacctttgaaggctggcctgcgtgagggacagggccctgggtttatcaggggatgaggcaggggtctctgcaggattgggttgggatctcctgggaatgggtgggagtgtaccttggggatgtgacgaaggtctctcgagactggatagggttttctggagagtggtgggtgtatcagaggactgtagaggtggagttcccagaagctgggtgggggttctttggggacttgagtgaggggtctccaggaattggacagcggtttctaagggactaggtagctagatagaagcctggaaaggattggagatggtttggggggacagagtggaggtctgaggggactgggattggtctctgaagagatgaagcagggattcagcgatttctagaaagctgtgcaggtctttgggatactcattgtggggctctgtggggagatggagtggggattcaagttgatgggacagggataaatttacagatcgttgggggcttgtgtggaagttctggggaggcgcatgggggtctccaagtggttggagaaggggatttgaaggtctgtggaaacttaggggatttctgggtctttgaggttctgaatggagattctctggaggactctatgggggtttctgagggcatgggacagaggatttggactctttgagggcctggtagaggtctcttagagtatgtatggaggtcccaggtggttaggtcaggagatttaggggtctttggggtgccaggcaggaaactctggggtgtctgtgataagtagactgggggcaggtctgagggggctgggatatcccctcacctgcccccacctctaccccccctctggctcccacagactgctatacaaggccatcgatgcatatgcagaggaccatggccccatctataattaccgtgtggagatctcagtgttcttcattgtctacatcatcatcattgcgttcttcatgatgaacatcttcgtgggcttcgtcatcatcactttccgtgcccagggcgagcaggagtaccaaaactgtgagctggacaagaaccaggtgacctctgacccctgaccccctatggatggtcaccaacccttccctccttgcctcaggaccccactgctcactcatgccctgccctggtatgcagcgtcaatgtgtggaatatgccctcaaggcccagccactccgccgttacatccccaagaacccgcatcagtatcgtgtgtgggccactgtgaactctgctgcctttgagtacctgatgttcctgctcatcctgctcaacacagttgccctagccatgcaggtctgagatccctgcctgacccccgccagactcctgaccctattatctccacataatcccttgggaaccattgggaacatttaaggctgcaaataacaaaccccctgccaactaacagcaacttaagctataaagacatttgccacatttctttaagtctatggccagtacttgtaagttgcattctgatttcggagatgtaagaatgtggaaaaaaaaaaaaaagtagccagtggccattgtaagttgccatttgttataaaatgcgccccaatttcagagattctaaaatgtaaaaagatgtgcctcctggagtcaatgaactgtggtaattacctcatgtattgagaagtgcagaggtaggctgtttgttcattgttcatccgggacccatgctctatctttctgcttcaccattcttagcaagttggcattcattttcatgattgttgtttcatgatcacagctccaggcatcaaaaccacactcaaggcagggagagctgcacctggggcctctccttatttgatcctttcatcggaaagcaaaattttttttacacaagctgctaaccaacagcagatttatgtttatgtctcactagtcaacctggccttgcctaactacaagaaaagctagtaatcaagaactaaactttccagtatccataatgggaggcagacagtgcaagaggtttgaccaatacacagtgcaatcaagtccccagactcgcctcagcccaggccagggaatatttggttgggtgtggcggcatctctgcctcaggctccatctcaacctgattttctcctgcagcactatgagcagactgctcccttcaactatgccatggacatcctcaacatggtcttcactggcctcttcactattgagatggtgctcaaaatcatcgccttcaagcccaaggtggccccccttctctagccccacccaccagtggatgaattccttgggagtggagctcattgcagagctctggggttggcgatgcgggcagcagccagggagtgtgagtctagggagtgagagggactcaggtgcaggcccatcgtgtgatccaagcgaagccctgcccccctccggcgccccctactactactggccccctaccctggcttgcgagctttgagaagacagggcactgcttttctcctacttgcagcattacttcactgatgcctggaacacgtttgacgctcttattgtggtgggcagcatagtggatattgccgtcactgaagtcaatgtgagaactggcctttccactaatccactctcgccctatacaccttccctcacctctatcccggggttccctttcacgtgggtgggtggctcccacgcacatcctccctactcctggagactcagtcctcattctagctctatctcttctgagtccctgttgggttcagcaaaagtccccctctactggctttctcattccattttgtaacctatctactggctccaccatctcctgaaatgcctctcctgttatttctgttatctctttcattgcctctacatcccccatccattggctccgtcatgttcactggctcctgctttggctccatcttttctgatgacttcattggcttcatttctccaccaacttcatcatctctgacactggctctttcatggctctgtcatcaccattgactatatcattggctccatcacctccattgggtactacatggttctgtcacctcaactgacaacgctgctggttccctatctccatcactggcttctccattggcttctccatcggttctctcatctccatcatctctatgacaccactggttccatcatttcctctattggctccaatgtctctgatccatcacctcctttactctctcctctcccttccattcccattacccactttttcctaatcctaatccactaccatataaactttcccattgtcccctgtgtaatgaccccaccatcaccccctatatctgctccatcatatctcaccttgttcatttgggcctatgatgtcatcatctcctgtatcacctttttcttggccatatctccctccagaatggtggccaccttggcgaggtagcccaccctaataacagggactctctgcttcttttcccatgtccctctgtccctccatccctccggattaccctagggcctgagtgatttgggtactgggagggccaaagcatgagatagggagatagctggagtaaatgcaaactgagcatccctactgcacccctcaccccagagctctgaggacagctcccgcatttccattaccttctttcgcctcttccgagttatgcggctggtcaagcttctcagtaagggtgaagggatccgcacattgctctggacattcatcaagtccttccaggtaatcccctaccccatccctttgaccatacctcgcccccatttcacacttctcagcctgcccctttaccaccctcagaactacatctcccaacatgccatacccatttccaaattattattccaattttctcttttttctgggctctcagtttccaacacacctctggtctcactgaccttactctatctacttaacactatgttcacatttgagagacaccacagtccttggcactttggagatggactgcatctcccagtaggcccaggccagggaaagcagtgcattctggggcttatagttctttgcctgagcctgtgcatctattctctgcccccctcccccatccctataggccttgccctatgtggctcttctcatcgcaatgatattcttcatctatgccgtcattggcatgcaggcaagtggggaccctaggaagcatcccttaagcactcctctgctggcaggggatgggttaagaatagccccaaagtaggggtggcaggtagacagacaagctggacggccctgggtcaatctacacatctgtgaaatgagatcagcagtgatgccctgtttgtcagggttatgaggctcctttaggtattaggaggtgtgaaatgggtggggcatgggttcaccccactgacacagccttgatgtgtccacagatgttcggcaaggtggctcttcaggatggcacacagataaaccgaaacaacaacttccagacctttccacaggctgtgctgcttctgttcaggtgacatctactcactcccctgccaccttatgcccgtgggtgcccacccaccctctctgagccccagactgcttgagctatgggaataatatggcagcatggggctccatacagcccgagatgtttcctggctatgatgtgaggagtctgttagagtattctagcctcagccattttctttctgactgtaagacgcctccccttctcaggtctcagtgcctcatctgtaagatgcaaacatgactgtcgtcaacatggccacactggctgttaaaatattgaaatgttatctgtgccagatgtagcccctggtgagaagtaggtcatctcctcattccccagtcctcccccaactccatttaccatgacttcatagcctccccttcaggatgctacccctgtgtgactcccaccaggtgtgccactggtgaggcatggcaggagataatgcttgccagccttcccggaaatcggtgtgatcctgagtctgacttcggccctggtgaagagtttacctgtggtagcaattttgccatcgcctatttcatcagcttcttcatgctctgtgccttcctggtgagaaccatttcctcacaaccaccaccaccgtcacgggggctggccctgaggggctcagggatgtgacgtgggcagcccagatcttcatagtgggtgagagggctggtctgatgacaagatcaacccagagactcatgaccatataagcccgccccagcctcccaccatccgtccatgacagtgttctgcccttcacctaactgctcccttgctcactggcccacagatcataaatctctttgtggctgtgatcatggacaactttgattatctcaccagagattggtccatcctgggcccccatcaccttgatgaattcaagaggatctggtctgaatatgaccctggggccaagtatgccctctatacccttacctagaatccaggggacaatgtattgccctacacagtcccctagcccccaaacctccgactgctgcatctcattacccagtcaatagatgccccaaagtttccactgccccatcctctgccctctctgactgccctccagttcttccctggcaagctctggggtattggtaggaggaggtagtgatgagctggtggggccttgagaaagggctagtgggggcatcgccaatccagtggtacctccccaactcctccaggggccgcatcaaacacttggatgtggttgccctgctgagacgtatccagccccctctgggatttgggaagctgtgcccacaccgagtggcctgcaaggtctgtgcacctgcccacccccaggctcctgagagaactgtctatcacatggcaagggtgggaagggatctgccttgggtggggaggggtgtttgatcgcatcctcagaggtttctgccccttgacattcgttcctgcatacccggcattttcccagagtgggtttcatgtctctcgtgtttgcagagacttgtggcaatgaacatgcccctcaactcagatgggacggtgacattcaacgccacactctttgccctggtccggacatccctgaagatcaaaacagaaggtgtaggggaggggcaggagtgggatcgttcctggggagggtgcaaggagcaaactcattgaatcatgggccccactcctagctctgaaccccagaatgggtgacaggattctccaggcctgtttccccccaccccgtccaatgggggcggtgtgcatctgcggtagcagcttgtgaagttccccccacccaacagtgagggggcagctgtggaggttcttcctattggctcatgccccacatcctcctccaacgcagggaacctggagcaagccaaccaggagctgcggattgtcatcaaaaagatctggaagcggatgaaacagaagctgctagatgaggtcatccccccaccagacggtgagctatccccgccccagttccccgcgccagcccctgaatggcagatgatcgctctccaccacaaaaccagcgctgggcagagggcgaggggaagtccatgctggtgggtagagaggcggcgaggtgggctgggtcagagggcccctgtgtgatcttgccttctctcccttgcccctagaggaggaggtcaccgtgggcaaattctacgccacatttctgatccaggactatttccgcaaattccggcggaggaaagaaaaagggctactaggcaacgacgccgcccctagcacctcttccgcccttcaggtcttcggggcagggcctagtgtggatgggcacgtgtggcagtgctgtggctgaggctgacccccattttgatcttgtgaaacccatgtcacagataaggaaactgaggccccaggcctcacggagggccagggtggctgaaggactccttcccccaccctacccgcctgcaggggaaacagagggaaagttcagaccctgagctgcctgcttacctatttctccacccccacaggctggtctgcggagcctgcaggacttgggtcctgagatgcggcaggccctcacctgtgacacagaggaggaggaagaagaggggcaggagggagtggaggaggaagatgaaaaggacttggaaactaacaaagtggggacaagttttcactctcccaggaacttgattgtaaaatacttcgtcaatcccctgagtgattttgacactgcttctgggaagaagctcccccagagaagccccctctgcaatagaaaaatatttatttgaggctgggagtggtggctcatgcctataatcccagcactttgggagtccagggtggaaggatcgcttgaaccctagggttcaagaccagtcctggcaaaatagtgaaaccgcctctctacaaaaaaatttaaaaattagctaggagtggtggtgcaagcctgtagtcccagctacttgggaggctgaggcaggaggattgcttgaacctgggaggatgaggccacagtgagctgtgatcatgccactgcactcccgcctggtgacaggacaagaccctatcgcaaatatttatttatttatttacgtatttatttatttgacatttaccattgctgttggagggcaaggcccacattcatggacctgtgggggagacatgttatatgaccaaatgacttagccacaaagtgcatgcaacactcagtcctgtgactctccacaggccacgatggtctcccagccctcagctcgccggggctccgggatttctgtgtctctgcctgtcggggacagacttccagattcactctcctttgggcccagtgatgatgacagggggactcccacctccagtcagcccagtgtgccccaggctggatccaacacccacaggtattatcaagtgtctggaagtagattgtgagggaaggcaaggactagacactggatagaggcaattcaggaggcaggaagttgaggggggtgggagggagggcctagaggccttcaagcagaaatttgggaagaatggaggtgtttcaagggctcaggtaagaatagagggtgataagagattcatatgagaaaggcaatacaaaggtttaatgcaaaaagcacattgtgtgaaaccaagagtttcagttcacattctgcctctgccatttgctaagtgaccttgagctaatcacttttttttttttttttttttgagacagagtcccgctctgtctcccaggctggagtgcagtggcacaatttcggctcactgcaacctctgcctcccgggttcaagcgattctcctgcctgagcctcccgagtagctgggattacaggcgtgcgccataatgccaggctaattttttttttttttttcagtagagacgaggttttgccatgttggccaggctggtttcgaactcctgacctcaggtgatctgcccacctcagcctcccaaagtgctgggattacaagcttgagccaccgtgccctgcctagtcacttcgtttctatgagcctcagtttcctcacctgtttaagggggatgacaaagcacttacttcacagggataaagaaaggatgaaatgaggtaatgcatgtcaaacacttagctgctagacaatacataagcagattaaagaaaaattttaaaaaaaaatttcagagtgtctagcttgcctaggcacggtggctcacactcgtaatcccagcactttgggaggccaaggtgggaggatcgcttgagcccaggagtacaagaccagcctgcacaacataatgagaccccgtccatacaaaaaataaaaaaatagccgagcatggtggcgcatgcctgtagtcccagctacttgggaggctgaggtgggaggataaattgagcctgggaggttgaggctgcagtgagctgagatcatgctgctgcactccagcctaagtgacagagtaagacctcgtctcagaaaataaaaaatagaaataaaaaaataaagtgcctagcttttacaggctccccccactcctaatacatgcccagttttgtgttcaaggtgtctctctacaggtcaactttgatttttttgaaactttcagtcctaattagatgaacatctattaaacaaaagcccatggtcactttaaaatggttaatggttaattttatgtgacttgtcctcaacaaaaaaatccaaaagcccagtgtttctgtaagggttggggcatgggatgagaggaaccaggggtccagggccacatattgagggatctggtctgcctaacgtgcctccctttccccaggagaggctctggggctctcattttcaccatcccagaagaaggaaattctcagcccaagggaaccaaagggcaaaacaagcaagatgaggatgaggaagtccctgatcggtacactggccatgccacatgggatgaacccatgagctggggtggaggaggggtgggaactgggtcggggaggactgtttgtgccccatctcccaggcccaggtccaggcccagacccaagttcacccctggccctcccacccacacaggctttcctacctagatgagcaggcagggactcccccgtgctcagtccttttgccacctcacagagctcagagatacatggatgggcacctggtaccacgccgccgtctgctgccccccacacctgcaggtgagagcagggatggatccaaggggcccccacgggcctgcaggacagagatctggggaagcactgacattgctatttgcccctggtgccccacccacccccaggtcggaagccctccttcaccatccagtgtctgcagcgccagggcagttgtgaggatttacccatcccaggcacctatcatcgtgggcgaaattcagggcccaatagggctcaggtgaggctgtggaggtggtgctggggtctggggtctggagagatgggggcagcctaggctgaatttctcaaacacagcacatatcaggcccttttttttttttttttttttttttttttgagacagagttttgctctgctgcccaggctggagtacagtgttgagatcttggctcactgtaacccctgcctcccgggtccaagcaattctcctgcctcagcctcccaagtagctgggattacaggtgctcaccaccatgcctggctaatttttgcatttttagtagagatggggtttcaccatgttggccgggctggtctcaaacccctgacctcaggtgatccgcctgtctcagcctcccaaagtgctgggattacaggcataagccaccgcgcctggcctcagagccttctgaagaacaggacacatatgaatgaatgcacacaatgctcactgtacttgtgaggaaactgaggtcctgagaggtttaccccagatcatgcagctagtaagtggcagagctgacatttaaacccaggcctcctgcactcttacataaataaactcaagcctgacttatacccattcaatttcactccagttgtatactgagggaaagaagtaggcacagcggtgagtcctagaccctcataccctactcatccatccctgcccctctgatgtttattctggctcagggttcctgggcaacaccacctcagcggggtcggctcctgtatgccccgctgttgttggtggaagagggcgcagcgggggaggggtacctcggcagatccagtggcccactgcgcaccttcacctgtctgcacgtgcctggaacccactcggaccccagccatgggaagaggggcagtgccgacagcttggtggaggctgtgagtccagagggcatatagacaagacggatgggggagaaggggaggaggtgggtactggaggaggacggaaaggagtccccaggtcctgtgttgtgcatgtagatatccctttgccctacgacctctgctcacccctgtcccccactgacttccctacatgccctcatgggcacgtcatttatccacactgaaccttctgtgcacactgtgccgtccgtcaacactgatcccacctgtgcccccaggtgcttatctcagagggtctgggcctctttgctcgagacccacgtttcgtggccctggccaagcaggagattgcagatgcgtgtcgcctgacgctggatgagatggacaatgctgccagtgacctgctggcacagggaaccagctctctctatagcgacgaggagtccatcctctcccgcttcgatgaggaggacttgggagacgagatggcctgcgtccacgccctctgaattcccacccctccccaactgctcaataaacctcctgccctcccctccccagcaggaggcaggcatggaccac

SEQ ID NO: 4513 - DNA, 28310 bp, human; identical to SEQ ID NO: 4510

SEQ ID NO: 4514 - DNA, 28310 bp, human; identical to SEQ ID NO: 4510

SEQ ID NO: 4515 - DNA, 28248 bp, human; identical to SEQ ID NO: 4512

SEQ ID NO: 4516 - DNA, 2804 bp, human
cgcagcattgaggaggttgaggccgacatgaagaccctgggcgtcagctttgtgcaggtaaggggcggaggaggggctgcgcgttgggctaggtcagaaggagggcctcggggtgtgagggactagatggggcaagaggtgctctgtagaggtctgcacatggcagaagggttcctgggagccattagggatctgtgggcctcttgagggtggctatgagaatcaggccagggtgagggtctgtgggcatctatggggcaccgcgggtctgcatgggcaggggattgaggggtcctcggagggtctgtgggcatctgtggggtacccacgggtctgcatggacaggggattagggggtcctcggggtccttggcaccagcgtggagctgttagagaggcctgtgggggccacaggggtgtacagtcatctgtggagctccatgggggctgtggcatgtgactgggtatccaccggccaggcagagtctgagtgccggcacagcaagctcagtacagcagagcgtgagcaggccctgcgcctgaagagccgcgcggtggagctgctgcccgatgggactgccaaccttgccaagctgcaggtggggttggggctgtagctgggcggagaggggcagggtggggtggggtggggttggagggcccagcctgtgtgacatgtacccatcccccaccagcttgtggtggagaatagtgcccagcgggtcatccacttggcgggtcagtgggagaagcaccgggtcccactcctcgctgagtaccgccacctccgaaagctgcaggattgcagagaggtaagcagtggggccctgggctgtgggcgggccagggcaggctcggtccctctctagggggccatccctatgctctgctcactgtcttctgcctgtgggctcatggcagctggaatcttctcgacggctggcagagatccaagaactgcaccagagtgtccgggcggctgctgaagaggcccgcaggaaggaggaggtctataagcagctggtaaggcctgtgtgagggacctgggtagcttaggagggtggggggatggtcctggggcagtgcctgctatatccctgcctagatgtcagagctggagactctgcccagagatgtgtcccggctggcctacacccagcgcatcctggagatcgtgggcaacatccggaagcagaaggaagagatcaccaaggtacactgccagggccatggagggtgggtcatgtgggctgtcaggcatagtgtggccgcacagggacctcacaccctcaggcagagctgtccagtcacactctaacacagaatagtcacacacaatccatcccagtcacccctgacacagtgacacagtccctgtctggtacacatgaggaccctccactgctagccagcctgccccaggcaggggctcatggctgccatggtgtctgccagatcttgtctgatacgaaggagcttcagaaggaaatcaactccctatctgggaagctggaccggacgtttgcggtgactgatgagcttgtgttcaaggtgtggggcaggttgggcgggggtgagtggggtgaggctgggctgctgccttgtgcatctgctaattggctggctggggtccagacccaggccctgtgcgaggctggaggtgcactgatacccagggctggctttgtttcatggaggatgaagctagtggggtggtgggagagggtggccttcttagggcatggagatggtcaagggcagcccactgatacctttgaggtccctgtgtctggtcaggatgccaagaaggacgatgctgttcggaaggcctataagtatctagctgctctgcacgaggtgaggggagacatgtgcctggggtggggctgctgggggtgggtgggactgggtgcaagccttctgctcctgttgtccccagaactgcagccagctcatccagaccatcgaggacacaggcaccatcatgcgggaggttcgagacctcgaggagcaggtgaggcctgggggcaggatggggagccaaggcgggccggggggacagttcctcaggttatgctgacagaggctgtggagccacacacagccgatggctggacacccagccctgccccttagtgcctgtgacctgggacaggcaagtggcctactgtgagccccagcttccaccccaagggccctcctgtctgcctcccagggccatgggcagaggcttcagcttaaagatgtagggggaatcctgccacatggcgaaggatgctttgggtagagggaacaccacacgaggcctggccatgggacagagcaggctgttggagttggtgggaggggcccagagtggctgtgatgggggctggtgagcaggagctgggaaaggggctgtgtgtgctgagggggcatgtgttcacattgcctcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgcggccttggacccagacccctgcccactgaccgcaacccttatatggggtgatagtccagcatgtggggagctcggctgcagtttattggggacggtactgtgggttgggggccttggatcccaaataaatgagtagttcct

SEQ ID NO: 4517 - DNA, 15048 bp, human
tccggcatgcgccgtgctcgctcacagaactacactttccaactctccccacacgacccgtgacactctgtggaccgcgagcacggagcagggtttctacagctgctccccactttctcggacccggtcctggacccagcccccgactccgacacggctccaccatggaggaggcggaccgaatcctcatccattcgctgcgccaggccggcacgtaaggacagagcccccgcccacccccgaagcccacatccgggactctaaagcccaggaccccgtttcccgggaaccttaaaacccgggatcctgacattcagggctccaactccaggatcctaagaccctcacccccttacacacacacacacacacacacacacacacacgcacacacacacacgcacacacacaccgccctccctgacaccgacatcagaggcctcccaaatcctttaaccatgatatttggtacacccaaagctctgggacccagacaccttgagacgttacaaccttgaaacctcaagacccggaaccctgtaatctggggaatcttaacatcagttccctgagaccctgttatctggagaccctaagacacctgtgccctaagaaccagggagcgtaaaaccccaggaccctggcactcggggactccaaaaaatccctggaccagatacttgggatccttcaaactccagttccccaaacacctggggcttaaaaaaacccaggattctttttttttttttccttttccgagatggagtctcgctctgtcgcctaggctggagtgcagtggggtgatctcagctcactgcagcctccgcctcccaggttcaagtgattctcctgcctcagcctcccaagtagctggtattacagccgtgcgccaccttgcccggctaatttttgtatttttagcagagacagggtttcaccatgttggtcaggctggtctccaactcctgacctcaagtgatctgcccgcctccgcctcccaaagtgctgggattacaggtgtgagccaccacgcccagccaaaaaaacccagaattctaaaatctgacatcagcatttggtcaccctgacgcacgaagactcctccgttcagaggccctaaaaacccaggatgccaacatctagggagtctgatttttgtattgcttgaaactaggtggtcttgatattcagggatcttgatacccagggaccctgacatttggaacttctgaaaacagcagcctcctaaaatctagtcttctcaaaactctagcagctcaatatgtatgcaaagaacatactatctgggaaccaagaaacccagagattgtgccacctggaccctttcaccttcccagactcccaaattttgatatttttctaaactgagttctcttccacccaccattctcctactccaagatcttaggacttgaggatttccctagttcctggttttccaaatggaagtcacagtcaccaacatccaggatctgtctgaactgtaggcatcctccctgccccgaccctggtactagtgtttccaaaaggctgcagggctcagcctgatccctgttgcctgactattcctgtgatcaagctggtccccttcttcagggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatggtgagtggccctcctcctaatgcacacatcctctttcttcctcttttacaaagtaaccaagttcctttgcaacacttgcctttcctctgcaacacttgcctttcctctgcaacacttgcctttcctctgtcatttttcctgcggcttagttttcattagtggttaaggctgctgactgtactgccaaactgcctgagtagtttagatcctagccccaccacttggtaactgtgtgaccctaacccttctgggccccagttttcctatttgtgaaatggagatgataaatgtagtgcttttatgaggagcaaatgagtttatccagtttgcacctgggctgctcctggcttctatgttttaaatttagctgcaaaataccacccccaccccatagtatccatttcctagttccagaaaatactctgtctgggtcatatactcctaaactaatcactctgtgctctgattggcccagtctggatgacatggtcattccttttttttttttttttttgagatggagtctcactttgtcgcccaagctggagtgcagtggtgcgatcttggctcactgcaacctctgcctcccgggttcaagcaattctcctgcctcagcctcccgagtagctgggactacaggcgtgtgccaccacacccaactaattttcatgtttttagtagagacggggtttcaccatgttggccaggatggttttaatctcttgacctcatgatccacctgccttggcctcccaaagtgctgggattacaggagtgagccaccgtgcccagccttttcttttctttttttcttttttttttttttttgatgtgaagtctctctctgtcacccaagctggaatgcagtggcgtgatctcagctcacggctcactgcaacctccgtctcctgggttcaagtgattctcctgcctcagcctcccgagtagctgggactacaggcatgcaccaccatgctcagttaatttttgtatttttagtacagacggggtttcactatgttggctaggctggtcttgaactcctgacctcgtgatctgcccacctcggcctcccaaagtgctgagattacaggcgtgagccactgcgcccggccgacacggtcattcctataggacactgtgattagccactccttcaggatcctgtggagttgggataaggatgattacccaaagaaaggcatgctggttacccaaaagagtgtctgctatattacctctgtgggaaccacatatcctgcctctgctaagagcaattccaacaatgtctctgtgacagaataaataaagtgcttttcttttaaaaaatattttaatttttttagaggtaagtgtcttgctatattgcccaggctggtcttgaactcctggcctcaagagattctcctgcctctgcctcactagtagctaggactataggcacatgccaccctgcccgagaatttttaaatttttcgtagagatggggtctcgcttttgtagagatgttgcccaggctggtcttaagctcctggcctcaagcaatcttcccgccttggcctcctgagtagttgggactacaggcgtgcaccactgtgcctggtaaagagccattctgatgaaacactcacccattcccagtatagagctgagtccaggagtccagttcctgtattcaagagctgcaagtaatgccactccccctggctcactcactctgtgactttgggccagtcttttttttttttgaagcccaggctggagtgcagtggcacaatctcggcttactgcaacctcctccgcctcctgggttccagcaattctcctgcctcagcctgccgagtggctgggattacaggtgtctgccactgtgcccggctaatttttttgtatttttagtggagacagggtttcaccatcttggccaggctggtctcgaactcctgaccttgtgatccacccacctcagcctcccaaagtgttgggattacaggtgtgagccaccgcgtctggctctcttaacctttttgaggctaagtttccacatgtgtaaaatgggtataagaattgtagctactgtatagggttgctgtgaggattaaacatgagttaatgtgtgaaaagctggttataataagctttgcataaatgggattactattattggataggtccgatctggaacctgtgaatacatagtgaatggaaacactttgaactgacccaggaagtatatggtggtggagggacgatagagtaactaccgtgaaaactttcatttagatataggggactgggtggctagagttgttaaatttgggccttgcttatgcagtttctgtctcttagcaacaggtctcagagctccatccatcccttcgctctcaggttcacccagctctcaggagttgtcacattgttctctctggggctcttggtggccttatgaggcaggcagtctgtcccctggcccaggactgtatgtattcttaaggttagcacttaataggggggaagttatgtcttctgtttgcagaggagagtacacagcaggaggtgttgaggtgggggctcaggcttcctgcagttctctgttcttccctcagtgctgtctctcttggattttgttcacctgcttttgcttacattgattttagtgggggttagtgactatggcttttccagtggccaggaggtacatgtgggctgggcacgttggctcttgcatgtaatcccagcactttgggagtctgaggtgggaggatcagttgagcccaggagctcgagatcagcctgggcaacatagtgagacccccatctctacaaaaaataaaaaaaaaatagctgggcatggtggcacacgcctgtggtcccagctatgtgggaggctgaggtaggaggattgcttgagcctgggaggtccaggctgcagtgggctgtgattgcgccactgcactctagcttgggaaacagagtgaaaccccatctccaaaaaaaaaaaaaaaaaaaaagactggggacggtggctcctgtaattccagcactttgggaggtggaggcgggcagatctcaccagaggtcaggagtttgagaccagcctggccaacctggcgaaaccctgtctctactaaaaatacaaaaattagcctggtgtggtggtgtgtgcctgtaatcccagctactcaggaggctgaggcaggagaatcgcttgaacccaggaggcggaggttccagtgagtcgagattgcaccactgcactccagcctgagcgacagagcaagactcttgtttccaaaaaaataaaaaacaggtacatatggttgtctggcccccagcagccttggtttatcagcagcaggcaaaaggagttctcttaatccagctgtgtgctgtccctgtagcccccccgcaactcagcactgccatgttctggcatcttttcttcatatgccctgctcctggcaacagtttctgcaccttagccacctccatattttggcaccttccccactcctggaatgagtttctatatcagtcacagctctttgattgcatattgtggaaaaaatccaaagtaaaataccttaaaagccagtggttatacttatttgaccttgagcctccaaaataaatatatcttgcattgtgacccagtatactcctaagtatagaataatgatggcttctaagtgtactctgtgccaggccctgtggtaagtaacatggtgttaactcatttaattctcaggacaaccttctgctatatgtactgttggtataccctctttcagatgaagaaagtgaagcacagagggattaagtgatctgcctgaggtcgtatagttggtaagaggcaaagcttgggtttgaatccaggaagtctgctttcagagtctatgcagttccaaagcagtggcaactctggaagaaaaaggctttcctaggccgggtgtggtgattcccacctgtaatcccagcactttgggtggctgaggtgggcagattgcttgagcccaggagtttgagaccagcctggccaacatggtgtagccctgtctacactgaaaatacaaaaattagccgggtgtggtggcatgcacctgtaatcccagctactcgggaggctgcgtgggaggatcacttgagcccaggaggcagaggttccagtgagccaagatcacgctactgcactccagcctgagcgacagagcgagaccctgtctcaaaaaaaaaaaaaaaaaaaggaaaaaggctttctttctctcctggcctgtttcctcagtccccatcagaaccctcatgagtccttttgttctgagctattgtgcttctggtctttttgtcctgtttatttttaggcactctttctataataggtagatttgctctttacctatgatatgggctccaaatattttttcccaacttgtcattaacttttgactttgcttattctattttctttaaatattttctttcttttcatgtattcaaaagtacccatcttttcttttatggcctctggattttgagtcatagaaaggccagagctttaatcttgtttcttgttctctgtagcgttgactatcatcactctgtgactccccccagggcccagaggccttggggagctgggggaggttgggagggtggtggttagtgagaaagtgggagcgttttcagcctaggcccaagtctcccagggcaggaggaccctgcctgcttcctgatagccgcccaccaaccctcaggacctgggctatcccttggagcttggctatcagaacttcctctaccccagtgagcctgacctccgagacctgcttctcttcttggctgagcgtctgcccaccgatgcctctgaggatgcagaccagcctgcaggtactgggtgtctgggatgtgggcgggggcggtgaggggagaggagggccttctaggggctgtagggctgagagaggtagaggtggtaaaaaggttgatgggtaggggtggcggtatgtgccttcaggagagctaggcaggaggattaggcatcagagaggggctacagggcagggggcagggggctgaggttgagctgaccccggtggtgcgttggtgcggggaggggcctccctgactcaacccctgtgccctccctctctctcacttcgctctaaccacttgggcctcctgggtgctactcaaacataccccagtacactcccgcctctgcacctttgtatcgttggttacctttcccctaggtaccctcatggttcactcccttacctctttgaggttaacctcctctccgcagccctctcctgatccccacctggctgcagtctggatggtattcaggatcctattcatgatctctctcctctgctagcttgccggctccctgagggcagggacctttatccagtttgttccacgaagtagccctagtgtctagaacagcgacctgtacatagtaggtgctcggtgtttgttgaatgactgaacgtgagaacgcaagctggatagatgtgtatctctggatgggggtcaggagtggaggctggtctcctagggtatgcccttttggatttgcagcattgacatctgattcacttcctccctatcccccataggtgactcagctattctcctccgggccattgggagccaaattcgggaccagctggcactgccttgggtcccgccccaccttcgcactcccaagctgcagcacctccaggtgagacccctgactcccatggatcttctcttgtccccgtctgggtgcccagggttttggccccctacccctggcaaccctcatcccacttcaccctggagattctgagcctgctctcccaccagggctcggccctccagaagcctttccatgccagcaggctggtcgtgccagaattgagttccagaggtggtgagcatgaggctgtggggaggggtgaggaggaaggtgggggggaacctcatagcgttgccatgcggcagggccagctgactctgttcctgcctccagagccacgggagttccaggcgagtcccctgctgcttccagtccctacccaggtgcctcagcctgttggaagggtggcctcgctcctcgaacaccatgccctgcagctctgccagcagacgggccgggaccggccaggggatgaggactgggtccaccggacatcccgcctcccaccccaggtacagccagatgcctggctccctgctgtctgggctgctgctcactgacactcccgctggtcctctgctctccttccccactttgtccctcccttccattgtttcccctctgtgtgtgcttacctagctccccacctgaaagaacactggagtcagaaaaaaggagaacctgggacaagtcagtatccctcctcagagccttggtttcctgtgctaaaatttggggtagtaatagtgctctcctctcagggcagtagttagactgaataatgtgcttgagattcctggcaactggagcaatccagattggctacctgccttcatcattcattaattcattcattcatttggagtcttgctctgtcacccaggctggagtgcagtggcgtgatctcagcacactgcaacctccatctcccgggttcaagcgattctcctgcctcagcctcccaagtagctgggattacaggcttgcaccaccacacctggctaatttttatatttttagtagagacagggttttgccatgttggctaggctggtctcgaattcctgacctcaggtgatctgcccaccttggcctcccaaagtgttgggattacaggcatgagccaccgcacccggccctaatctttctctgtttctgcacttgtcactgatgttcatttttctggtttctaggtttttgcacaatttctgcctgtccccattattctagttctgtgtttttgctgctcctctttcttacctctctgtctcctcgtttctgtactgaattcctctcttgctctgtctatctatctgttcccccttctcctctgtctacttctttatctgtcccctcttcttctctgtgcacctttttatctgtgtccccttctgctctgtccacctctgtatctctccccttccttgctgtccacctatatatctgtcacccctctgcctctgtttacttcttaatctctctcctcttcctctctgtccacctctgtatctgttgccccttccctctgtccccttatctctcccttcttcctctctgtccacctctgtatttgtccctcctccccttctgtccatctctttatctgtcctctcttcttctttttttttgagacggtgtctcgctctgtcacccaggctggactacaatggcatgatcagggctcaaggcagcctcaaattcccgggctcaagcaatcttcccacctcaggcatctgagtagctgggtctacaggtgcgtgcgcccggctaatttttgtattttttgtagagatggggttttgccatgttgaccaggctggtctcgaactcctgacctgaagcaatccacccaccttggccttccaaagtgctgggattacaggcatgagccaccatgccgagccccctcttcttctctgtcaacctctttgtcccctcttcttctctatccatctctgtatctgtcccctcttcccctctgtccacttatctgtcccctcttcctctgtccacctctgcatctgtcccctccttctctctgtccacctctctgtcaccctctccctctgtccatttctttatctgtccccttttcctctctgtccacttctctttttccctccctccattctgctctcctatttctgttccctcttcctctgtgttcacccaggtatcagtacccctccccttctgtccacctttacatctgtcccctcttcctctctgtccacctctgtatttggcccccctccccttctgtctgcctctttatctgtctcctcttcctctgtgtccacatctctgtctgcccctctttttctccacctctgtgtcggccccctcctggtctgtccacttttttatctgtcctctctttctgtcttcacctctgtgtctttttacatttttatttttttatcattattattattttttgagatggagtctcgctctgtcacccaggctggagtacagtggtacgatctcagctcactgcaacctctgcctcctgggttcaagtgattctcctgcctcagcctcccacatagctaggactacaggcatgcaccaccacgcccagctaatttttgtatttttagtagagacagggtttcaccatgttggccaggatggtctcgatctcttgacctcatgatccatctgcctcggcctcccaaagtgttgtgattacaggcgtgagccaccacgcctggctgtctgtttttgtttttatatctgtagtaattttcaaacataaatgtagagagaatattctagtgaatcctatgtaccattttgccaacttttcttcatcttttctctcccaactttttctttgttgctgtattattttaaagcaaatctcagacatcatgtcatttcagctctaaatacttaggactacatctcttaactcataaggacattcagttttcaaggtaaccactggaccattttcatggctaatgaagttaacaataatatcttgtgggtttttttttgttttgttttgttttgttttttgtttttttttgttttgtttttgagacggagtctctctctgttgcccaggctggagtgcaatggcgtgatgtcgcttcactgcaacctccacttcctgggttcaagccattctcctgcctcagcccccaagtagctggaattacaggagcacactaagttttgtatttttagtagagtcggggttttaccatgttggccaggctggtcttgatctcctgacctcaggtgatctacctaccttggcctttcaaagggctaggattataggcatgagccactgtacccggccaacaatgatatcttaataccatccaatacttgagttcataatcagattttcccattatcttgaaactctgttgtccctctcttgcctctctctctctgcctctttctgtgcttggtacctttgattccctgtctctgccctgtcccccgatatcctgtctatgcttctcttggatttgggggctctaggcccacccccctctcttcccacatccttctccagcatggggatctagtgggtggagagaagtatgtctgtgagcaagaggagacccctgtcctcgaggagatcccaggctggtggagcaggagagtagagcagggcctgccttagtgggaaggctggagggtgggggtgacttgtctgtatactcttgtcagggggtccttggaggaggcagggccttgggtgctaggtgggcccctacaccttcctgcttcccccgccttttctccccaggaggacacacgggctcagcggcagcggctgcagaagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggtgggtgcgcctgaggacatgagatgtgtggatgggcgtggcaggcttggagggtggctttttgtgtcagcaccacacctttatccacacaggttcctgtgttcccactggacaggccctcgccccactgtgggatgggtacccagaggggtcccctagcttattagggacttgactggagaaaatgtggataggtgggaaccatgcaaaggtgtgggggtgttcttggggcaacaccccctttcctcaggcagtttcctttgagcatatcttctgtcctaagatgttcactctgagggccccccatccttctcatgggcatttgaggcttgagagatggggcaggtgggtaggagctgtgacagggtcagggagatttctccacgagcaagcactctggcccgaggttgcagatggtgcctttacccacatagtcacagtctggccaccatcggtgcttcagtgggcatgcatgccgcactgggggcagttctcaggggaggctgaggctgggccacgtgaggaagggccttccctggcagccaggatgcccctcgtcactccccttaggagccccaggcccaggccactcaggtgtcagatgtgccagccacctcccggcggcctgaacaggtgagcagagtggtttggaggggggtgtcccaggcccttgcttgtctactgggcctgacaccccaaccctgactggcctgggcctcccaggtcacgtgggcagctcaggaacaggagctcgagtcccttcgggagcagctggaaggagtgaaccgcagcattgaggaggttgaggccgacatgaagaccctgggcgtcagctttgtgcaggtaaggggcggaggaggggctgcgcgttgggctaggtcagaaggagggcctcggggtgtgagggactagatggggcaagaggtgctctgtagaggtctgcacatggcagaagggttcctgggagccattagggatctgtgggcctcttgagggtggctatgagaatcaggccagggtgagggtctgtgggcatctatggggcaccgcgggtctgcatgggcaggggattgaggggtcctcggagggtctgtgggcatctgtggggtacccacgggtctgcatggacaggggattagggggtcctcggggtccttggcaccagcgtggagctgttagagaggcctgtgggggccacaggggtgtacagtcatctgtggagctccatgggggctgtggcatgtgactgggtatccaccggccaggcagagtctgagtgccggcacagcaagctcagtacagcagagcgtgagcaggccctgcgcctgaagagccgcgcggtggagctgctgcccgatgggactgccaaccttgccaagctgcaggtggggttggggctgtagctgggcggagaggggcagggtggggtggggtggggttggagggcccagcctgtgtgacatgtacccatcccccaccagcttgtggtggagaatagtgcccagcgggtcatccacttggcgggtcagtgggagaagcaccgggtcccactcctcgctgagtaccgccacctccgaaagctgcaggattgcagagaggtaagcagtggggccctgggctgtgggcgggccagggcaggctcggtccctctctagggggccatccctatgctctgctcactgtcttctgcctgtgggctcatggcagctggaatcttctcgacggctggcagagatccaagaactgcaccagagtgtccgggcggctgctgaagaggcccgcaggaaggaggaggtctataagcagctggtaaggcctgtgtgagggacctgggtagcttaggagggtggggggatggtcctggggcagtgcctgctatatccctgcctagatgtcagagctggagactctgcccagagatgtgtcccggctggcctacacccagcgcatcctggagatcgtgggcaacatccggaagcagaaggaagagatcaccaaggtacactgccagggccatggagggtgggtcatgtgggctgtcaggcatagtgtggccgcacagggacctcacaccctcaggcagagctgtccagtcacactctaacacagaatagtcacacacaatccatcccagtcacccctgacacagtgacacagtccctgtctggtacacatgaggaccctccactgctagccagcctgccccaggcaggggctcatggctgccatggtgtctgccagatcttgtctgatacgaaggagcttcagaaggaaatcaactccctatctgggaagctggaccggacgtttgcggtgactgatgagcttgtgttcaaggtgtggggcaggttgggcgggggtgagtggggtgaggctgggctgctgccttgtgcatctgctaattggctggctggggtccagacccaggccctgtgcgaggctggaggtgcactgatacccagggctggctttgtttcatggaggatgaagctagtggggtggtgggagagggtggccttcttagggcatggagatggtcaagggcagcccactgatacctttgaggtccctgtgtctggtcaggatgccaagaaggacgatgctgttcggaaggcctataagtatctagctgctctgcacgaggtgaggggagacatgtgcctggggtggggctgctgggggtgggtgggactgggtgcaagccttctgctcctgttgtccccagaactgcagccagctcatccagaccatcgaggacacaggcaccatcatgcgggaggttcgagacctcgaggagcaggtgaggcctgggggcaggatggggagccaaggcgggccggggggacagttcctcaggttatgctgacagaggctgtggagccacacacagccgatggctggacacccagccctgccccttagtgcctgtgacctgggacaggcaagtggcctactgtgagccccagcttccaccccaagggccctcctgtctgcctcccagggccatgggcagaggcttcagcttaaagatgtagggggaatcctgccacatggcgaaggatgctttgggtagagggaacaccacacgaggcctggccatgggacagagcaggctgttggagttggtgggaggggcccagagtggctgtgatgggggctggtgagcaggagctgggaaaggggctgtgtgtgctgagggggcatgtgttcacattgcctcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgcggccttggacccagacccctgcccactgaccgcaacccttatatggggtgatagtccagcatgtggggagctcggctgcagtttattggggacggtactgtgggttgggggccttggatcccaaataaatgagtagttcctctgc

SEQ ID NO: 4518 - DNA, 15060 bp, human
tcacatccggcatgcgccgtgctcgctcacagaactacactttccaactctccccacacgacccgtgacactctgtggaccgcgagcacggagcagggtttctacagctgctccccactttctcggacccggtcctggacccagcccccgactccgacacggctccaccatggaggaggcggaccgaatcctcatccattcgctgcgccaggccggcacgtaaggacagagcccccgcccacccccgaagcccacatccgggactctaaagcccaggaccccgtttcccgggaaccttaaaacccgggatcctgacattcagggctccaactccaggatcctaagaccctcacccccttacacacacacacacacacacacacacacacacgcacacacacacacgcacacacacaccgccctccctgacaccgacatcagaggcctcccaaatcctttaaccatgatatttggtacacccaaagctctgggacccagacaccttgagacgttacaaccttgaaacctcaagacccggaaccctgtaatctggggaatcttaacatcagttccctgagaccctgttatctggagaccctaagacacctgtgccctaagaaccagggagcgtaaaaccccaggaccctggcactcggggactccaaaaaatccctggaccagatacttgggatccttcaaactccagttccccaaacacctggggcttaaaaaaacccaggattctttttttttttttccttttccgagatggagtctcgctctgtcgcctaggctggagtgcagtggggtgatctcagctcactgcagcctccgcctcccaggttcaagtgattctcctgcctcagcctcccaagtagctggtattacagccgtgcgccaccttgcccggctaatttttgtatttttagcagagacagggtttcaccatgttggtcaggctggtctccaactcctgacctcaagtgatctgcccgcctccgcctcccaaagtgctgggattacaggtgtgagccaccacgcccagccaaaaaaacccagaattctaaaatctgacatcagcatttggtcaccctgacgcacgaagactcctccgttcagaggccctaaaaacccaggatgccaacatctagggagtctgatttttgtattgcttgaaactaggtggtcttgatattcagggatcttgatacccagggaccctgacatttggaacttctgaaaacagcagcctcctaaaatctagtcttctcaaaactctagcagctcaatatgtatgcaaagaacatactatctgggaaccaagaaacccagagattgtgccacctggaccctttcaccttcccagactcccaaattttgatatttttctaaactgagttctcttccacccaccattctcctactccaagatcttaggacttgaggatttccctagttcctggttttccaaatggaagtcacagtcaccaacatccaggatctgtctgaactgtaggcatcctccctgccccgaccctggtactagtgtttccaaaaggctgcagggctcagcctgatccctgttgcctgactattcctgtgatcaagctggtccccttcttcagggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatggtgagtggccctcctcctaatgcacacatcctctttcttcctcttttacaaagtaaccaagttcctttgcaacacttgcctttcctctgcaacacttgcctttcctctgcaacacttgcctttcctctgtcatttttcctgcggcttagttttcattagtggttaaggctgctgactgtactgccaaactgcctgagtagtttagatcctagccccaccacttggtaactgtgtgaccctaacccttctgggccccagttttcctatttgtgaaatggagatgataaatgtagtgcttttatgaggagcaaatgagtttatccagtttgcacctgggctgctcctggcttctatgttttaaatttagctgcaaaataccacccccaccccatagtatccatttcctagttccagaaaatactctgtctgggtcatatactcctaaactaatcactctgtgctctgattggcccagtctggatgacatggtcattccttttttttttttttttttgagatggagtctcactttgtcgcccaagctggagtgcagtggtgcgatcttggctcactgcaacctctgcctcccgggttcaagcaattctcctgcctcagcctcccgagtagctgggactacaggcgtgtgccaccacacccaactaattttcatgtttttagtagagacggggtttcaccatgttggccaggatggttttaatctcttgacctcatgatccacctgccttggcctcccaaagtgctgggattacaggagtgagccaccgtgcccagccttttcttttctttttttcttttttttttttttttgatgtgaagtctctctctgtcacccaagctggaatgcagtggcgtgatctcagctcacggctcactgcaacctccgtctcctgggttcaagtgattctcctgcctcagcctcccgagtagctgggactacaggcatgcaccaccatgctcagttaatttttgtatttttagtacagacggggtttcactatgttggctaggctggtcttgaactcctgacctcgtgatctgcccacctcggcctcccaaagtgctgagattacaggcgtgagccactgcgcccggccgacacggtcattcctataggacactgtgattagccactccttcaggatcctgtggagttgggataaggatgattacccaaagaaaggcatgctggttacccaaaagagtgtctgctatattacctctgtgggaaccacatatcctgcctctgctaagagcaattccaacaatgtctctgtgacagaataaataaagtgcttttcttttaaaaaatattttaatttttttagaggtaagtgtcttgctatattgcccaggctggtcttgaactcctggcctcaagagattctcctgcctctgcctcactagtagctaggactataggcacatgccaccctgcccgagaatttttaaatttttcgtagagatggggtctcgcttttgtagagatgttgcccaggctggtcttaagctcctggcctcaagcaatcttcccgccttggcctcctgagtagttgggactacaggcgtgcaccactgtgcctggtaaagagccattctgatgaaacactcacccattcccagtatagagctgagtccaggagtccagttcctgtattcaagagctgcaagtaatgccactccccctggctcactcactctgtgactttgggccagtcttttttttttttgaagcccaggctggagtgcagtggcacaatctcggcttactgcaacctcctccgcctcctgggttccagcaattctcctgcctcagcctgccgagtggctgggattacaggtgtctgccactgtgcccggctaatttttttgtatttttagtggagacagggtttcaccatcttggccaggctggtctcgaactcctgaccttgtgatccacccacctcagcctcccaaagtgttgggattacaggtgtgagccaccgcgtctggctctcttaacctttttgaggctaagtttccacatgtgtaaaatgggtataagaattgtagctactgtatagggttgctgtgaggattaaacatgagttaatgtgtgaaaagctggttataataagctttgcataaatgggattactattattggataggtccgatctggaacctgtgaatacatagtgaatggaaacactttgaactgacccaggaagtatatggtggtggagggacgatagagtaactaccgtgaaaactttcatttagatataggggactgggtggctagagttgttaaatttgggccttgcttatgcagtttctgtctcttagcaacaggtctcagagctccatccatcccttcgctctcaggttcacccagctctcaggagttgtcacattgttctctctggggctcttggtggccttatgaggcaggcagtctgtcccctggcccaggactgtatgtattcttaaggttagcacttaataggggggaagttatgtcttctgtttgcagaggagagtacacagcaggaggtgttgaggtgggggctcaggcttcctgcagttctctgttcttccctcagtgctgtctctcttggattttgttcacctgcttttgcttacattgattttagtgggggttagtgactatggcttttccagtggccaggaggtacatgtgggctgggcacgttggctcttgcatgtaatcccagcactttgggagtctgaggtgggaggatcagttgagcccaggagctcgagatcagcctgggcaacatagtgagacccccatctctacaaaaaataaaaaaaaaatagctgggcatggtggcacacgcctgtggtcccagctatgtgggaggctgaggtaggaggattgcttgagcctgggaggtccaggctgcagtgggctgtgattgcgccactgcactctagcttgggaaacagagtgaaaccccatctccaaaaaaaaaaaaaaaaaaaaagactggggacggtggctcctgtaattccagcactttgggaggtggaggcgggcagatctcaccagaggtcaggagtttgagaccagcctggccaacctggcgaaaccctgtctctactaaaaatacaaaaattagcctggtgtggtggtgtgtgcctgtaatcccagctactcaggaggctgaggcaggagaatcgcttgaacccaggaggcggaggttccagtgagtcgagattgcaccactgcactccagcctgagcgacagagcaagactcttgtttccaaaaaaataaaaaacaggtacatatggttgtctggcccccagcagccttggtttatcagcagcaggcaaaaggagttctcttaatccagctgtgtgctgtccctgtagcccccccgcaactcagcactgccatgttctggcatcttttcttcatatgccctgctcctggcaacagtttctgcaccttagccacctccatattttggcaccttccccactcctggaatgagtttctatatcagtcacagctctttgattgcatattgtggaaaaaatccaaagtaaaataccttaaaagccagtggttatacttatttgaccttgagcctccaaaataaatatatcttgcattgtgacccagtatactcctaagtatagaataatgatggcttctaagtgtactctgtgccaggccctgtggtaagtaacatggtgttaactcatttaattctcaggacaaccttctgctatatgtactgttggtataccctctttcagatgaagaaagtgaagcacagagggattaagtgatctgcctgaggtcgtatagttggtaagaggcaaagcttgggtttgaatccaggaagtctgctttcagagtctatgcagttccaaagcagtggcaactctggaagaaaaaggctttcctaggccgggtgtggtgattcccacctgtaatcccagcactttgggtggctgaggtgggcagattgcttgagcccaggagtttgagaccagcctggccaacatggtgtagccctgtctacactgaaaatacaaaaattagccgggtgtggtggcatgcacctgtaatcccagctactcgggaggctgcgtgggaggatcacttgagcccaggaggcagaggttccagtgagccaagatcacgctactgcactccagcctgagcgacagagcgagaccctgtctcaaaaaaaaaaaaaaaaaaaggaaaaaggctttctttctctcctggcctgtttcctcagtccccatcagaaccctcatgagtccttttgttctgagctattgtgcttctggtctttttgtcctgtttatttttaggcactctttctataataggtagatttgctctttacctatgatatgggctccaaatattttttcccaacttgtcattaacttttgactttgcttattctattttctttaaatattttctttcttttcatgtattcaaaagtacccatcttttcttttatggcctctggattttgagtcatagaaaggccagagctttaatcttgtttcttgttctctgtagcgttgactatcatcactctgtgactccccccagggcccagaggccttggggagctgggggaggttgggagggtggtggttagtgagaaagtgggagcgttttcagcctaggcccaagtctcccagggcaggaggaccctgcctgcttcctgatagccgcccaccaaccctcaggacctgggctatcccttggagcttggctatcagaacttcctctaccccagtgagcctgacctccgagacctgcttctcttcttggctgagcgtctgcccaccgatgcctctgaggatgcagaccagcctgcaggtactgggtgtctgggatgtgggcgggggcggtgaggggagaggagggccttctaggggctgtagggctgagagaggtagaggtggtaaaaaggttgatgggtaggggtggcggtatgtgccttcaggagagctaggcaggaggattaggcatcagagaggggctacagggcagggggcagggggctgaggttgagctgaccccggtggtgcgttggtgcggggaggggcctccctgactcaacccctgtgccctccctctctctcacttcgctctaaccacttgggcctcctgggtgctactcaaacataccccagtacactcccgcctctgcacctttgtatcgttggttacctttcccctaggtaccctcatggttcactcccttacctctttgaggttaacctcctctccgcagccctctcctgatccccacctggctgcagtctggatggtattcaggatcctattcatgatctctctcctctgctagcttgccggctccctgagggcagggacctttatccagtttgttccacgaagtagccctagtgtctagaacagcgacctgtacatagtaggtgctcggtgtttgttgaatgactgaacgtgagaacgcaagctggatagatgtgtatctctggatgggggtcaggagtggaggctggtctcctagggtatgcccttttggatttgcagcattgacatctgattcacttcctccctatcccccataggtgactcagctattctcctccgggccattgggagccaaattcgggaccagctggcactgccttgggtcccgccccaccttcgcactcccaagctgcagcacctccaggtgagacccctgactcccatggatcttctcttgtccccgtctgggtgcccagggttttggccccctacccctggcaaccctcatcccacttcaccctggagattctgagcctgctctcccaccagggctcggccctccagaagcctttccatgccagcaggctggtcgtgccagaattgagttccagaggtggtgagcatgaggctgtggggaggggtgaggaggaaggtgggggggaacctcatagcgttgccatgcggcagggccagctgactctgttcctgcctccagagccacgggagttccaggcgagtcccctgctgcttccagtccctacccaggtgcctcagcctgttggaagggtggcctcgctcctcgaacaccatgccctgcagctctgccagcagacgggccgggaccggccaggggatgaggactgggtccaccggacatcccgcctcccaccccaggtacagccagatgcctggctccctgctgtctgggctgctgctcactgacactcccgctggtcctctgctctccttccccactttgtccctcccttccattgtttcccctctgtgtgtgcttacctagctccccacctgaaagaacactggagtcagaaaaaaggagaacctgggacaagtcagtatccctcctcagagccttggtttcctgtgctaaaatttggggtagtaatagtgctctcctctcagggcagtagttagactgaataatgtgcttgagattcctggcaactggagcaatccagattggctacctgccttcatcattcattaattcattcattcatttggagtcttgctctgtcacccaggctggagtgcagtggcgtgatctcagcacactgcaacctccatctcccgggttcaagcgattctcctgcctcagcctcccaagtagctgggattacaggcttgcaccaccacacctggctaatttttatatttttagtagagacagggttttgccatgttggctaggctggtctcgaattcctgacctcaggtgatctgcccaccttggcctcccaaagtgttgggattacaggcatgagccaccgcacccggccctaatctttctctgtttctgcacttgtcactgatgttcatttttctggtttctaggtttttgcacaatttctgcctgtccccattattctagttctgtgtttttgctgctcctctttcttacctctctgtctcctcgtttctgtactgaattcctctcttgctctgtctatctatctgttcccccttctcctctgtctacttctttatctgtcccctcttcttctctgtgcacctttttatctgtgtccccttctgctctgtccacctctgtatctctccccttccttgctgtccacctatatatctgtcacccctctgcctctgtttacttcttaatctctctcctcttcctctctgtccacctctgtatctgttgccccttccctctgtccccttatctctcccttcttcctctctgtccacctctgtatttgtccctcctccccttctgtccatctctttatctgtcctctcttcttctttttttttgagacggtgtctcgctctgtcacccaggctggactacaatggcatgatcagggctcaaggcagcctcaaattcccgggctcaagcaatcttcccacctcaggcatctgagtagctgggtctacaggtgcgtgcgcccggctaatttttgtattttttgtagagatggggttttgccatgttgaccaggctggtctcgaactcctgacctgaagcaatccacccaccttggccttccaaagtgctgggattacaggcatgagccaccatgccgagccccctcttcttctctgtcaacctctttgtcccctcttcttctctatccatctctgtatctgtcccctcttcccctctgtccacttatctgtcccctcttcctctgtccacctctgcatctgtcccctccttctctctgtccacctctctgtcaccctctccctctgtccatttctttatctgtccccttttcctctctgtccacttctctttttccctccctccattctgctctcctatttctgttccctcttcctctgtgttcacccaggtatcagtacccctccccttctgtccacctttacatctgtcccctcttcctctctgtccacctctgtatttggcccccctccccttctgtctgcctctttatctgtctcctcttcctctgtgtccacatctctgtctgcccctctttttctccacctctgtgtcggccccctcctggtctgtccacttttttatctgtcctctctttctgtcttcacctctgtgtctttttacatttttatttttttatcattattattattttttgagatggagtctcgctctgtcacccaggctggagtacagtggtacgatctcagctcactgcaacctctgcctcctgggttcaagtgattctcctgcctcagcctcccacatagctaggactacaggcatgcaccaccacgcccagctaatttttgtatttttagtagagacagggtttcaccatgttggccaggatggtctcgatctcttgacctcatgatccatctgcctcggcctcccaaagtgttgtgattacaggcgtgagccaccacgcctggctgtctgtttttgtttttatatctgtagtaattttcaaacataaatgtagagagaatattctagtgaatcctatgtaccattttgccaacttttcttcatcttttctctcccaactttttctttgttgctgtattattttaaagcaaatctcagacatcatgtcatttcagctctaaatacttaggactacatctcttaactcataaggacattcagttttcaaggtaaccactggaccattttcatggctaatgaagttaacaataatatcttgtgggtttttttttgttttgttttgttttgttttttgtttttttttgttttgtttttgagacggagtctctctctgttgcccaggctggagtgcaatggcgtgatgtcgcttcactgcaacctccacttcctgggttcaagccattctcctgcctcagcccccaagtagctggaattacaggagcacactaagttttgtatttttagtagagtcggggttttaccatgttggccaggctggtcttgatctcctgacctcaggtgatctacctaccttggcctttcaaagggctaggattataggcatgagccactgtacccggccaacaatgatatcttaataccatccaatacttgagttcataatcagattttcccattatcttgaaactctgttgtccctctcttgcctctctctctctgcctctttctgtgcttggtacctttgattccctgtctctgccctgtcccccgatatcctgtctatgcttctcttggatttgggggctctaggcccacccccctctcttcccacatccttctccagcatggggatctagtgggtggagagaagtatgtctgtgagcaagaggagacccctgtcctcgaggagatcccaggctggtggagcaggagagtagagcagggcctgccttagtgggaaggctggagggtgggggtgacttgtctgtatactcttgtcagggggtccttggaggaggcagggccttgggtgctaggtgggcccctacaccttcctgcttcccccgccttttctccccaggaggacacacgggctcagcggcagcggctgcagaagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggtgggtgcgcctgaggacatgagatgtgtggatgggcgtggcaggcttggagggtggctttttgtgtcagcaccacacctttatccacacaggttcctgtgttcccactggacaggccctcgccccactgtgggatgggtacccagaggggtcccctagcttattagggacttgactggagaaaatgtggataggtgggaaccatgcaaaggtgtgggggtgttcttggggcaacaccccctttcctcaggcagtttcctttgagcatatcttctgtcctaagatgttcactctgagggccccccatccttctcatgggcatttgaggcttgagagatggggcaggtgggtaggagctgtgacagggtcagggagatttctccacgagcaagcactctggcccgaggttgcagatggtgcctttacccacatagtcacagtctggccaccatcggtgcttcagtgggcatgcatgccgcactgggggcagttctcaggggaggctgaggctgggccacgtgaggaagggccttccctggcagccaggatgcccctcgtcactccccttaggagccccaggcccaggccactcaggtgtcagatgtgccagccacctcccggcggcctgaacaggtgagcagagtggtttggaggggggtgtcccaggcccttgcttgtctactgggcctgacaccccaaccctgactggcctgggcctcccaggtcacgtgggcagctcaggaacaggagctcgagtcccttcgggagcagctggaaggagtgaaccgcagcattgaggaggttgaggccgacatgaagaccctgggcgtcagctttgtgcaggtaaggggcggaggaggggctgcgcgttgggctaggtcagaaggagggcctcggggtgtgagggactagatggggcaagaggtgctctgtagaggtctgcacatggcagaagggttcctgggagccattagggatctgtgggcctcttgagggtggctatgagaatcaggccagggtgagggtctgtgggcatctatggggcaccgcgggtctgcatgggcaggggattgaggggtcctcggagggtctgtgggcatctgtggggtacccacgggtctgcatggacaggggattagggggtcctcggggtccttggcaccagcgtggagctgttagagaggcctgtgggggccacaggggtgtacagtcatctgtggagctccatgggggctgtggcatgtgactgggtatccaccggccaggcagagtctgagtgccggcacagcaagctcagtacagcagagcgtgagcaggccctgcgcctgaagagccgcgcggtggagctgctgcccgatgggactgccaaccttgccaagctgcaggtggggttggggctgtagctgggcggagaggggcagggtggggtggggtggggttggagggcccagcctgtgtgacatgtacccatcccccaccagcttgtggtggagaatagtgcccagcgggtcatccacttggcgggtcagtgggagaagcaccgggtcccactcctcgctgagtaccgccacctccgaaagctgcaggattgcagagaggtaagcagtggggccctgggctgtgggcgggccagggcaggctcggtccctctctagggggccatccctatgctctgctcactgtcttctgcctgtgggctcatggcagctggaatcttctcgacggctggcagagatccaagaactgcaccagagtgtccgggcggctgctgaagaggcccgcaggaaggaggaggtctataagcagctggtaaggcctgtgtgagggacctgggtagcttaggagggtggggggatggtcctggggcagtgcctgctatatccctgcctagatgtcagagctggagactctgcccagagatgtgtcccggctggcctacacccagcgcatcctggagatcgtgggcaacatccggaagcagaaggaagagatcaccaaggtacactgccagggccatggagggtgggtcatgtgggctgtcaggcatagtgtggccgcacagggacctcacaccctcaggcagagctgtccagtcacactctaacacagaatagtcacacacaatccatcccagtcacccctgacacagtgacacagtccctgtctggtacacatgaggaccctccactgctagccagcctgccccaggcaggggctcatggctgccatggtgtctgccagatcttgtctgatacgaaggagcttcagaaggaaatcaactccctatctgggaagctggaccggacgtttgcggtgactgatgagcttgtgttcaaggtgtggggcaggttgggcgggggtgagtggggtgaggctgggctgctgccttgtgcatctgctaattggctggctggggtccagacccaggccctgtgcgaggctggaggtgcactgatacccagggctggctttgtttcatggaggatgaagctagtggggtggtgggagagggtggccttcttagggcatggagatggtcaagggcagcccactgatacctttgaggtccctgtgtctggtcaggatgccaagaaggacgatgctgttcggaaggcctataagtatctagctgctctgcacgaggtgaggggagacatgtgcctggggtggggctgctgggggtgggtgggactgggtgcaagccttctgctcctgttgtccccagaactgcagccagctcatccagaccatcgaggacacaggcaccatcatgcgggaggttcgagacctcgaggagcaggtgaggcctgggggcaggatggggagccaaggcgggccggggggacagttcctcaggttatgctgacagaggctgtggagccacacacagccgatggctggacacccagccctgccccttagtgcctgtgacctgggacaggcaagtggcctactgtgagccccagcttccaccccaagggccctcctgtctgcctcccagggccatgggcagaggcttcagcttaaagatgtagggggaatcctgccacatggcgaaggatgctttgggtagagggaacaccacacgaggcctggccatgggacagagcaggctgttggagttggtgggaggggcccagagtggctgtgatgggggctggtgagcaggagctgggaaaggggctgtgtgtgctgagggggcatgtgttcacattgcctcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgcggccttggacccagacccctgcccactgaccgcaacccttatatggggtgatagtccagcatgtggggagctcggctgcagtttattggggacggtactgtgggttgggggccttggatcccaaataaatgagtagttcctctgcagtctaa

SEQ ID NO: 4519 - DNA, 222655 bp, human
ccgttttcttgtccattacgcgctatccctccgcctctccttctttcttttcttttctttttttcccttctccttttcccccctctctccccctttctccagctccgtgtcatttcctccttgcgctcgctcgctgcctgagcgtctccagccgggagagtaggcggagcagggcggtgcggggtggcgtagagctggagggcgatggtggcggagctgctgggggcggaggcaacgtagccccctcggaaaaggagcccggcggcgcctgagcccagccgaggatggagaaccggcctgggtccttccagtacgtccctgtgcagctgcaagggggggcaccctggggcttcacccttaaggggggtctggaacactgtgagccgctcacagtgtctaaggtaagaactggcggctgatgtcctaacggcgcctaactttgaatggacaagcgggtgcgaaggctgccgctggacggggccctcaggccaactttgaaacttagggctgggagcgaaagaccctctgagcggcacggaggggtcttgccaccagtccaggtgcagacatcccctaagggtggctggaacacgagctgggagcacaactggcccccggctagaaccttgcgcgcagacacactcgcgagggcgctggggcagcccttgctgccccacgtcggggcggctacttccctcagtttgggccgaaggaagtggaggctgttggggatttctccttggaggcctctgcgtccctgcgggacagtgaaggactgaagggacagtcatcgcggcttggcagctctcttggcagcgttgtcccctctatcgaccggcgggccgtccctcccaggcaggttgcagggctaggggctggtgtgggaacggagatgaggccattggtggcttttgccagccacacttcccacggccggacgcgcacacatccattcagctcttggggcgttgttgccgccggttcggctcggcctctccctccctccagagtcctgccccagcgccggcgagatttcctgcacgttgagaagtgtggaggaaacttgcgccatggagcgcagctgtgctggagctactgctgttgctgctgccgctgccgccgccgccgccgccgccgccgccactgccgccgccgccgccgccgccagggtttgtttgttttaggagtctgtgatctgctggaagccaagttgcagctgaggacaggagagaggagctctcctgagtgctccagaacccccaaagcgagcctcccccgtaggggtgagggcgaggggtaggggcagctggagctgttaccaggaagagtgacttgtgggacgactcaccttgaggtgccagattgccaagtgaacggactttacgaactttattccacttttttgttgtttctcttaaatcctcaaatccgaaaagccctcccgcttccaacccgcttaaatggcagttgaagttgtagatgtgggttcaggctggagatagaaagatgtgtcttttcagcagggagcaaatatcactttttttttgcgggggggtggggttcaacattggtcacatctcagcagagggttcagcaaacgtccaccgcaacacacacccacaataacctgtgcggcattcgccttgcattggagcctgtggttgacttccagtgtatgggatccttcaggccttggggcccacactcttagcaaccctggagtgttgccatgggtgtaccaatcagattgaggagtctgaggtatgctgaggcaacattttgaggggctggcagggacccctctgatcattagcctccccaaactagcccagatcttcatccagcaccctttcccccatacttgtcatgtactttaaccagcctgagatgcgtttgtcatccactgtcacaacccctcctgaggcagtctccctccagtgttctctggagaaagttatatgctttttttttttttttttttttttaacaaaaacactcaactcctttggtgaggggaatcctggccttcaggaatttcttctaatcaagctcctcctctccccactctttccaccaaggtcacaatgggatatgcagccctccatgatctggcagttcctccctttctttttctcctcacaccgcccacagaatttccacagtctgcctagacaacctgccttggagaggtcatttttcagctctgcccagagctgacccatcttgagaagcaccccagagagtgcttgctgctgtggtcccggattattttgtgagccagtgagagcatggcagggggtgttactaagtatggggcagccagcaatttgtggtctggctgggggattatttgagagggtagatgagggtttccttggccaagctgtagaggaagtgcttcgtgtgttgagaggcagggtgccttttaatgattccctttccactgaatgtacagttgacccctattatatgaaggctcattatgacatgcatttagatatgcaagggataaaattatttctcccattcctcccaaatagcctagttcttaacagtaaaagtcagttataactgggttggcttcaacggtatataaagggaccatagtatttttttaagcacaatgattgcctgtattgtgtttttcttgacaagacactgttttggcatatttcattaattccctcttcatttttcaaccttgattttatttccttttatgattcagaacaatacagctttctccttgaaaacagccttcttagtctgtacacactggttgggatgggtggaaggtaatagaaagataattgggttggcagattaaaaacttgggttctaatcctttttctgccactctctagttctggaatcctaggtatatcacttgccctacctgggtctaggcatccccatatctaaaatgacattcaagtgggtggtctttaaatgatactatgacaatctagtagccatgtttttgtttgtttgtttttgagacagggtctcactctgttgctcaggctggagtacagtggtgccagctcggctcactgcatcctgtgcctcccaggctcaagcaaccctcccacctcagcctcccaagtagctgggactacaggcacacgctaccatgcttggctgattttttgtatttttgtatttttgtatttcaccatgttgcccaaactggtctccaactccttcaaacaatctgcctgcctcagcctcccaaagtgctgggattacaggcgtgagccaccactcctggccaaatagctaatcttttatgctagctctggctctcttctcagaagtgttgctgcagagtgaggaaaatgaagctttgcttcatttgcatacagtgttactatttacaatgtgcttcctcatcctttatttcattactctcttgcagctacactgtgaggcagtcaggaaagattgtggagaaactgatggaaaacccgagactgatgtattcagtggcttacctatgtctatcatactgagagtcaatggcagtcctactaagagagtttctgattcttctgttagtactgtggtttgtgaaggagcacagggcaataactttcagggatgtatctagtcttattagcctcctaatgcagtgtccctttccatgccagcctgtaattccatacttggtgacggactgggttgtaggtacactctgatggagtctgggctcagagtaggaaaggactattttgatgaccccaaatcacttgtgatgatctcaggtcagggagagacagaggtaaggtgcaggaagcatggtggaaaatggcagagaacctcctttgtggaaaaaaaaccagaagcggtttgcatcagggatggtgtggcatacatgctcagagatatcttgtggcacaagtggagatatctggggagtgggggaatttgaaaaagtagtgattagtgggggaagagggtatgcagtgtgaaagtctagttcatagttgtcatgggagaccctttggaccaggaaatgatcaagttggggaaatcatcaattcctgctggttcctatgatttccctgaatatggggaattcaactgcctgatttatggacacttgtatagtaccccccgacagtcaagtggcaaagaaagagaaaattttttaatactattgctggatgcggtgtcttgcacctgtagtcccagctactcaggaggcttaggtaagaggaatccctagagcccaggaattccaggctgcagtgtaccatgattgggcaacatagtgtgaccccacctccaaaaaataaaatacgattgattatcctaaataataagggatagtttatgatgtttccctatattgtggtgtttcgagtgagatcatggtaacaagtaaaagatacatgacccataaaggaatagggcccatgacattggcattattgattcctttggttaacatgttacgctacctcattgactcagaagtactgtctggatggaatggggattctcttctaatcagatgtgtctgatgatatgtaggctcatgctaacatattttcccttttcttggctcgtttatggtagatgtttctatctggcatagtgaagcaagtggggctagttactgccctggaacaaaacagagtggggtaggggagtaacctggaggagaaagaagctttactcccatccacttgatgtgctctgatattgctatataattttacactctccagacccaagtctctatttgcagagtggggcctaggcataactgccccatctctattatcacagatgatgagacaatgaattaggcaaactctaatagtgtttgccatccttagcctaggacagtggcagggcatgctcatcaagttgttttagtctgtattccattcctagtctgaccttatttctagaagcacacagagaggcagttgagacttcaagaggatctggataaactcagatagaggttgtcttgtggctggaagtaaatttggctgtgattttgaattcttattgggtgcagaggtggtattatgtgaacaatgagagttcctgtgaaatcttttgagctgtgttacagaccagtgcctggcactcacaaagggaccttcgtggggtgtgcatctttggagcttagtccagcctggttacctacatgaatcccctcctcatttctgcctctagaatcaccaaagatgtccactacctcagtttcccacctgctgccctatcccagaaagtagagggcattttgaggcatggattagaaatccatcagagagatacaaagaaggttggagggaggtggagcaagaagggtgggtggtatggctggtaacccttggctgagctttgagtcgatactacttttggccctgctgggttttcataatacacctggtaccccattgagagccacatgtatgcttgctgaagttaaaaaaggtcaagcctattagaggattttccctctccaaaacttcacacaaagaaaataattcaactccattgtcccttaaaaaaattaaaatgatttccccccttgccttccccaaccccctccccaggaatttctttaaagaaaaaagagagactcagacttgagattggaggttatggatgattatctggagggaacatcatggcttttatagttagacttctttagaactaagggaaaaaagatgctgacccatctgagaaaagttaatgaagaacagcagggattatgggaagggctgctctcactgcctgcccctctacccctcaagcaccaaggggcagacttaactcagtgctcccagagtaattctgttcttggtagagacctagaatcaaagaatctcagagtaaagagagccttttagaagtcacctagtctaatcttaaccatttcatgagcctcctgtgcagtgtccctgagcttgttctacagtagtcacaggggagctcattcccttctaagcctatccattctgttgctggaaagttttgactgtggacagcttttcctttgttaagctgcaatcgttttccttttagcgatcatccatgggtcctagctgtatcctctggatagcatcacacagaacaagggtgcttcctctgtcttgggacagcccttgggatatctgaaggcaaatattatatcatcttgtttcacttttctagcagagccctagctctttcagctgttccttatgggatgtagattccagcctctcctcctgtttcctcctcccactcatgatgcacttcagcttgtccatgttcctcttaagttatggatcccacagctgaatactgtaactgaggagaatctgaccacagttgagtatgaacattctttaaaaaaatacagctgaagatcactttggctctttctggcggccatgtcataccaaggccctgtgtcaaaatcttttaatggaagtagctgtgctgctattaagccatacctgcctaaggcctctatgaaggcatctgggacagccacataatagatttgggagggacacatttcatctcctactatttatttagaattgcctctgcccctagccctggccagccttggtaaatgcatcgtaggggagatgagagagaagatataagccctgacttcaaggaacatgtatgtttaaacaaagagattattaagttacagagaaggaatttgtataatagaagaaggaaatggcatttaatgaatagtgtcaaagtcagaattccagatcttttttatttcctttttacctctctgaacttaattttttccccttctggaaagaatagttgtctccaagattgaagatgctaaccatatgtgccatacactcttcaatttacagagcccctatgtaggaatatagagacagcagtctctgtccctatccactgtcagatatatatttccctgcatacctccactgacactgattggaaaagcccctgctgttgctgccatccttcagctctgggttcttctgtctgtacctggaatacacacaagagtgactcctgctggaggtcttgcatccacagcctctttctccccatctccccacatttaccagttgtcatctgagctggaaaaatatctttcgttactactaaagcctcgatcagggagtggattggagtggggcttaatctatattattactgaagggtaaggggtctgaggaagagagtgtagaggtctaggaaacgtgtcttcactgacacaatgttatttataatggttacattcagaacagttctggagaagcctatttaatccatagtgtatcattgattaaattacacaacctaaccatcatttataatgtcctatctacaggaaacagaattcaaagctccaagctgcttatttatagaagatattcttgggaaacaatgcattcataagttaggaacaaaaagtgctctagatagctctgttacacagttctgggggagtttgggattctgctaccattagtgcccaaggtgttcatacctttgatgctgggaccagatgtgtgtgcatggttacatttccctctgaaacggaattccaggtttccctgagagttatcttgtaatcagcaagtaacgtttttatattggttatgtcggtatcaagatcactttcactcagcttccatggagccaaaattttgtctcctggtgctccctgagatatactcccttcacacataattcaataaaatcattaatgaataagttgagttactattttttatggctaaagattgggttccaaggactgggaaggggtagaggtttgtctccttatacctctttgccctatccagtgtaaataggccaagtggaaaaattgtcttacgcattagtgttgcaacggatgatccattcttcctcacatcacactggcatgtttgcttggtcagatagccatcctggccacgcactgaagttgcaaaagtcaagatgacttgatctttcaaagtgagctctaacctctcccctttgacttcacatccacatcctcctctttcactgtgaatctatgactgtaccatatcgcaacacaagtactgcctagtagcaacagagacacattttccatgcatctaggctgtccttctttcatgtcaagtctttagttcccatcccccacccaagagcaccagttgcttgaggcctacattttggaccgtctcattcaagtgccattgcccctttgttcattcattgactgccctgccctctgtccaaaacccaacttttttttcttttttggtcacagtgagcccttctagtctgctgtaccagctttgtccctcttggctcagccatgcttccagtggtggcggggaggggtggtgggtagggaggagggagagagaagctcacagagttgaggttgataggtttgaaaacaatcagcaaatcataacagaatcagagggaaatttcctcacactgcatctctctctatcctgtttcagtgatggacagaatctctgttcttatattcttttatcaacttgctgaataatcatggcatgctactttggctctccacaccctcctgtttcttctcataccctccatgggacaagttcttgctttactgaagggttgctaaggacccttacttggtctaggctgtggaagtgtgaaggctgactgacagcaggcagctcttggagtgcattgcttttctccacactcctacttcctatctttctagaagtggctgtttcctggtatgttctcagggaggacatggtctgttaactttcactcaactcttttaatgttacatctgtgaggaatgcgggaggtgggactaatttgacaggatcaagggttaagcccagttacgaacagcccctttgtggtgtcttctgtcccccaccctaatgccactcaacagtttcctagctgtatgatcttctctcttttttcctgagcctctggcagggaagttttcaatggttctcctatactgcctttcacggtccataagaaactgatttttcgtttcggggagggggttggaggtgagatgaggtagagctagaagtaaagctggtttgactagttattctggaaaggagttagagtcttatggctgtagccccatctttacttatgagaggatgacaagctaaagccttgtctttgttgggctgccttgctgttttccatttctttttgtttgtgtttgatataagtaaaagccaccctgaaaaattctacaggtaggcagctttggatggcatcttactctgactgagagtgtgagtgatgacatcttgaagcttcagggggtaagtatcaggcttgactctcacattctgtagaggatttgacaagagtttggagctctgtattaacttaaattggcgatcaggaaggatcaagacaacaagcaaaagtagaccaggcaaggatttggatacttcagttgtgtggctgtgcctcattgagttcagtaacctcttgaacccaaaggtggtcaaagcctagacatggtgggatcggagaggtagtggaccgctgtatagcaaatactgctattttctaggtgttttacatgtattttcatttaacttttacagtaactctttgaggccagatattaatgtctccattgtgcagatgaagaaccgagactcaggagaagttaagtgaaagactctaagtcatatagtaagtgggacaactgacattcaaatttacttctgtccaacttcaaatcccatgctctttctaaaatagtgtgtttacacaggtgaaagacagagaaatagaagagaactagataagaatgagaggttgggggacagacggagggagggaaatgagggaaatgaaatttgatgcagaaactgataatattatgagtatctattcctcagaggtcagggtcaaaggaaggtctttgttttgttttaaatctcaaatcaaggtaaggggactgggtcggtattcagaaagcctaaagtttagtcccaactctgccactcttcatttgtgtgaccctgggaagtcattttcatctctctatctcaattgccctatttgcaaaatgagagtaatacaacctgcgctgttgtccagtagggagagagattcattttatcatttatttcatattattattagcagtatatgtgatgtaagaaagcaagcaagcgcattccacaggtgtcccttattaaacaggaattctcttaagaaaattttgagcctaaaaattgaagtgtatgaagttacctaatcattgggaattatgtgaaatggcagggcagctttcgtgtaatgtctgctactgcaaaaagttggaagaccagccatgatttctgctaatgtctgaacagccagcactttgaaaggctaacatcttaagagctctcagttaggcctccaatcaatcaatcaatcaatcaatcaactgatcaactaaccaaccaaccagtcaacacagatttgttgagcactttgtaaagtgcctaaccctaaactagagaatacaagagttagccaccatagaagacctggtttctggattctcaaaagagatgacagttttgttgaagagctgcattactataagcccaggaaacaaaaagctttaagtactgaaactgtggggtaggatctaagagcaacatttattcagtgggaagagatttcattgtgggctgatgtagctgggtgttttgtgaaaaaaggaagaattggagctaggccttgagggataatacaggatttaggtaggtaggcctgggaggaagaaggacgttgattccagttactacaagcactgcatgtcctaaagacacagacagaagactgagaccagtttgttcactccacagtgtgttgactaacagcataagggcagagcatgtagtgtttgttcatttatccacttattaattcattcattaaattttattgagtgcctgttctaggagctgagctattcttcctatggccaatgaaaccagcacagagctccatagatgtcacttttatttgttttctaacaaatactttatagtgcatattctgggcactagttttctaacttaacacatattagctcttttattttattttttgagacggagtctctctctgttgccaggctggagtgcagtggcgtgatctcggctcactgcaacctccgcctcccgggttcaagcgattctcctacctcagcctcccgagtagctgggactacaggcgtgtgccaccacacctggctaatttttgtatttttagtagagatggggtttcaccatgttagctaatttattaactccattttacacatgaggaaattgaagaaagattaggtgacttgcccaatgtcatattgcttgtgtggatggctacataagtgagtcagtggagatcttcttgattcttgcagactagtgggatataaaggtgaatggatttgagccaggtattctggataccccagaaaactgggctatagaatggatgcaagttggaagtaggtagccattttgtggtttggataatcagtgtattaagaataaggcacctagtctatggtcataccaccctgaacctgtccgatctcatctgatctcaagaataaagcacctagcacagtaccagtcacataattgcttccatgaggaaagacctgaactgaacaatagataggtaaggtcattttgaaggaatcagcccatcttggcaatttgctgacttgtcatacattagtgagttgccagaagttagtgataatgcataccattgaagaaatgaagaagaggtaggagtcagggattaatctaatatgtaaaatctagaaggctctgagagattatgggaattgggaagaccaaccaggtttagttcagttttggatcttctgagactgaagtgtctgtaggccaatcaaaaagtccctaggcagttggggagcatgtttatttaaagccactgatcagttaaaacaacaaagcattattttaggaacataatgatcaacacagacaatttactaatctactggttgttgtggaaacgagttaattgccagacaatcttatgccccaaagatagtagaacagacctgcattgttatttaatgggctttcctggccatagctttgtcttgctatctcctccaatctgtgggatgctttgtcaactgaggtgttactggctaaagttcattttgtataacttagaacttgaagtgataggaatcacttcttggaatgcctttccgttgccacttttgtgcaacatcacccgattttctacatggtgaagaactgaaaatccgaatgttgtaaagatgcttatgccatgcaacctggtctaaattaactccttccctaccttcttgtagactaaagtcacttcttgctaaaaggctaatgaccacatgggttcctttacctagctcctctctctaacaacatgaaatagcttgtaatttatatttgaaattgatttgaatctgtagctgctggggagatttttgtgtaaaagattgcccaagtgctctgatttttacaagcgcctgcttgctaacttccctctgttgcgtgagccctggtgggaggctgatactctccttttctggaggtaaggggctcaagatgtaatttgcgtgtttttcccatgcctttggctgaagaaaagtgcagtgttctgaaacctgcccagaccttgcacatactgtatctgcttaaagagggttttggctcttagcccttctcagctgcattagggttcaggttacatccctctccccatctagccactaataaaagccaaaataattaaggatcagggagagttaattcccactgctaagacccaggtggggcccttccatctcccatcccctagcttggagccctaatttaaggctgaactttagtctaagtctataagtgacagtgatctggaacaggccccagaaaagcacttgacaatcaggttttgccccatgctggcagtacgtgttctctctctctctctctctctctctctctcctctttctctctctctccttccctccctccttctccctctccccttccctcctttccctaccacgttggcatcttagaggagaccagtgaccccagggatcaagccaactgattctgttgcagcaatggaaataatgtatcatacttccctttcatctaaactgggagattcagatgaagcttctgttttttttcaagcccttgacccaacttcagtacaacattaggagcctcattcagaataagaaacatcattgatatatctctcaactcaaaagagttgcatagtaatgagctcttagtgagctcagatgggaaagggcagctttgaaggaggatcttgcaagagctgggacaggcaggaagaagcctcattctggaacaactacactactgtagtggcctcctcaatggtttctttccctttgatcatcccctcctccctcccttaaaattatttaatggttccctgctgcctgtagaatagagcccaaactacttttgcctggtattacagaccattctccatctggctccagtcttagcaatccttccaggccccaggttttcaggcagaacggttacctctctgttccccaaacccacctgggaaattctggcctccgattttctcaccatgatgttctttccagtggctagacttcacactgcatccttggaaggacttctcacttctctggccctctccataggacctaaccttcaagccctacctctaagcctctagggcatcatctttgattgctcctggtggaagcaatcagaacctcccctctgaaatgccggagttctgattttccagtagctgtctttgggtactttggctgtcttgtgtttggtttgctggatcaagatcttctagacgacaatggctgtatcttctatatattttccatagtcagcacagagtagactctccatcatggtttgctggtttagataatatgtaagaagagtcaagcaaaaattttttactccgtgattggtaatctttcccctttccacttccaagcctaaattagagaatatgactagatgatctggatatactggccaagtttcccaaactttgtgtgacaccccacctaagtggggtgagccttgaatgacacacacatgggaactagaggcagagggaacacttagaagaaaataatgttggggacagaagttgagaaggatcccagaggcaacccaggatgagaaggagcagtagaggatggggttggctacctgcttgtccccaggctgcctgaagtttggtttataacagttgaatttcatgctgctgctggagttcctgtgtgtaagctgtgttccgaggtttgcatgtgggagaggccggctggctgatgattgcagcatttcctatggtgttgggacgcgttgctgtgagactcttaaaacaacagccatcccacttgttgctatgtgtttaaggtgggtgtagtgtgtgtcttcagtgaaactcaagtgtttcactgctttagctgagaggcagtagctttgggtgaacacactctgtgtgtgtatgtgtgaatgtatatgcatgtgttttcactttttcttaagcaagctctgacatgttgtgtctgactggccttggatgtgagtcactgtctggtatttatacccagtgtcttaagtgtccttattatttgaccatgatattgctattctccctattttactcaaagctgagaatgctgagaagggccaaagggaactcactctgtcttccttccaaatggggtctaatctcattggtggttaactgtctctgtggcagtcaattaggttatgtaagggcactaaagggaacaggttgaaattcacagtagtagtactgtgacagtttaaaagacacactatagggcttctcttagtttgttcctgtccaggatactgttggagagttcacccactggaatgactttaggaacaggcctcgaaagggccttagcacaatcacaataagtatgaaaggagtacaaacaaactgagaaagccttagagaggagatgatccagcctttgcaggcattggtgagagaagcagagaatgttagcttcctccttactgttgtttgtattaagtccttccaagattgaaaattttgtcttagaagcaggctcatagagtgtgggaatggtaaaccccatcagaggcactgttgttatcaaagggacagagcctcagataggaaggacatggctgctagcatggtcatttggaggccaggcagccagtaaatcatttgagaatgagttaaaggttcaaagggcaggagggaattctttgggtgacctcataggtgcttgaaaaatcaaagggatagctcgtgtgcttttatgttttcaggcctggttcggagggtcaagggaatggaaatgcacagtagaaaattggcattgctgtttttatgtgcttgggaaccctaactccgggctggtgatcgtcagagttaccattaattagatgcatattttgttctgggaattttatatgcatactctctaatcttctcatctctacttactgtaaattaagtagtagtattcctattttacagatgaaaataatgaggttcagaggggcaaagtaatgttctccaagtaaccaagccagtaagtggtagagctgtgatttgaactcaactctacctgaccccaaatcctatgcttgtcctactataccttaaaattttacttcagccccaaagcccctttctgtgtttcatattgtctttttaataccactgttaactatgatgactatattctgtgtttcatagcattggaaaacgtgggtttcacagatcagtcagtttacaactttgctgggaagcttgttaaaaaacacagattagactctgaggatgaaataatataatgcacgaagaggtacttagtagtgtccctattccaagatgcagaaattgaggctaagagggaagtaactttccagaattcattggaccagtaactggcagggctggtattcaaaatccagtttatctgattttagagtgcctgttctttcccatgctcttgttgcctcccaaactagaaggggagtaagcaataaacaaaaaaccagacttgaccctctcggcccctacaaacctacccttcttactgccctctctgtcaataaattttttttaagtgaggggtggcctccctctctccctctcccctccttccttctcttctagcacaatttatttatttaaatgtttattttggggatagatgataaatgttcatggaacaaaatttttaaaactatataaatgggtacatctttcttcattcatgtccctaaaccacctaatttcccttcccagtggcaatcactgttaccaattccttgtgtactcttccaaagacacccttccaaagatacattatatgtaggcatgttgtatatgctcatatacgtgcatgctcagtgtctctgtttcctcactgcctgtcttcctgaatcctctccaatctggcttccaatgaggtcttcctgagggccaaatatactggccttctcactgttttcatcatccttgttttctctatacaattattgtttttcaataatttgttgaataggtaatgtagttatgtggtttaaaaggtagttagtatgaaaaggcggagaatagtttcccagtcatccttgtctctcatctgtccagtttcaccactacctcccactgtgcttagatatttctgtgtgtcttttcagagcctctctatacatacacaagcaaatgtcaatatagattctttattttgccttttatacaaaaggtagcatactaaaacaatcttttgcacttcgcttttttcacttacatatcctagagatctttccctatcaagcatacagaaggttatctctattttttaacagccacattgtatttaattatttaaacagttcttagtattgctagtcattggcattgtttccaaaccattcagactcgaccttctccaaactctgctgccagtatagctcctgtaatactgaactctcctgtttctgcatcttctcttgctgtttctccattctcctctgtaaatcgactgcctctcttatctctatcctgtggatattcctcaaggctcagcactcagtccctccccccgcactcttttctctgtttcttctttccctattctccctccccccatcctttccccctctcctcttttcctcaagaaagcaacgatgagatctcataactcctgaatctctagtcttaatcttttccactgtctgatagtattcactggaatatttcttttttacctcataccccagtatgtctaaaatggaacttatcttccccttgtaaaatgggctctttccttggcttccccactcagctagcattaaaatcatggagtcattgcttactcatcccatatcccacattctgtcagtcttgcttcctttacaatagccctcatatccacctgcttcttttcaattcctgctactcctaccctcttccaagctcttattactttatgtctggtttctggattcctggctggcttccctgcttctaagatcactcctgttaaatttatcttataagacacttcttctatccaagaattttagtttccctttctatacaatgaggaagctggactgactggttcatctcagaggtgggttaaaatcctagccctaccattccttccacctccgacattctagaccagaactccatcctttccacctctaacattctagaccagaaatcttcccagtgtctccccacctcccaccatttccactctctgtactgttctctttcacttgaattgttgctatggctccatgctcccagcagtgccttgaaaaaatctttcttccatattggtcctagagtctttatcctaaattaacttacagttgaaaggaatcttagaggcaggccatccaagctgaccaacactaacctgctgcctgagtgccattaataacacccttgaatttggttggtcagactgttcttttgaatgcttccattgatggagaacattatctcataagccagccctttgtattgtcagatagcaagagttgttctatatctcctaccacaaactgacaccaactgatctgcctttatgatactctattattaaaaacttgcttcatcttgatttaagttcaaacccctcaggtctggcatccgaagttctccagaaatatggctcctatcttcccctgtaggctgaaatcatggatacttcctttgcacttcatccacattttaaaaaatagctaatatttattcagcacttattggatgccactgttctaagtgattttacatgtattatttaatccacatggcaactatatatgtttctattattcttccccattttatagagaaagaaaatgaggcatatggaaatccaaatggtttacccagagtctcacagttagtaaatggtagagctaggattttaacccagaaaggctatctccagagcacatacccataatcactgccatacacagtcagcctcaaatgtgacaataattttctgaatatgcccagtgacttgttatcatggtttcttaaaatgcatttctagtcccagctacctgactaaatcttacctgttccttgaagcccatcagaaattacccttccttctggtcccattctaccccatcttccatctggtgctcaccatgttctttctaatgagctgggcatgcttgttttatatacttcatgggatatgctccttgagggcagggcccacagacataaactgctggattaggcttttaaccccaaatctgttccatagagcatttaacaagtagagctaggctttaggaacttctgaaagacttgagatttcttctttttgagtttgtatgaatctcctctttctaaatctggctctaaattctttctttcttaggctattaattcatttctgtttattgcccaatagttttgcacatttgttcccaggtactctcagggccagaaaacaagtgttgttatccatggttttatatatatatatatcatatatatatatatatatatcatatatatatatatatatcatatatatatatcatatatatatatcatatatatatatcatatatatatatcatatatatatatcatatatatatcatatatatatgagatatatatgatatatataaagatatatataaagatgttgttatccaacatatatcatgtatgagatatatatatatgcacacacctatatttatatatatttatagacacatacacatatatatatatatatatacacatttatacacatattcatacatatatatactgggagccaaatgaggaacaatattaaaaagaaatttcattacatcccttatctgtgatctgacttccttaatatttataacttctgatctcctctcttccttgtccttaacatgtattactatgctaggtagataaataggtaggtaggtacctcaccacacaatctagagattgtgaatctagagactgtgaattttagtgtgtgtgtgtgtgtgtgtgtatgtgtgtgtgtttgtgtgtgtcagagagagaatgatggagggtggttgggtagttggagggacagttttttgagtgcaaagcttccttgtcttctgtgctaagaaagtctctttaaaatgctgcgtcctgcagaacatccctcccccaacctcctccttctcttctatttcttctcttaatttcatagtgattgtagtttcccatgtgtattttgtaaatgagttctgtctaaaatttgccaagctctctgttcgagtgagatatgctcatctagcatgttagacaacaacatgatttactacccagacaggctaattcagcgggtaacacatcattctctgaaggatcacggtactgttaattcaatgtgtaccaatttaattatatttcagaagttaaaaaaagttaaatagctccagttgcagtgttctagttcactaagcattgactataaatcattagtggttactttacaaatttatgttgatgcactggctggtattttacataagtataagccacctacctcagggtgtctaacttggttttgtaaagtacaaaatgtgctcttgatttctctctctggccccataatatcttcatcaacccccaccccaacccatacaactttcacagggcccctttttttctcccttcacatatttcatcagactctttaaggaagtcatagactggttgtgattattactgaaccatatgggaaccacacatctttttttttccttctactttcttgtataatggttatgacttcttaaatgaattaaaaagccccaagattagtttttaactattgaaagacttaaggccaggtagccctgctttaatttcatcattcaaaaaagccaaagttagtaacccctcttttttcttttcttttagatatcacctgaaatctgttctccagaagggtgatactagttactgcaatatacattagcgtgcagcattcatgaccctttattgtttttactaaaatcttcaggattagaagggtctgggagtcattagatagtctcctcttccaaaatgggttgtgcctactagataaaatttgactaaaaagcaatgatactgatttttttctccagtctttacttttgtattttcgatgtcagaaagtatattcatatgtcttgttaaaattttacattcatctaacttactttttattgtagtgagaacatttaacatgagagctacaattttaacaggattttaagttcacaataccacactgttaaccataggcacaatgttgtacagcagatttgtagaacatcttcatcttgtattactgaaactttataccccttgaatagcaactccccatttccctctccccctggctcctggcaaccaacattctactctctgcttctgagtttggctattttaggtacgtcatataagcaaaattatgcaatatttgtccttctgtgaccagcttatttcatttagcataatgtcctccagacttatctatgttgttgcatattggaagatttcctctggaatgatatttcattgtgtcttatgccacattttctttattctttcatccatggacatttaggttgattctacatcttggttattataaacaatgctccaatgaacatggggttttaaatatgttttcaagatcctgatttcttttagatgaatacccagaaatgggaatgctggatctagtatgtagttctagtattaattttttgaggaacctccatactgttttccatagcagtggcaccattttacattcctacccatggtgtacaagtgttccagtttctccgtatccaacacttatcttttctcaaaaaaaatggccatcctaataggtgtcaggtgatatctcattgtggttttgacttgcatttccttaatgattagtgatgttgagcatcttttcatggtcctgttggctgtttatgtgtcttatttggagaaatgtttactcaagtcctttgcccatttttaactggattttgttattatgctgttgagttgtataagttccttatatgttttggatattaaccctttatcagataaatgctttgcaaatattttcttccattccataggctgccttttcttttttttttttcctgagagagagtcttgctctgtcacccagactggagtgcagtggcatgatctcagctcactgtaacctctgctgcccgggttcaagcgattctcctgcctcagcctcccaaatagctgggattacaggtgttcaccaccacacttggctaattttctttttttgtatttttagtagagatggggtttcaccatgttggccagactggtctcgaactcctgacctcgggtgatccaccagcctcggcctcccaaagtgctggaattacaggcgtgagccaccatgcccagcctaccttttcactgtgttaaaagattcgttagttgtgcagaagccttttagtttgatgttgtcccacttgtttatttttgcttttgttgcctgtgcttttagtatcatattcaagaacccatggccaagactaatgtcaagagccttttccctcacattttcttctacaagttttgcagtttcaggtcttatgtgtatgcatatggtgtaagaaagtggtttgatatccagttttcccataccattcattgaagagactatactttccccattttgtagtcttgatacccttctcaaagatcacttggtcgtatatgggtgggtttattttggggctgtctcttctgtgcccttgctctatatgtacatactgttgattactataactttgcaatatcaattgaaatcagggaatccagctttttcttttataagattgttttggctatttgaagttctttgcaattccctctgaattgtagagatttttttttcctatttctgtaaaaaatgccactagggtcccagcacttttggagattgaggcaagaggattgcttgaacctaggattccaagaccagcctggacaacatagtgagaccttgtttctacaaaaaaaaaaaaaaaaaaaaaaaaaaagtcaggcatggtagcacatgcctgtagtcccagctactcaggaggctgaggtgggaggattacttgagcctgggcaatcaaggctgcagtgagccttgatcatgctactgtactccagtctgggtaaaagagtgagaccctgtctcaaaaaaaaaatgccattaagattttgatagggattacattgattctagatcactttgggtagtatggacattttaacaataagtcttgcattcattagcatgaatgtcttatttatttgtgtctttgatttctttcatcaatgttttatagttttcagtatacaagtcttttgccttcttagttacatttattcctaagtattttattattttaggtgctatagtaaatgggattgttttcttatttttttgaggtagtacattgttagtgtatagaaacactgttgatttttgcatgttgattttgtatcctgtaactttactggatttattagttctaacagtttttttatggagtgtctaggattttctccgtataagatcatgttatctgacaacatacaagatcatgttacctggtaagtaaaaaataattttacttgtttctttcttattttgatgcctttacttattttttcttgcctaattatgctgggtaagaattccagcactatgttgaacagaagtggcaagagtgggcatttttgccttgttcctgatcttagaggaaaaactcagcttttcaccattgagtatgacattagctgtggggttttcttatatggcctttattttgttgaggtaatttcattctatttctagtttgttgagagctttttatgaaaggctgttgaatttgtcaaatgctttttttgtatctcaaaatgatcatgtgctttttatcccttattctgctaatatgttgtatcacatttattgatctgcatatgttaaaccatctttgcataccagacataaatcccacttggtcacagagtatcatccttttcctgtgccattgaattcagttttctggtattttgttgaggattttcgcatcagttttcattggggatattggcctttagttttctttttttgtagtgtccttatctgtatcaggtataatgctggcctcataaaatgagtttggaaatgttcccttctcttcaatttttgggagcgtttgagaaggattggcattaattctttttcaaatatttgataaaattcaccagtaaagtaatctgttcctgggtttttctttattgggagatttttaatttactaattcagtctccttactagttacaggtctgttcagatttttttctatttctttgtgacagtcttggtcagtcatatgtttctaaaaatttatccatttcttctaagttttccagtttgttggcatatacagtcatgcatctcataatgatgtttcaatcaatgacagaccacttatgtgacagtggtcccataagattgtaataccatatttttactatactttttctatgtttagctatatttagattcacaaatgcttaccattgtggtataattgcataaaatattcaatacagtaagatactgtataggtttgtagactaggagcaataggctctatcatatagcctaggtgtaataggctataccatctaggtttgtgtaagtacactctgtgatgtcacacagtgatgaaatcaccttatgacacatttttcagaacataatcctgtcgttaggtgatgcatgattgtaattgtggtatcagttgtaatgtcttctctttcattgatgatttaatttatttgtatctttctctttttccttggcctagccaaaggtttgtcaattttgttgatcttttcaaaaaattaacacttcattttgttgatcttttctattatttttctattctgtattgtttatttatgttctaatctttattatttctttccttcaagtaactttgggattagctttttttccttatttttctagtttcttgaggtgtaaagttgggttatttgagatttttcttttttaatgtaggcatttgtcactataattttcctcttggtactgattttgctgcattccatcggttttgtacattctattttgtttttcatttatctcaaaatattttctaatttcccttttgatttttttgtttcacccattggttatttaggagtgtattgtttaatttccacatatttttgaatttgccagttttttttctgatattgatttctagtttcattccattgtggtcagaaaatatacatggtatgatttcaatcttcttcagtttgttttgtgacctagcatgtgatctattctggagaatgttctgtgtgtacttgaaaagaatgtatattttgttgctttgggtggaatgttctatgtttctgttaggtccatttgatctatagtgttgttcaagttcactgtttccttttgatcatctgtctggatgttccatccactattgaaagtagaatattgaagtctcctactattatagtattgctatctatttctccctttagttctgtcaatgtttgctttatatatttcggtggtttaatgttgtgtacatatatattcacaattcttatatcatcctgtgaattggccttttttcattgcacattgtcctttgtctcttgtgacagtttttggcctattttgtctgatataagtgtagccaccttgctgttttttggttagcatttgtatggaatgtctttgtccattcctttactttcagcctgtgtgtccttaaaacttaagtgaatctcttatagacagcatatagttggatcttgttttttgatccattcactcactctatatctctcaatttgggagtcaacccatttatatttaaagtagttattaatagagaagaacttagtattgccaattttgcttattattttctgtcttataattttttttttttttttttgagacggagtctcgctttgtcacccaagctggagtgcagtggctcgacctcggctcactgcaagctccgcctcccgggttcatgccattctcctgcctcagcctctccgagtagctggggctacaggcgcccgccaccacgcccggctaattttttgtattttttagtagagacggggtttcaccgtggtctcgtctgtcttataattcttttttcttgttttgtaatgtcttcttttgtgttttgatttctgtattgagtgatttctctttttcttttgtgtatattttcaataggtatgttctttgtagttagaagagtttacattaaaatatcttatagttattgtaggctattttaagctgattaacaacctaacttcgatcacatacaaaaactacagtttccccttcacacactttatgctattaatgtcacaatttacctatcgttttatttttatcattaacattaacatattttatatttacagtctaacacttttgccttttaaattttatactagaattaaaaatgttttacctaccactatcacagcattacatcattctgtatttgtttatatatttaactttgccagtgaatttcacacttgtctgtattttttgtattattattttatgttctttcatttcaacacaaagaactccctttaactctttatcatttcttgtaaggcaagtctggtggtgatgaactctctcgggtttttttgtttgtctgtttggtctggcaaaagcttaatctcttcatctttttgaaggatagttttgacaggtatagtattcttagttgctggtgggttttttttttttcttttagcgctttgaatatatcatcttctggtctgcaaggtttcagctgagaaatccactgatagtcttttggaggtttcttttatatgacaggttatttttcttttgctactttcaaacttctcttttcatctttgcctatggacaatttgattataatgtgtcttagtatggatttctttgagtttatcttatttgccatctattgagcctgatggatctggatgttcatttcctttcctagatttgcaaagtattttgcaactatttatttgaataagctttttggaactctttctctttttactctccttctggaacttccataatgcatatattggtctacttgatcatggcctttaagtccctttagctttcttcactctctgtaattcttttcctcctctgactgtataattaccaacgacttgtcttcaactttgctgatcctttcttttgcttgagtctcatgttgaacccctctagtgaattttttggttcagttattatattcttcagctccaagatttctgtttttttttttttcttttttgagacatggtcttgctctgttgcccaaactggtgtgcagtggcaaaatcatagctcactgttgactcaaaatcctgggctcacgtgatctcccatctcagcctcccatgtagctgggactacaggcgagtgccaccacgcaaggctaactttttaaattttttctgtagagacaaggtcttactatgttgccgaggctggtctcaaactcctagcctcaagcaatcctcctgcctcagcctcccaaagtgctgggattacaggcatgagccaccatgcccagcctgaatttttaatatatatattttatatctcttttttgaaatttttactttgttcatgtgttgttcttctgacctccttgaacatctttatgttagttttggctgtcaggtaaatcatatatctccaatttatgataccaggacatttattttgtccctttgtttgggatatatttccctgtttcttcatgtcccttggctctttgtgtgagtatctgttcattaaataaatggctacctatcccagtcttcatggcctagccttatacaggagaagaccctcatcagtcaggccagctagagatttagggggccttttaaagctttatgctattccaccctactttctttgttcttagcagggtaactgcaaggccaaaccgccatctctgatcacactggtcctgaaacagagtgtgctgggtcctgtcagtacttcaatacaaacaagacataaaccagtcctttgtgcatcccccacaaaaaaggttggagcacgggacacgtggtccaactcctttcctcaccagagagaagataggagctagggattttcatctgctggctctgtgctaagctgggaagaggggttatagcaactgctagcctaacatactgtctctcatctctggttccaaggtggctaggtgctaggtcccatcatcactctgagacaggcaaaactgaagccaatcttctggacagctcctggaaaagttggggcactggacatgtggtctaactccttcccttcctagggagaatttggaatctggtgagggggtcttcccaattgtatggctctgtacagggggaagttattatgctgacagggtctctcagatttccctgctggctttaatgtggtagtctcatcgtacaggagtctcttatgtagtttctggatttttcaaaaagggaatttgtctatattttgttgttgaatttgtttgttcatgtggttaggagagttgagggttttctattccatcttgctgatgtcactcaggatactgatttttatttgtttggaaaattagtcttattttattaatatattcactatgatattcaggcaaattgacttaattttacattttattgagatatatttgatgtacaataagatatacatggatatacatgtataaatacgtatataaattgatgagttttgaaatgtgtgtgaaactattaccataattaagataataagcatgttcatcacacccaaaagtttccttgtgcccctttgtaatccagctccacaacccccaggcaaccattgatgtgctttctatcactacagtagcttgcattttctagaattttatgccaatcgaattatacagtgtgtatttttctttgccttcttttactcagcataattatacttatatctgtctatgttgttgcatatatcagcagtttgttctttaatattgctgagtaatattcaattgcatagatatatcatagtttgtttattcattcacctggtgaacatttgcattatttctggctattatgaatagtttttcatagctattatgaatagttattcatagctattatgaataaagctgctatgaacagtcacatataagtctgtgtgaacatatactttcatttttctttgttaaatctatgaatagaatggctcatcatggttaaatctatgagtagaatggctgggtcatatggtaggtatatcattatcattttttaaagctgtcaaatcattttctcaagtgattgtaaacatcttaagtcaatactgtaggagggttccattcctccacattctcaccaacacttattatggtaagttttatttttttaatttagccagtctaatagatatgtattggaatttctttgtagttttaatgtatatttttctaatggctaatgatgttgagcatcttttcatctgtgtatttgccatatgtatatcatctttagtgaagtgtctatttaaatcttttgtacatttttattgcttgtaatactaatattgagttgtaagagttattttttattcaagatataagtcctttgttggatatgagatttgccaatattttctcccagtctgtggcttgcctttccatttcttaatagtgacttttgaaaagtaaaatgttttaattttgaattttcataaagtccagtttaatgattttttcttttataatttctgcatttgtgtcctatttaagaaatttttgccttaaccgatgtaactatgatttttcttttatattttcttctagaagttatataactttagctcttgcacttgggtttaggatccattttgggttaatgtatgttttgtgaagtaagagctaagggatttttgggttttgtttgtttttgcatatggacgtctagttattccaacactatttgttgcatatgaacatccaattgttccagcactatttgattaaaagattatccttttccaggccaggtgcattgactgacacctgtattcccagcactttgggaggctgaggcaggaggattgcttgaggccaggagtttgagactagcctatgcaacatagcaagaccccatctctacaaaaaaacaaaaacaaaaacaaaataaaaccactttttaaaaattagctgggtgtagtagtgcctacctgtagtcctgctatgcaggaggctgagatgagaggatagcttgagcttaggactttaaggctgcagtgagctagaatcacaccactacacctcagtctgggcaacagagagagaccccatctctaaacaaaacaaaacacaaagattatcctttttctacttaattgctttggtacctttgtcaaaaatcaattgaccttttacatatggatctatttttggcgacgccgttgtgtaacattaacccatatgtttatctttatgccaaaaccacactgtcttgattactgtagctttataatatgttttgaaatcaagtcgtataagtcctccaactttgttctttttaaaggtgttttggctattccttgtttgaatttttatataaagtttagaatctggccgggcacggtgtctcacacctgtaatcccagcactttgggtggctgaggcgggtggatcacctgaggtcaggagttcaagaccagactggccaacatggcaaaaccccatctctactaaaaatacaaaaattggctgtgcatggtggtacatgcctgtagtcccagctacttgggaggctgaggcaggagaatcacttgaacctgggaggtggaggttgcagtgagctgagatcacgccactgcactccaggctgggtgacagagcaagactctgtcttaaaaaaaaaaaaaaattagaatcgacttgtcaatttctatttaaaatggctgctggcattatgattgggtttgtgctgtatttatagatcagtttggaggagaattaatgcctgagcagtactgatttttctaatctaggaacaatgtatatctctccatttatttaaatcttatttggtttatctcagccatgttttgtagtttcactctaggtcatgtacatcttttgccaaatttatctctaagtactttcatatttttgatgttattagaaatggtttatattttaaaatttcaccttctgatggttgactgctactatgtagaaatatgtttgatttatatacattagttttatgtcctgcaaccttaccaatctcacttattagttctagtaaactttttctagattccttaaaattttctgcctgcctgatcatatcatctacaaataaagatgatttcacttcctttgcaatctgtatccaaacctcattttaaccagctgtacgtgacttggatgttatataacttctcattttattttattattttattagtccttattgtggtaagaacatttaatgtgagatctattcacttaacagatttttaaatgtacaatatagtattgttatttatgggcacaatgttgaacagcagaactctagaactcattcatcttgcataactgaaattttattcctgttgattagcaactccccatttccccttcttcccagcccctgacagtcaccattctattctttgcttccatgagtttgactattttagatattccatataagtagaatcatgtagtatttgtccttctgtgactgacttatttcacttagcataatttacttaagattcatccacattgttgcatattgcaagatttccttcctttttaagggtgaatactatcccattgtgtgtatcgattgtatgtatacatcactttttgttttccactcattcatctattgtaggatatttacattgttttcactatgtaacttctcttaaacctgagtttccttatcaataatatggagattgtaacagtacatactcagagggttattgtgaggattaaatgagataatgtggataatgtttctagtacaggacctggcagaattatagcccctatatgtttctcttttgggccctcctcctatttcacaaagtcaacatccataagtaatggttgtcctcctgacattaatttcctttttagtgtctctcatcagctaatttatccaaaccttaaaaaaaatggtttatatagtcaagctgttttaaaccatgggagtgatgtgctttctgtttactaattgtatacagttggacttaattttattagattttttttttttgagatgtattctcactctgtcacccaggctggagtgcagtggcgtgatctcagctcactacaacctctgcctccaagttcaagctattctcccaacttagccttccaagtagctaggattacaggcaagtgccaccacaccaggctaatttttgtatttttagtaaagatggggtttcaccatgttggccaggctggtctcgaactcctgacctcaagtgatctgcccgccttggcctcccaaagtgctgggattacaggtatgagccgctacgctcggcccattttatttgttttaaattgaccatttttaagcctttcatatgaagatctccagcttgatgctattgtccctgagatgtggtaaccagacctgtacacaatatcccaggtgagagcaaaccatgaagagggaatttaggggcaggatgaggtgagggagtgagggaagagagtattttctgtctttatttttttttctttctgtttctgatctaactagaccgataattgttttggctgaaatagcaatttgggctggtgtgttcaggaaacagtctacagtgactttcatatctctttccttgttcggagctgatagcttggagcccatattcctagagacagaatctgcatcccccccactccccatccttaaaaaaaatggcattaattatcttataattgtccctgctaagcctctgagtctgtatctggaatagctgggaggcctcttggtctcagcatatatgcgtaagtagtcagggtcagacaaaagcctccctggaagtgtcctgtggaccctttcagccttaaaacttctggttccaacatttgttttcccttcgtgagtgtaatatggagcttaacaaattatgttggatggtggttatgatgtttaattttgtgtcaacttgactgggctaagggatgcccagatagctggtaagacattatttctgggtgtgtctgtgagggtgtttctggaagagactagcatttgaatcagtagactgaataaagaagatcaccctcaccaatatgggcaatcatcatgggatctgtaggggtcccatccaaataggaaaaaaataaggcagaggaagggcaaattctctctctctcttctttagctgggcatccatcttctcctgcccttggaccattggtgcttttacttctcaggccttcagactcagactgggacttacacctttggctgtcctagttctcagtcctttggcttggactggaaccacaacactggctttccccccagcttacagagggcatatgatggaactttttagcctctataatcagtgagccaatccctcataatatctcccttcctatatttatctttatatccttttagttctgtttctctggaaaactctgattaaccaaagaccataactctgttgggagttttggattttaggttatcaagtgaaactcttatatccagctataaatacttgaaaagagatcgagtgagttagaaatgaaagatgaaatatctggatctatttggggccaaaagtttaatgtttgtctctacagtcctagtttttatcaatatgaaatcccctgaagacatagactacagggttgctactaacccatatagtgcttttgtgccaattacagaaagactgtcttttctgcaggtggattcagccctgttttgaggcatgagacttggcaggtggagcttaggttctcatttactccctcagcctcgggactttatgcactgtttacatgccatgtgatttcattaatagcacttttcatgatttccttttcagatagaactcacctttgtttctccaactccttaaatttgaattttccaattgtatcttatcactgccatcactgactcattttcagctgcagcatcctttgaggttgcaatgcaattttcctttttccctactttcttaccctttgcttggtataccatattgttgattctagatgccatgaactctgcctactacttagttggcttttaaaaattatcttattaatttaggtggctaaaatatctcatctgtatgcatagataattcagtgtctatttctcttcctttcttgtaataaatgggactgactgactcaagactcttttgcatacttttttacccaagggatttattacctaacagccacacaaagaggttctcactgatacgccaaacaccatgctgggagcttcagctgtgcctctggcccctgggcctattctctccactagatgctgccaccgcttgctatgaatttggaagaatcccaaaggccaccactccccacattccccttccaggaatgtccttccaggaagaggactattttcctagctctggccctaatcccaagcattatccccctctgacttctcttaacagcagtgtgtgttttgcagatggtgactgggtgaattcccagggcaggaaggaagaaccagagatagcaatgtccaggagaggagtgttggaggcacattgcgagactctcttcttcttcctgcatgttccagattccctgattctagcttaggaatatctgtacatacttcctgtacaggggcagtctatgtagctggggatgtagacaggtttccattaaccatttattggcctgaaatcctgatggagaaaatcccagagacccagatgattatccttggcttgctctttacaaactgttcacttcatgtttaagtcactgaatgcaatatccacagtactattttaattatttgtatcactaagcttgtgagttcttacaatgctaatccttcttttctgaaatctgggcacccaaaatagtcaaaccatcaacttttacctcattctatattacatcttcgaatcaactgtttcttttctctgttgtctataaagccctcttcttataaggaacatggactctgaaatccctcagacctgaagtcaagtcaagctgtgtaaactttgccttctgtaaaataagattaccattaatcttgctgaggagttgtgagaattcaataagagtatgcagacaccagagacttaaatttcaggcacgcagtctgtcatggaacaattctatatttatgattattagtggcctaagttttgaaatacttattataattaccttctaaaaacatttaatacctaaaacttatacagtggtaactcggccagatgctgttctaagagtttcccatctctctactcatttaactcttacaacaaccttgatgtggatattattagtatcttcatttcacggatgaggcaattgaggcacatataggccaagtaatgtgcctaaggtcatgtagctgggaagtgtcggaaagtgattcttgatctcaggctggcaagctccagattccctttattaaaaccactatgctataataaataagttttatggttacttttaaatatggtctttaaaactatttttacttgatgagcacttattgagggcatggatggtagaagttgagacaaaggaagaggaagatttaagttaatactttttaatgatcttacatctaagaaaggggatgaataaacatatgtgaaagacacaaggacagtttggaatgagtcaataaatctgtgaaaaagctgtgaacactttgctccatctgccaactttagggccttctagactagtgtttctcaaatattactgtgtatacaaatcacctagggaacactctttgattcagtaggtctgggtggagtcagagataatgtctgtctaagaaactcccaggtgagtctgatgatactggtccagagatcacacttcgagtaggaaggtgccacattgccacttaccaatagataacttgcaatgagggtctactacgtaatgcagtgctttctagttaagcaaaacatgttgaacacttttagctgattatatgggaacttgggtgataattgaagaatgtcatagaataattggctaaaaaattagtgtgatatgtgaagggtactcaagagtctgcagtagtctgagcaaaggattaacatggtcagaaagctgattcttgatacattgtggagggtggatagaggagaccagaagactggggtatgtccagctggaagactggtatggaagttcaggcaatgggagggtaaaggcctgaagtgtgatgatggcagtagaaatgggcaggaagccctggctttaagaaagattgattactacagaacaccaaaaaaatcagcacatgtaggatttcctcagcaatatagctcagaagtgactagcactctaatgtttgaaaaagaaatcacttccacatccatcatcttatttcatcaacacagaaactgtgggagattagtaattactttcacacccattttacaaatgaaagcagcaacttcaaccatttatgagaaaaagcgaacctaattgtaagagcaaaaacactgtggaaagggtcagaattattaatcttggtttttataaaattgactttttttcattaacagagtaatatattttgattataaaagtaatatatatttgagatcacactcctggtcatattgtctgtatccttccctccagttcttccacttaatttattatggttcttttcccttgtcattatgattgttttgaaaatttaattttaaattactgcataataataacccatgatatgaatgcattatagtttaatttattagctccatgtaattgcccatttaggttttcattttttgctattataaataacattgtagaaaacatctttgtatatacatcctcatttaaacatctgataatttacttaaaaacttaccaactctttaaaaagtcttcttatctatttacagccatctgatttaatgcttgataaaggatcatgtcagtctccagcttgaggtgattacctaagcatctcattgtcccagattatacagtgaactcccactgggctcccgggctcaggaagtaatgtcttggaaaattctcctgcattctagtgtcatcactgatcttgggtctcctcattctggtccatcagcaacaggtgtgactacccattggggtaaaacagtgaggggaaactaaataaatgcctagttcttgccttatcagctctttggggaaagagctgtgggattatgaaggaacaggtcaaatcaaaacactagtttatgtagcttgaaagtctatagagaggccggtgcggtggctcacacctgtaatcctagcactttgggaggccgaggcaggaggatcaattgagcccaggagtttgagacagcctgggcaatatagtaaaccccgtcactacgaaaaaattcaaaaattagccaggtgtggtggtgtgcacctgtagtctcagctgcttgggagcttggggtgggaggatggcttgagcccaggaggttgaggctgcagtgagccatgatcatgccactgcactccagtctgggtgacagagccagaccctgtctcaaaaaaaaataaaaaaaaagaaaaaaagtctttagagaatagcagatatgtaaatgatattgtggatgcttttgttttcttctttctgctaatttatatttttgtggtatctatatcaaagaggtaggaaggcagtgtagcatggatctggaggcagacagagttaaatggaaattctgtcatttattttccatgcgaccctgtgcaagttattcaccctcattcttcatctgtgaattgcagatagtgttatttatatgtagattttctgatgtgaatagatgatctaagccactaagcatttggtgctgtgtctggcacacagtaatgctcaatactaccttgtattattattattagatattgtctaaataaaaggttaaaatatacgtatatatatgtataaaatgtgtatatatgttatatttagaaataacacaataggtaggattttaacaaagcctagaaagccaattttgattggccctacttcaggaaagcagcttttctctggtactaggctgccaggggaaaggtgctgctgcccctcgccccagtgttgggggcctggtttcttagttacatagggctggctctgtttagcagccattgaattggaagactacaagatttggagccacagacatctggctcaaaggctggaagtgctctttcctagtcagttgcccctcagcaatttcagggaagcaactccctgtatctcagtttcctcacatgtcataacggcaatcatacttaagtcccaggattgttgtaaggagaattaaatgaaatgatgccagtatttggcttacggttgagtgcaaattcttttcttactggaatttcctcctggcttttgccataccacaccttccactgcttctctagctttggttaagcaccagttccctcatatgtcacacctgggtgagactttggctcttaacagtatccccttttacttgtcacccaagtcagatgttgggctcataacatgagtatgtaaaaatgtccttttcatcaggctattcagaattttacttcccagactctgtttcttcaacatcccccttacctgcccttgtgagcatgccatttctttctctttgcttgcctcagagtgccccacctcttggtcacttgggtgggcgttaagggctttccatatcgaagccaaacattctttccagcctgtaattcttaccccagtactcttcctggaagctggactgtctactggttaacccttcccccagacctccctctttgtattcatgcctaggattcttcgctcctgagtatgatctttgatccaaactgagcctgactctgacctcgcttgctgggtgctgattatttttgtacctctgatccattaggcatatgagctgtagtggaaagagccctttagataccattgactgtcctacccagagcccaatatcagccatttctaagaagctaggctgctagttaaggtagttgacactaacatggccctaaaaatattctgggcccaaactggtatctgctgtctaaactcagcattttggaggtcccaaccaagtatccagaaacttggaacagatccaaagcagcagcatcaggagggtgttggcaccacttgctcacaggcccttcatcaggagtactgggaagcaagtgaggaaaaacaaaaggattgttcacatggggagggtaattcaagacatgagtgtcaatttaaggaatgattatatgacaaaagtatattctggcaaaataatgtcagaaatatcagtttttgtgtttttaaagtttttttccttttatagtttgcatgtagaatccagtgctcataaatagtttgcctcctgataaattagcttgtttccttttatcagattaaggttctgaaacctatagtgtttgcctttgtgtcttggctgctgggaagctcagatcaaatttgaacattcgatgaacatatatgtaaacaaaaggtttcctttttaaataaaataacctcattttctgttttttttttttttctaaatctttcttttaattttatgaccctgtgacatcagaatttttttgtaaggtgcttcaaatctttttggatataaatggccacctggtgggtgaggattataatccttaatttttggccatcctgagaagtaagcaaaagtatttgagaaactccccagtctcccttgaacaggacaacatgccctttggggagaagtacctctgcaagcttagtttaagtgggatagagggaactgttcgtggtccttggcattttgcttttcaagagatgtattctcaagtcccaaggtgtttttttctgagattagatgtaggtggtttaagtgaaaaatagcacattttggacatgtcaacaagagtgttgttgttgcctaataccatactgagaccctagaaaggctggagtgtcttcttcagtgtgaactctgtaaccaatacatttgtacatctgatgaaagggaaccaggccctagcttcctttatcaactccaaaaatgtagccctaaagtcctcagtttgggaattcaaggggacaagtgatgttcatgtggatgccttagcaccttggagacctccaccgcaaaagtggcttattttgtaggctagcccttcttgcctgtattcaacctcaaaagagagatgacattgcctcagggaaaaggtgtcaccatcatcaggttaatttttccaaagcccatgtttgataatgtcatttttctgttcatcactcttctttggatctgccttcatgttcatctcctctgatctatctcaccgatggtaccctggtcattgcttttagctcaaacataattcatttgccaaaaagaaagtgcctttcataaagctgtgcaagaagcataggctttagtgtcagtcagacatagtttaaaccttggctttttcacactgaagcaatgggggacaaacctctgtgaacttgtttccttacctgtacaatgggtatttctctgatatgattattgttgagattagtatattaaggcatcatttataatttactggtcatatgctatttatagcatcattattatctcatgtattctctaagtcatgtactaaaattagcacataagacaaaaatcatgaatcgttgaaactcttcctggaaatcttttgtattgcagtacagtactgtatctgttgtgcatagaagtctatacagtaattctctaagtttgttaacctgtgagctgaactagagaaatgaacaaatgggaagtatttatgtaggtgtctgaatattcaaaccattctagctctaagatgacctcatggtgaataagggaacagtggagaattctagatgctttgtttgttgatttgtttcattttgatttcatattaggtaggcctcaaccttaagccatgttaataggtttgtggtcgtgaaaacttacattgtatgtaaagcacttagcctggtttctgtcactaccagtgaggatttaataaaatgttagttgttatttttcgtaatggtagtatgaatagtagtaatagtagtactcataagatatgtgacagcacctaacacagagcctggtacatagtcattgctcaataatgtttgctagatttggttaattggatctatatgtttactttccatattctttgtaagtgtagtaaagaagaatttggcaacctgttttctgtcttcccaagtttcctgctgtggccccttggtcattggtcacatttcaacttggagtttgttctcaagtaagcctctcaggtgaatgggcctgtgatgcactaaggatcagattgcacattatctgaaggcagggagtctgccttattcatctttgtatgcccacagttcctagcatatgataggtattcaatgaaggaatggatggatggatggaggaagaaaacgtttgaatcaaacaaagactgtctttgcatttgtgagatttaagggatgaaggttcaatttgagctattgctgattttggtcacctgggttttggcatcaggctctaatagtgctgcttccttgaaaccttgctctgagctagaaacagttatgctcttaatggggtctttctggcgtaagtaatcaaaagtataataactggctttgatacattgttttgagcacttcaagggagaaagggccctagaagaggaaggtggtagagcatcaaataagagaatgagatttggagtcaacagaaacctcagtttacatcctagttttgtcactttctagctgtgtgtccttgggaagtcccttaaactctctaagcttcagtgttttctcatctctaatatggggacagtattacatacctcataagtactgttatgagatcaaaatataagtgtacttaaaaccaaggtacatagtaactgctcagtaaatgttagctactattattgttgttaccacatgttttctctcctttccaaaatgaccgtagctttattgttttccacatcatcaaaagcaataatgtttgttgatttaatattaacttagaaaatacacagaagtttaaagaagaaaattaaaattagccacattcctacctcctagaggtaacaggcattgatatttaggtgtatgcatatctcacacttcattcttccatgtttatacacacacacacacacacacacacacacacataaaaaacaaggtcatattatatgtaatgttttctagcctatgtttttacaactaacaatacgttgcagaaatcttttcagatctacagaatcactttaatggtatcactgtattacactttatgactatataaatactacaggtattttcaccagtaccatattaattgacatttaatttgctcctaacattttgctaatataaacagtgcaacagtggccatttgtgtacgtacacctttgcacacttatctgattattttactaagagatatttatagaaaaagcagaattgttaggtcaaagggaattagtcacaccacataatggattaatctttattaaatggcataatgaatgggaggatgctgtgtaaactgtcaagtgctatgtaagtatgagttattgcattgcaactgttattgcaggaggcgtggcagaccaatgaccttatgggctagaagaaggcagaaggcttaatttctcccagatttccatgaatacacctagatgaacagatacacacaaatggatggttactgtttattctaatggatctacatttccactccctctcccaaactgccaaaatgaagaaaggttcttgcaatcttgaaattaaacaattgtttttaaacatggctgcttccagccaaatgttcagatctgttttttgccaaccacacagtttaggaaagcactcgaatagagaagcacaaggtctcccaagctgcttctgcctgagttgttctgctgcgctctagagaaccaagactgaaggcctggctactttctttgtgtgtgaagggagggtggggaaggcagatttggggagaaatacctttttactaagacaggggtggttggtcagttccagcttaaagataccttggtcacaccttcagtggaggcattcagctttctagtgagcctgacattccacagagttcaggccagtctagagagcctaactgacctacccactcctctggcttcctgtttttctagcagccagagtgcctcttgagcgtaactttattgtaagcattgttgagtagggggaagtgtgtgttgagaagtcttgaatctggatctcctcatctaacagcctgcattctctctgacttcaaaggctgggcattcatccaagaatgatgctcttggcctctgctagaaggtggggccaggtgtgggaatgcaaacagactgggggcctgtatgagggtggaaggcagcaggagactatgtgaccatggagaggagcagacgcctggtacttggccaggctccaccttacaaagggtgctccttgcaggaatgttttcaatgatgtctgtcagggagctagggctatttgaacctctaagtctgaattgggtgatgtttgccataagcagtaataagcatggaaataatttactctgggaccttgactgcattagtatgaaatcactggcatactgatggggcctattgatcctcaaactgtttcctgaattctctctgcaaatccattctttcctgtcccagcaaaccagttgtcactgctgactgtgtatgtatgctgctgccttgaaacacagtatgttggacttattcattcacctttctatccaggtcttcagctcactgagctgtgaaatttccccctcccaatctgtttacttttcttctgactttgtttgtaagcaaacctgtgtacataccttttcatgtgtttacatgtatttcttggaatgcatgctggctccccgaggctatttgtaagtctgtggctcttttatataaagggatgtatctcctctgagtgtacctagtcaggcacttcaattgagtgcagtgggggtagtccttggggcaggggagttgctgtgctggaagagtgattgacccttctcttggacaggaaggctttggtaagaccttaattgaattatgactctggagaacagggaagcttatccaccatcattgggaaaaagatggaagcttacactgactctggaagtaaacatcttctttttattccccccgagaacatgtggaatgaactcagatgactaatgcagtgtctagattcaaaagggcccttctgttcaggaaagtccagggcttgagatatgcaagtgggcttaagcagaggttttgaatggttcttatgttccccaccctaaccctagactctaagcccttcaagagtacgttgttatttttgcatttcctcactgggccttgtacaacacagacacttaataattggtgagtggattattaaggcagaagggtagactggttggcctactgagactattgatggccctacagactcccacagaactccacaggaaggaaggcttaagcccaggaggtcttgtttccagagcaggccttagacaaaggtcccgcccaaccctactcatgaagtaattggcagaatggctagaacaagtgaatgattgtgccataattagtttatgacctgagggcatgccagtttgtagccctgccagtctgctagctgccaccagcacagatatgcctcataaaagctcaagcaacaaagctgtggtcctattgggcctgcgacgcctaatgattcaggcctatgaactgagagaaactgagccagtgtgttaacatttcctgaactgaccttttctattttcattttatgcaaaagtaacctttatatttattacagctgttaattcttgctttaattgtaatgcttttctttttccctttctttcctttttttccttctttccttcctccctccctccttcccctttcttccctccctccctttcttcactccttcattcccttcctcctctccccttcctttcctctttttttcccctccttcctttcctctttgttttggagctgggagaatagttagaatagggcaagagggagcatctggcccattgtgtgacaataattgaaatcatttccttcggatctgctcaggaaatggctcagccaacatctccttcaagtctcaccctcctggcctgctgctggcatgattgttttccaaatattctcttctagtttcctgagagttcaagaaacccaaccttggtaatgagaaatctatcaacctgccaacctaattcctataaatgtatacaagactgttgatgccagacctcagcagatctggattctgaaactaggttttgcttctgaggttccatgagttcctctttcctttcctgcctatcaacctgcattatatttttactttagatgctcagcatatgtaatctttggacccattaaagttgaattaataatgtatacactatttgttgctgacaaaagcactaagcagctcacgttcataggtgggggaaaagatttacagattcctgaatacaggttttacatataagaaataaagcaatttacagaatgaccaaactcgaaggatggctcccatttagtgatttctttcagaactataaggattattgtttccaacatcatacaagcagacttaacgcccttagccccatccagggaatagacctaaggtgggaaattcttcactttttatatcttcttctcatcacagccaagttttcaaagcttaaatttcttctgagtgttttgttttgttggttgtgtggctcaaaatgaaggtatccttctcttttaacattgccagcaatcgctttacccacccagaatgttcttatttctatttattttgaaatgcttttaatgtgtccactgacttctttggtaggaatggtatccaagtctttcacaaaaaggctctaatatgtttatattagcctctatatctggggactactttgatttcatttttgaaggctaatcatgtatggccttaagtaaaacctccaacttagaaccaacattttgtttttaaaaagtaagtttgagattgagtccttgatgagaattatgactgtgtaattttcacatatttgtgagattcaagcacattattattatgaagcagtaataagctgtaatgaaccaaaaagacctcagttttaagaaatgtattttagttgacagtaggcatattaccatgactctaatagatgtatttgttattacttgtccccagatttctttttaatcacaacatggccaattctattcacagaacttataatttataaagtttaaggctatctttcttgatcaaaggtgtttccatgtttccatatgaaaatatttctattatggactagaggagttttgctcaatacatagcgttcatgaaaggcaaacagttttactaagagcctgtaattaaagcaaaaccattttttttagcaataccccacttatcctgaagctcagagaacagcctggactctggtaataagtttaaaaagaaaaaagaagcctttgagatttttcaaacagctgccagaaagcccatggtgcaggagaagaggccctcatgtcttgacctcagagagacccactggtccttaatttaatgggagcctgatatttcctcagttacagcagcaaattagaatttggggcggcaggatgggtgggtttgaggaggtagtttactctagaaatagacacagtgacagctaagtaacagacacccaggatggagaaatcataaaagcaaagacctggcaatgtggaataggcagatacccttacacatgaaaatataagattgtgtggtattgacatgccagattttgcttagccattctattattggagatttaagttattttaaaatttttactcttataaaaagtgatgctgtgaatggttctgcacaaattgcatttcttctgtttagagttattgctttctggtatcttaccaaatgtgtaataacgaggccaaaaggtatgagctgttttatagctgctgttacatgttgccagattgtactcccaaaagattaaactgcataagtgtgcctgttttcacagatccctgcagcactgaatgttatcatttttaacctttttgctagtttagtaggtatataagtatactatccatttgttttaattttatttaatgaggcttttcattttttagtgtcataatttgctgtttcctcgttcatcttctttcaccacttctcaagtaaaatctgggtaatgaccttatatatttttatccattctctatattttggatagtcagcttcatcatttatatttgtcacatatttttccaattttattgctttcatttttatgtatgctttatcatatttcactatgcaaaactattcctttttacatttatatattcaaatccatccatcctgtctctaatgtttctttcatttttcaatattcagaaatttaccactcctcaacagctgggacaaatatgtgattctgtcttccccactcccccagggtgtttttttcttttttgtgtttaatttttgggcccatctggaatttattcaagtgtatggtatgaggtatggatctaaagtaaaatctccatactgatatccaaatgtttcagcaattcaatttggcaaatatttcttgaactcctcctatgtctcctatgtgataagcattgtgttaagttccacaagaaagttttttttttaaatgaggcaaagttcatgctctttaagactgtgatcctgtgtgtgtgtgtgtctttctgtctcttgttcgccctctttctctgaagagggaaaaagtagtggtggcaggaataatgtaggtatttaaataattataacaaagcacaagggaaactatgataggtatcattaaaaaggttagaagcaagaagctgtgggaatttcaacaggtgagagacttgacccatttgagaccaggaaaagcgccaaggtggaggtgacatttaagggttcagatggttcagatggcagaaattcattcattaaaaaaatgtactgaatattctgacaggccttgtggtgggtcctaggggcagagatggacaaaacacaatcccttccgttaaggaactttcagactagcaagacagggtgatgacggtgaaggaaacataccaggtgaaggtagtagaaagggaaataaatgtggttggagaaagttacaaattggggaacagtggagattgagtctggaaagaaaggttagggctagtttaaagtagactttaaatgttaggaggcattggttctttcattgtttgggcctgcagaaagtttaagggtataacagtgccatgatcagcatagatttctcggccagttcatgtcatttggaaggctgttgtttatctgtttgccagacagtttacggaaatgtgaatgaggtagatgtgtgcaccatttgatatttgggatccttggcagtatcaattatactctttacagtgtctatcaatgtgtctgactgatctctataattggcaaagtttgtgatgtctttcatatattgtacctgcttcctttttagcaatccttcattctccctttcaagtagttagaatcacctgcctttgtgtaagttactaaggagatattttagagtgagtccaccaacatgactaaaatgaaatgtctggtacttgatggaataaagtttgggtatcttggatattcagttatgggaaaacaactcatttttactttctgctggaaaatgaggaggctatatgcatgagaccgaaaattaacttgaatgtagtcactcatatgagcatacacctaatgaatttgtgaaatattttctttcttgttgtgggcattgtgtttgttggtctatatacataaagcctacactacagaaattaaaccattggtaagcagaaccaactcatctgcaaatctaaaaatggattgtgatatggtctggctgtgtccccacccaaatctcatcttaaattgtagctcccataattgccatgtgtcatgggagggacctagtgggaggtagttgaatcatgggagctgatttttcctgtgctgttctcgtgacagtgaataagtctcatgaggatctgatggttttataaagggaagttcccttgcacatgctctattgcctgctgccatgtaagtcatgcctttgcttctccttcgccttctgccatgatcgtggggcctccccagccatgtggaattgtgagtccattaaacctttttttcttataaattacccagtctcatgtatttcttcatagcagtatgaaaatggactaatacaagttggtttccaaaagccaagaaaagcataataaaaggcttaaaaatcagtggtttaggagcaggacttccagaatggctgtgtgaggagctaaacatattctctccccattgaagcaaccacttaactggtgaaaattattgaaaacaactatttaaagtctctggaaattgacctcagggaattcagtatattgagatgaattaattcaagaaaatctactaggtctcaataagaataaaggaagtccagctagctgtcatcacctctccccaacccagctctttgtcgtggaagctatactttgggcaggtatagccaagaagatggggcatcctttatgccaagctcctagtcataagactacagtttcacctgaagagagacaggctgctctttttccccccactcgcagtgtctttttccccccactctcagcttcatgttttagaagctctattttgggttggcgtagtcaagaagactgaggttccttccccaccccagatcccacttgtagggtagaagttccataccaggaggtacagatcaaaaagatggggctaccatccccatcctccagctcctgcttatagggtgatatcacttaggtagaatcagactactaccatatcttcattccagtaaggaacgacaaaaattctgctcagggtgttaggaaagactggaagactggcaggtcagcagcgctgttgagggctgactttatttggaacagagaatggaaaaactcactcctaaaaggtgttttcaaaaacggtagagatctttatgttgaacaactagtaggaagctaatagttcatgtaactagaagcaacgaattaaatggcagaccagccagaagtttaacagacagaatcaaggggagagacagctaaaaagagtcctgttaagatcactgggggtcaggatggcatgcacatgtgctacactgcattgactcaaaagcaaccagaaagtgtacttgagagctactagtcactgcttgaacatggagccaatttataagtattccccaagccacacagaaatccatcatcaaagttctatatcattaaggcttaaggggcataagcacaattctgaccaatcactaggtaaatattaagttatactgacccaggagctactctgaggtaacaaagaaacaaaccaaggagaaaaaactgagcagtaacattggagatttcacagtgcagggaaattagacttcacaagattagtccaggcaaaccaccaaacagcaagccccatggtagtggtgggaaagctaatcagaatctagatttgttacagtatatcatctaaaatgcccagttctcaaacaattatgaaacatgcaaagaaacagaatagtgtgaccattgtacaaaaaaaagcaggcaatataaacaacgtgtgaggttgtaggggtagataatatatcagacagacacaaacacttcaaaataactattataagtatgttcaaagaactaaaggaaccagcctaaaatgagaaaataacaagtcaaagagataataaagagagaaattatagaagaaaaatcaaatgaaaattctggagttgtaaattacaacaatggaaaggaacaatttactggaggggctctgcagtaaataaggctggaagaagaaagaatgaatttgaagatagataattagagattatacactctgaagaacagaagaaaagaataaaggaaatgaacagagctccagaaatctgagacaccattaagtgcttcaacatacacatgataaaagtactgcaaggagaagagtataaatggggcaggaaaaaaatgaatgcataatagctgaaaatttccaaaacatgatgaaaaatgttaatctacatatggaaaatcctcaagaaattccaagaaggataaaggcataaagatatacacctaagtatattacagttaaaatgtcagaagccaaagacaaaaggaaaagtcataagagcagcaagaaaataaatgactcataatgtacaagtgaactccaaaaagatgaatagctgacttctcatcagaaagaaaatggagaccagaaggcaaagggatgacataatcaaagtgcttgaaggataaagatatcaaccaagaatcctgtatctggcaaaactacctttcagaactataggcaaaataaagacattctcagataaacaaagacggagataatttgtcgatgtcagacttcccttacaagaaatatcgaaggaagttattcaggctgaaaggaagtgatgtcacacagtaattcatatccacatgaaaaaaaactaagagtgctgataaatgtaattatgtagtaactataaaagacagcataattacatattcttatcttcccttaattgatttaaaaacaatagcacaaaacaatagcagtataattgaattgggggcctgtaacatatagagagatacttaacaatgacagcacagagtaggctgaagggaaggaagttgcagtggagcaagacaatgacatcaggtagtctctcaaatgcacaggaagaaataaagagtaccagaaatcataaataagaagctcaacataaaactttataagtatagttttatttcttttttgttccttcaaacagcataagattatttaaagcaacaattataacactgcactgttgagtttgtactgtatatagacaaaatatatatgaaaataaaaacacaaaggaagaaggaggaaatggagctatagtagagcaaatttgtaaatatcttactgtaattaagttagtataaaactgaagtagaatataagatgtatattgtaattcctagagcaataaataagaatataactttaaaaatagagtttaaacaactccattaaaaaggaggcaaaggacatgagcagatacttttgaaaagaagacatacatgtgggccaggcgcagtggctcacgcttgtaatcccagcactttgggaggccaaggcaggtggattatctgaggtcaggagttcgagactagcctggccaacatggtgaaaccccgtctctactaaaaatacaaaaaagccaggcgtggtggtgcaggcctgtagtcctagctactcgggaggttgaggcaggagaatcgcttgaacccaggaggtgaaggttgcagtaagccgaggtcatgccactgcactccagcttgggtgacagagcgagactccgtctcaaaaaaaaagaagatatacatgtggccaacaagcaagcagatgaatgaaaagctcaatatcactgagcattagaaaaatgcaaatcaaaaccacaatgagataccatcttaaccagtcagaatggctattattaaaaagtaaaaaaataacagatactggaaaggttgtagagaaaaggggacacctatacactgttggtgggagtgtgaattagtatcatagcttttgaggaaacatagatggagctggaggctattatccttaggaaactaacgcaggaacagaaaaccaaatactgcatgttctcacttgtaagtgggaggtgaatgatgggaactcatgaacacaagggaacaacagatactggggtctgcttgaggatggagggtgagaggagggaaagaaaaagaaaaaataactattgggtactaggcttaatacctgagtaatgaaataatctgtataacaaacccccatggcatgagtttacctatataacaaaccttcacatgtatccctgaacctaaaataaaagttaaaaaaatagggtttaaaatttaataaagaaattaaaatgctacattggaaaatacctatttcatacaaaacaaggcggtaaagaagggacagaaaatattttgtaaaatacgacatatggaaaactaatagcaaatggcagatattaattcaactgtattaataataatgtgaatgtgaatggagtaaataacctgataaaaagaaagaaattctcagactggataaaaaaactgaggtctaactgtatgctgtcaaaaagagatgtaccttcaattcaaagatacaaataggttaaaactaaaataacagagaaagatataccatgtaaactgcaaccatcggacagctggagtagctgttagtgttatcacacaaaatacgtattaaaacaaaaaaaaatgttgtcaggtgtgcttgttcatgtctgtaatcccagctacttggaaggctgaggcaggaggattgcttgaggccaggagttcaagaccggtctgagcaatatagtaagatcccatccctaaagaaagatagaaaattagctagacatggtgatgggtacctgtagtcccagctacttgtgaggctgatgtaggaggattgcttgggcccaggagtttgaggctgcagtgagctatgattgtaccactacactccatgcactctagcctgggtgacagagacctgtctcttaaaaaaaaaaaaaaaaagttactagagataaaaaataaatattttataatgataaaagggtcaattaatcaggaaaatataacaaacatattaaatatttatatacttaacaacaggtcccaaaaatacatgaagcaaaaattaacagaattgaagataaaatagacaattcaacaataatagttggagatttcaatactcattttcaataatggataaaatgattagaagatcaacaagaaaatagaggacttgaacaacacaataatttaaatagacctaacagatatttgcagaccactccacccaaccacagaagaatatacattcttctcaagtgtatgtggaacaatctccaggatagacccatatgctaggccataaaacaagtctcaacaaacttaaaagaatagaaatcatatgcagtaaatttgcagatcacaatataattaaattagaagtcaacaacagatggaaatttgggaaattcacaaatatgtgggaattaaacaatatactcctaaataaccagtgggtcaaagaataaatcactgaagaaataagaaaataagattaatgaaaatgaaaacacaacacatcaaaacttacagactgcaggaaaaatagtagtcacagggaaatttgaagctgtaaatgcctatattaaaaagaagaaaaaatgtaaaaccaatgacctaatctgccttaagaaactaggagattcagaaggaattttgcaatgtaaatgcaaaaccagtggaaggaaaccaataatatgataattactagagttgaaataaatgaaatagcagaaaaacagcatagaaaatcgatgagaccaaaagttggttgtctgaaaatatcaacaaaattgatcgtttgctagcactgccataacaaattaccacagacttggtggcttaaataacagaaatcaattttctcacatttctggagactgaaagtataagatcaaggtgtcagtaagtttggtttctcctgaggcctctctttttggattgcaggtggctcaccttttcaatatgttttcacctggtctttcctttctgcatgtgcatgtgtctagtgtctcaatatgtgtcgtaattttctgttcttataaagatacctttcaaattggagtagagcccactttaacagcctcattttaacgtaactatctctttaaaggatttatctccaaattcattcatgttctgagatactgttgagttagggcttcaacctacgaagtttggatggacagttcatcccataacaatcaacaaaatatattgacaaagagaagactcaaattacagatttcaagaattgaggagggaacatcacttcagaacttacagaaaaattaattaaaaagtataaaggagcactccaaacaactgtatgcaaacaaattagataacttagataaaatggatacattcctggaaaatgcaaattatgaaaactgctcaagaaataatagaaaacctgaacagacaagtatgaagattgaattagtagtttaaaaatcttcccataaagaaaagcccaggtccaaagagttttactaataaattctaccaaacattaaaagaagagttaataccaatacttcacaaactctcccagaaaatagaggaaataagcgtcaactcattctacaagaaaagaaaactatagaccagtattccttatgaaaatagatgcaaaaatctagaacaaaatacttgcaaactgaatctaacaatatgtaaaaataattatacgccatgaccaagtggaatttaccttaggaatgcaaggctgttttaacatgcaaaaaatcaatgaatgtaaacattgcattagtagaataaagtacaaaaacaacatgataaactgcatacatgcagaagaataatttgacacaatccatcaccttttcatgacaaaaaccctcaacaagttaggaatagaagggaatttccttaagctgataaagggcatatacaaaaaccttacaggtagcatcatacttaatagagaaagactgaattcttttgctttaagatgggaacaagacaaatatgtctacacttaccagttttattcaacattgcattacagattctatccaaggcaattagacaaaaaaagctaatttgtctttattcatagataatattatattttatacagtaaaacataatttttcatcatgtctgtaggatatgacatcaacataaaaaatcaattctatgtctttatagtaataatctgaaaatgaaattaagaaaacattttcattcacaatagcatcaaaaaatggaataattaagaatacatttgacaaaaaagtattttgtacactgaaaactataagacaccagtgaaagaaaagaaagacttaaataagtagaaagatatcccatgtttgtgaattagaagatataatattattaaaatggctgtacttcccagatggatctacaaattcaatacaatccctagaaaaatctcagatgactttttttttttttttgagatggagtcttgctctgtcacccaggctggagtgcagtggcgtgaccttggctcactgcaacctccacctcccgggttcaagcgattctcttgcctcagcctcccgagtagctgggactgcaggactgtgccaccacgcctggctaatttttgtatttttagtagagactgggtttcaccatgttggccaggctgatctcgatatcctgacctcaagtgatccacccaccttggcctcccaaagtgctgggattacaggcatgagccactgcacctggcctcagatgagatgacttttttgtttcagaaaattacaagctgattctaaaatacacagagaaatgcaagaaacccagagtagccaaaacagtctttaaaaagatcaaacttggaggacctacagtggccaatttcaaaatttatgacaaggccacaatagtcaagtcagtgtgctactggcttaaggaaagacatatagataatggcaatcagttgagatcccagaaataagcctttacatgtgtgatcaactgattttgggcaaacttgccaagaaaattcaaagggaaagaaatagttttttcaacaattggtgttcaggcggtagaatattcacatgcaaaataatgaatttgatctttgacttcacaccatacacaccaattaactcaaaagtgtaccatatacctaagtataagagcttaaactataaaactcttagaagaaaacataggagtaaatctctgtgatcttgagttacacaaagatttctaagatacaacaacaaaaccacaagtcataaaaacatgataagctggatgtaagctggacttaaaatttaaaaccttcacactttaaagataccatccagaaagtgaaataacacctcaaagactgagagactatacctataaatcatatatcatacaaagtctttagattcagaaaatataaagcctcttacaactcagtaataagacagattatacattaaaaagcaggataagaatttgaatagacatttatccaaagaatatatataaatggcaaataaacatgtgaacagatactcaacatcattagtcattaggaaaatgaaaatcaaaaccatgatgagattacatttctcatccactggaatggctatctattagacaaaaataagtgttgtcaaggatgtggcatatcagaacactctcatacattgctgatacgaatgcaaaatggtgtagttctttggaaaacagtttagcagtttctaaaaatgttaaacatagagctatcgtatgactcagaactttcactcataggtgtatacacaagataaatgaaaacatatgtctgcacaaaaagttgtacctgaatgttcatatcatagcatcatgactcacacaagccaaaaggcagaaacaccccaaacatcctcaacttctgagtggataaataatatgtggtataatcatacaatagaatattgttcggcagtgaaaagaaatgaagcagtattatatgctactatatgaatgaacctcaaaaacatgctcagtggaagaagacacataaggccacatattgtatgattccatttattgtatatgaaatgttcaaaaaagacaaatctttggaggcagaaagtgattagtggttgcttggggctgggtgttaggaatggggactgaatataaattgcacaaggtttctgtttaggataatggacatattctaaaattagattgtggtgatggttgcacagctctgtaaatgctaaaattcattatattttatgctttagatgggtgaattttatcatatgtaaattatatatttaagttgttaaagtgcagtggtttaagaagataaaaattttgataattttataaagaacatctccaccaaaacattataaaattccttcccagataaagtatagctcatgaatttctatttctatttcaggaccttgttccatttgtcagtttcccccatgtacctctcctgtaccctactaccatggacctatttctctggattctgtgttccaactttcccttgccttgagcctgttcacccttccagaactttctcattcagcattctggcttgtgcgttcacctctatcctaaagttcttttctcctgagtctcatttcattttttcaaaccactgcttctatttcattgatgaaaagtggcaaataatttatcctgggcttgtttatgtatttgacagatgtttactgagcacctactgtgaacttggccctgtgatgatacttgtcgtgtcttatgttgctggtttttatattcagggggcaataagtatgtttaatgtgccacatgaaagattctgtagagaaggaccgagtagctatatttcatggcaatttttgcccagtctgtagaagggtctctgtttcaaaatgacaagtgtgtaattgccttatctttgtccctgagttgtccatgtgtcttgcggtttaagctagtggagtgctggcaaaccagctctccagaaaaacagtaaataagtaaaacctaatttgtagcacttgtggtttctatagcggatatactcccaccatggccagtttcaagttgctaaaatgatattactgaatacttcactggaaagctagccagtgtgagccctccactaagaggcaattgcttagtcctaatccatacaagaatagctttcatgctgtttctaaaataccacccaacttggaaggaatgtgggaagaaaactaatgcttctggaatactaactgtgccaggcactgtgcctgttagatattcattcccataatcctgtgaggaagatagccttttcacaggacagcagatgaaggaatggagagttaaaatgatctgcctgaagtcacagtgcactgcagagctaggatttgaatcctggtcattttggtgccaaagcccatgctactttcattgcaccatgatacctcctgggacaaaactggtagtggagacagtgagataatgtacttttctggtggtagtgctgtggatattgtttgcttcctgagggtttggcacgtcacttgtagcccatttgacatactagaggatagtgggttaatctctttgtggcaggtaagagatcagtgaagactgatgcatggtatgtggagggagcctacaaaccttttgattgatttgagcctaaggaggggactgcattgattggctagtaattcttgactattctggggagtggcagagatgctggaacaacacataccttacaggctttaggtgagacctagaatgaccatttgagaggtcagtgctgtctatggagaaagtggtttctgaatcaagttccgaatataaatgattggagcgagcttttgaaaacaaatctatgacttatttttaccagaaagaaaagtctataagggcaggaatctttgcctgttttgtttattgttatattcccattgtctatagaacagtgcttgagactcaataaattaagtgttgaatgattggatagatgaataaatgggagaatgaattctttgcctccagttctgtagctccttcctaagcctggctactgcttaaaaccaagcatcatctcagagatccatgaggaaccaacactgaggcttctcacatttttctcagctaaggatctcattagcagttatgtaaagaaaaatgatgttacctggatggtaagatgtataacatttctttgggaagcgcttttcactatctttgggcagaatacctgtcaattgttgagtttttactaagtgccaggtacagagtacagagataagcgttatgtatgcattagcccattaaatccttatgaaattaataacgttatgaaatagacaattagccccatttggcctggagagcttaagtaggtttcccaaagctgcacagctagcttttcttgggagcatctcaaataccgaaagcaaaaggaaaaactttaggagttaggtatgacaaaattcataaacataaaacaatataacaatacgtatatgcccttttaaattttcaagtaatcacattaaaaaggtaaaaagaaacaagggagacaaatgttaataacatattttagttaactactcaatatatctaaaatattaacatttcaacatggaatcagtataaaagttactaatgagatattttgtgttcttttttaatattaagtctttgaaatctggtgtgatattaaacttgacaagtgtgtgtcaatttacaccagtcacatttaagtgctcattagtcacacgtggctagtggatggctactgtactggacagctcagtgctaggccttgctcccaggtatactgaaatgtattagaaacctttctgtgaagtgatgaggaaaggcacataaactgcagtgagcccaataacaatttgttttgcagaaagctgttctttaaattattacccatataggttacaaattatgagattaaaacccgatgtaacattaacagtccttcaagctccttcagagtctcctccactggatttgggagagtaactctcttaaagcaggacatcattttgattctgcaaatattctccaaggcaaggaggttacatatctctgcagagtgtctgtgaactgaggcctgaagcaatttaaggtagggacttcagggtcatcaaagaagaagcacatgccactcaagtcctttacgtaatctagaggaaagaccaacaaagaactagctaatagtctgggaattatttctcgtttccctgttctctgcccttcttcaccatgcagtctattctcccaagacactccatctctcagaggttcccaatctctctctatagtctaggggatgtataactatataagtgagggtatgtgaccctatgtgagattaggtgtgtgctgtcatgggtcagctatgtaaagtatggagagtgagttggcagccccaaaagcatagctatgaataatcaagtaaaaagattctccccatttcatgtcctctcagaagaaggagacataaattaatggggcctgtaggcactgagctgacctgacaatttccatcacagagtttccctgtagttgcaggggctgtctggcataaatgaggattccaacctggaatttgatttttctcctttagagcacaatatttgaaatccatttactcacataaagggcttttaaagttgtcttaggctttaggtagacttccttgattagagacttagaaatatgtttcaaagagggtccttgtagaaggtaagtttctttttttaaccttttagggtggaaaggaaaagagagatggtagagtagtatttttcatgaagaacccctcagcccttaagctgtatcaggcataccctcagtctgactgtaatggcaatctgactaatggaattaatcatctgaaaagtaaggcaggtggccatctcaaattgtgttgtctgctttccccagagatatgtgactctaagctagtgtatcaaaaaagaagaaaataggcacattccttaagattaagatgtgggtgaaacttaacctgtcttctctgtcagaataggaagtgcttatggaccaaatttgccagaggacttagtcttctgttgaagaaccatgtgcagtcaggaatgactaaacctggctttaaagctggagggagatcaggacagggaatccctataatattgggcacaaaaagcatggactaaaatgttttttctctgtgtttagtcaagatttggtgaacacctgatcagaaaatcctgtattgtattatcagatgcagatatggtacagaggaaaggggaaagtaactttcatttacagaaatgtgccaggcacgttacatattcttagggccatcctgtaggtcaagatagcatcttacccactttatagatgaggggactaaaactcacagaacttatgtgacttacatagctagctcgggagtggggttcaaacttggaaatgtcttactccaaagtgtattcttcccactgccctatactactgtcttagatcttactgtttagctagaaacacatgacttgtactctcaagtaacaaagaaataactgtattaattataattaaacactgctaatatgaagtcaggacagaatgtattttgcatgatcaggaacagttctaaggtcagagcagatcttgtatttccctgatggtgttggtcagtgtcatgatggatagtaagaaatgtagacaaggagctgtcaacaacacagccccatgttgcaaaataccattattatagaaaccttccccacaaaggacgaaatatctgacagtgagccccagatcttcctgacgtacagaatgtcattagctccttagctaatatttttttgccctagtgatagagaaacaccattttgacaaggctatgtctgagttctactggtaggtgaagaaatactagttctctgttgttcccccaggagctatagctgaggattcaatgccttgatagttctggaagataaagcttccattgttttgttgttttattgtcacatcaccctaggagcaataatttcacagttgaccaaagtggtagtatcacatgggttcatctacattgtggactctctttggcatagactccatgagttcgattagagtggtaggattctatcattgtttcatagctcttgacaaaactaactgtcctaacaaaaaagaataaagataggtgtaagttaatactgcttttaaaaatgcattttctatatgtatgtctttatgaaaccttgagttaaagatggtgaaggcaagccttgtaatttcatcccatttttactgagcaagacaaactcctattgttgaatatggagtgacatattaagtgatacgttaatgttttgtcaaatcttaatggccagcatcttctagtggcccattttaggacaaccttaatcaagctatggttagagaacttttattaaatgcccagcactgtactactttctagcatttcccactctgatcgtttgcttgaggatgatgaaggatgataaatattataaataagattgcttcccatataggtcttaaaatcagctgaggtcaatgcagatctactgctagaaatgatttggaattttggctgcttcaggagaagcatagcagcagaaacaggagatcattgaacattttaagaaggaggctacccgcaaattcagaagttcatccctttaggaagggtctgtcataatagtaggaagggaccaggcacagtggctcacgcctgtaatcccagcactttgggaggccgaggcgagtggatcacctgaggtcaggagttcgagagcagcccggccaacatggtgaaaccccatctctactaaaaatacaaaaattagccaggtgtggtggcagtcgcctgtaatcccagctactcgggggaggctgaggcatgagaatcacttgaacccaggcggcgaaggttgcagtgagctgagattgcgccacagcactccagcctgggcaacagagtgagactccgtatcaaaaaaataataggagtaaggattcctgactgaagccctttggacacttcctgctggaaacgcatgggcctttagtaactgatgttggccaggtgagctggcacatatggcattcttttgtggtctcaggatttcatggtaagaagatctgggcatagcttatagcaaagacctctatatcaatcattccattcctagaagtgccacctggaagaggccaagataatgagatgtctgtcctcttgtgttggtggctatggtcaagttgaggtcctcaagaagcttccctgttgtccaattccagttcactgtggctttggtaaccctcaagagagagatagtagatggaggtcttctaaaaaccagatttctagtggcaagcgcacagcccagtctgcggtcatcagtggaagccagttcagggtatcagcagttggtaagcttgctgaacatgccattttagagagaatctctccatagcaagaatatgaagaaattgattcaccactttctcatacatcttatgccctagccaacccatacctgacaaactatctttcttaaatatcccaagatcttccctacctctttttctttgcacatgttgtaccctttgctagaatgtacccttcctctttctacatggtgaactctcatctattttttaaggtctagctcaaatgatatattctctgtataacctttccttcattccatccctactacttctgtggttctacagcctgttgtatagatctctatcctcccattgctctatacagggagtaaattatctatgaagatatctctctactactaaactgtgacccttttaaaggtggtaattgtttctaacttctctctgttatctccattagtcagaacaaagcccggcatataataagatgaaccagggaaatgctgatgagtgagtgactgacttatttattctgatatggctagggttagattctttagattccatcatcattaggctttatttggtatcatattttataagtgtgtatttcagtggcctcttctctttttatttgtattgttttttgacacaggatctcactgtggcacccacgctgaagtgcaatggtgtgatcacggctcactgcagcctccatctcctgggctcaagcaatcctcccacctcagcctccccagtagttgggactacaggtgtgcaccaccatactcagctatttttttggattttttgtagaggtggggtttcaccatgttgcccgggctggtcttgaactgcagagctcaagcaatccaccagccttggcctcccaaagtgctgggattacaggtgtgagccactgggcccagcatctttaatgaaatggctaaactttttgactatgtttatttgtttctttgaataaaaggtacatttgtagtctttaattggtccaatatacagattccagtggaacagcaatggctccctcttgtgaggcagtctcagaatttctcctataatttctttggagatgtgtggataaggtcctcttaggagagttaattctaatggtctgaatactttggctcctaagtatgggggaccaactagttctttcttggaaagttttaagaacatcacttgacaagagtaaagaagccatcccgggagtcttaatcagcacaaaatctgaacttcctggagttggaagggttcctggaggtcatctttacaactgaatctcacacagcaactcatgtcagttttgagttgctctctctctcttagagttttatgttttttagtagattattccttttaagaaactaaaatctccctccagctgatctaggtcctagcctttggaaccacacaaaacagtatgtaccttcttgataactaattgccctttaggtagttaaaagacaatgttaggtttctcatgatattttctacattcagtttttccaacatgtatgaacacctccctagtgccaggcatcctggtctaatcttctccaagtctctcaactgttccccatatgtcagttttccaatcctctgaaccacttcttgtagatcatttccaccttgtcactggctctgaagtttataatttttacatgttatctttgttaaatgttttccattgttccagccagcctcgatctttcaggatactatcatatatgggacctactctatcctaggagagtctcctctttcagttcatcagtataagcttccagttttgacactttagaataaagcagtacttttcaggcaacagcatggaatagttgaactagatggcaccagatctgcgttcaattcatttaacctctttgaggctaaaatggtgctaataatccttcctttatagggtaatacccatgattcatgagatactgtctgtaaagcattaagcactgtatctgagcacttagtgggtacaccacagaaattaatgttccccccttctcctcctgccagtcttgccctgcccaccactgccctctactgaggagagtcagtaactgctttaaacttgaattctttcttgtttgagccaagtagccctattccatttaatctctttgtagccttttaatgaatgacaaacctgcatgagatgcagcacaaactggaagatggcatactggcctcaattttgtaagatagcccttgtaaaaatattgcagtaagcatcttcgccaatttctgacacagcataactgagttagagttctacattccatggatagctatttgtcagaacttttttttaatattacaagattccaaggtgctaaacacagatgcttggaatgtaatccagcatttgtggttcgctgtcatgtaaacagtcaaagtcacagcctgattctgaattcattcatgggttttctggatatttcccatgctctttttgaagaggggcatttatgtgaattagcacttttaattcgtctgacagagtgatataggcttgtataaaagcaataaaaatacagggtcccaggtggcatttattgccacacagatgaaaagccatatagttggaattctcctcttatgagaggcttttgggatgtggagggaaatccctaagcttagcaatctgacattatagtacagtggatagagggtaacctaagtgtcagatctgagtttcagtttctcctgtgctagtcactatgaatatgatctgggacaagtcctttcacctccttttacctcagctttcccttgtgtacaatgggaaaaaattgtaccaactttgtggattggttgtattataaatgagattaacaattctataccacctagcccagtgcttgatatatggtaggcaagcaataaatcattgctcttaggatcagttctagttgataacagctaagcctgctggagttgccatatcattttcctcttgaagagtgaaagaagtaatagcatgtgtatagtttggggattcaattcctgggtctctgtagaaactggaccaccctgagtccctcagactgtgctgggagtttataatcattcatgtgaaggacaatgggaaaacattgggttgcttaatagcccttgctggtacctaagcaaagacagtgagaagaaccctggtgacttctcaacccttctccactgtaagggaagaatcctaaggcttttcttacactgtagcctataactccttaaatgcaaggacttgaatttaccaactcaaacaggagtgaaatgctgttgccttttttggaggtctggaaacatatacttgggaatctggtgagctggttactaaaactccctttgcagagatggcggtggctggattctttgttttctcttgagtaattttgacctagaggcaaaaagaaaatctctaaaaatgttctgctcataagaaaagagcaattgggctgagggtggtcccctggtaaaagagaaacttcaccaccaatcagctttgtaaattaaaaacaggtgcaaaaactaatctatagtgacagaagctaattaatggttaccagagggagggggacagagaaaactgggtggcaatacaaagggcacaagaaatcttttgggattaatgggtaagttcaccatcttgattatagtaatagaaggtacatatgtcaaagataatcaaattgtatactttaaatatgtgcagtttaatgtatatcaactatacattaataaatctgttaattcaaacaaatccagtgtatataacacctagtacatagtaggtgtgtgctaaacatgtgttgaattaacaattgtgacagaccaacttctagtgtgaagagctcaacaaaccctctcaccagtaaaacaaccattaaaatggtagaagatgatgtaaaacaaccattcaaagtatctggaaactggctcaaggtcatgcaacaaattgagaatcacttatttaagaaaaatctatggaaccttggtaagaacaattggcatttgagcaaggaactgcttccattcctcctcccaactttatgttgcagaagatttattccaggtgagtacaaccgagaaaacagggggtctctttcttaccagctgttgattatagagctatagtttcattccagaatgatcaggctgctagtgactctcattcttccatctccagttctctgttgtacaagatttattcttggccacaaaaaacaagaagattgggggttcccattccgtgctcagttcccactcttaagatgaaggcactaccctagacagttgcagcaaactgtgaatggcagttggagaagaccagggctcctatttccccactcccaagtcgagggcccagttttttttttgtttttttgtttttgtcagacaaggacttcagggggctcatagagcagagatgtcactgtagaagaagcaggctgccatatcattctctcctcatccagctccaaatagtaacatagcctatggggactgactgactttagaacagagcatgaaggaattcatgcctaaagttattgttgaaaacagcagagattatagtagtgaatattagagaattacatattagtagcagctagaagaaaaaagaccagccagacatttcagagagagacctgtggaaagagtttaaaaatgccctgctaagatcacatttgtctattggtctggaaggctgtacacacacactaggctaaacctgtgtgggagctaccagagatatgatatttatgagctgctaaaccctatttgaatgcaggataaaattaaagacttcctgaagtatgaaagcattccccaatccatacaaagatacattggcaaaagatagaagctttactggatctaggaacttaagaaaaacctgtgaccttttgatataagatgactcctagaaagccagacttaaaagtaaaacaagaagagaaatgaacatgacatcagagactgtacactacagatgaaatagacttcagagagaattagtccaggcaagacactgaagagaaatagagaaaaagcagaaacaaaaacaaagcccaggttatgggggtgggataggtaaacagaattcagagttactacaatacattatttaaaatgtcaaattttcaacaaaaattatgagcattgccaaaaaataagttaagtgtgaccatggacaggaaataggcaatataaatcacctttgagggagctcagatgttgtacgtgacagacaaggactttaaagcagctattataaatatatccaaaaaactaaagaaaactgtgttttatgaactaaaggaaagtgtgatgataacaactcatcaaataaagaatatcaatgaagtgatagaacttattttttaaaaagaaccacatgcaaattctggacttgaaaataaaataagcaaaacaaaaattcttaaggccaacaatattttatatcatggcagaagaggcagaagagagattactgaagcagaagacagattaatagagaaagaaaaacagaaggaagaaaaatgaacagagcttcatatatgtgtgggaaacaaacatatcaacatatatgtaatgagagtaccagaaggggagaagagaaaaaggcagaaatgtagtcacagaaattatggcttaaaatccccaaatatgatgaaagacattaatctaaacatcaaagaagatcagtgagctccaagtaagataaactcaaacagatccatacctagacatatcatagtcaaaatgctgaaattcaaagccaaagggaaaatcctgaaagcagccagaggaaaatgacttatcacatacaaaggaatcacagtaatttcaacagctgacttctcatcagaaaaagtgggtaacaggagacaaggggaggacatactcgaagtcgtaaagaaaaaaaatcaaccaatatgtctgtatctggaaaaactaatcgtcaaaaatgtaggcgaaataaagatgtttccagataaacaaagattaggagaatgtgttgctagcacctgccttatgagaaaaacggaaagaaatatttcaggcagtctgggggcagtaactcgtgcctgtaatcccagcactttgggaggccaaggcaagaagatcgcttgagcccaggagttccagaccagcctgggcaacatagtgggccccatctctacaaaaaattttaaaattagcggggtgtagtggcacgtgcctatagtctgagctactcaggaagctgaggtggggtgtgggggtcgcttgagcccgggttaaggctgcagtgagccatgatcacaccactgcactctagcctgggtgatagagtgaggccctgtctcaaaaacataaataaataaaaagaaatccttcaagctgaaagaaagtgacaacagacaataatttgaatccataaagagccctggtaaaggtaattgtgtagtgattaagacagtgtaattacatattccttctccctcttctcttagttgatttgaaaaacaaaaccatactgaagcagcagtgaacacaactagtgcccagaacttggattctaataccatttttcaatgaaaggaaccagggatccttgaaaaaatggctggttctaggactggatcaggaactacatgagtctggagaatctcgtagtgccaggaagtaaggaagtactaaagtgcacacacacacacacacacacacacacactactgaatgggttatgtcaaaaggacactggagtcaattgaaagaggtcccaatggccaaagctggaacaacttgagaaaaaaagtaaatcaataaagtactaatagattataatccaagatatttattttatgtccatgagtccatatgggttaaataaataaatggggagaaccatacaaacattttatgcagaagaattccaaatgatttatgttactactctgtcctcaaggacatagagcataacttctcactgtttaagtggggcctgtgcatagtgacttccttgaaagaatacagtatggaaaggaaaaaattgtaatttaagtgaagaaagctggcaaacactaccttagccagaaaaccaaggttaacatcaatgagataagtcatgttggtagtgtgttccttgatatgctgtgatgaaaatggtatttcacttctgtgattgcccccccccccgaaaaattcataaccccactccaattatgaagaaaccagcagagaaatactaatcgaggattattctacaaaatacctgaccagtactactggaaactgacatggtcatcaaaaacaaggaaagtcaaaaactgtcactgcaaagaagagcctaaagagatatgccaactaaatgtaatgtcatatgctggttgggatcctggaaccaaagaaaaagaacatgaggaaaaaactaaggaaaattgaatgaagtatggagtttggttaatgatataagtgtatcggtattagttaattattacaaatgtaccatactaatataagttgttaataacatatagggcattgtgtgtgaggtggatggtaaatctctatagtatcttagaaatttgtcttaaatctaaaactatttgaaaatataagcatatatttaaaaagcaacagcataaaacagtataatattgacaataatagcacaaagcaggggggaagtgaaaggaggtataatagagtaaggaaatgaaaccagagagtaatttcatacacaaaaagaatattagaagtggcaaataagattgtttataattacatacatttttcttaaaaattataatatgtatttttctcccatcttttagctttttctaaagacactagattagaaagcaaccattataaaactatattagcatataaaatatgtttataacatataaataggattgaaagtttggtttaacacttaaaaattaataaatgtaacacattaatggaataaaaggcaaaaacatgatcatttcactagatgaagtaatataaaaaacctgggaaacactcaggtaacaacctacaacaaattagggagataagaaaatttctttgacgtgataaagagcatctattaaaatcccacagctagcatcctaccaaaaatgttatacaaatgaccaaaagcacatgaaaaggtgctcaatatcattagtcattagggaaatgcaagtcgaaaccacagtgagatactatttcacactctaagaatgcccttaatttttatttatttttaaattaatatttttaatgacaaatcataattgtatacacttatgggatataatgtgatgttttcatatatgtggaatgattaaataaaacaaattaacatatatatcacctcatttacctattatttttatcatgagatatttgaaatttactcttagttattttgaaatatataatatgattattgactctagtcaccctgctgtgcatagctctcaaaacttacttctatcttaaactttgtattatttgttggacaacaccccattgcccctttccccgctcttcccttccccttctcagcctctagtaaccaccattctactctctatttctatgaattcaagtttttagattccacatataagtgagagccggtattataaagtgattataatcaaaacagcatggtactggcataaaaacagacacatggaccaactgtagggacataaagcccagaaatacacccatacatttacaatcaattgattttcaacaaaggcatcaaggacatacaatgaagaaaggacagtttcttcaataaatgatgttgggaaaactggttgtccacatacagaagaatgaaattggatacttatgtcccaccatctacagaaatcaactcaaaatagattaaagacttaaatataagacctgaaaccataaaatatagggggaaagctgtacaacactggtctgggtaacacttttttggatatgaccccaaaagagcagacaatagaagtaaaaagtgtatttaattttgtatatttgcatgttttcaaatggctttgttattttctcatttaatttcattgttgatatcacacatttctataatttcaattgttttacattttttgagactattttataccctaacatatggcctatcttagtgatgttccatgtgtgctttggaggaatgtattctacagttctaggctaaggtgctctatacatgtctgtcaggtctgattggtataagtcaagactgttgttcaagtaacctacatctttgttagttttctgcctggttattctgtcttttattgaaagtggagcattagagtcccctgctatcattgttgagttgcctatacttccttttaattttgtcagtttttgcttcatatcttttgtggctttttgtttggatgttcatgtaattgttttatcttcccaattgattgacccttttatcattataaaatatgcttatttatctctcataacagtttttttaaattatactttaagttctagggtacatgtgcacaacgtgcaggtttgttacatatgtacacatgtgccatgttggtgtgctgcacccattaactcatttagcattaggtatatctcctaatgctatccctcccctctcccccgaccccacaacagtccccagtgtgtgatgttccccttcctgtgtccatgtgttctcattgttcaattcccacctatgagtgagaacatgcggtgtttggttttttgtccttgcgatagtttgctgagaatgaaggtttccagcttcatccatgtccctacaaaggacatgaactcatcattttttatggctgcatagtattccatggtgtatatgtgccacattttcttaatccagtctatcattgttggacatttggcttggttccaagtctttgctattgtgaatagtgctgcaataaacatacatgtgcatgtgtctttatagcagcatgatttctaatcctttgggtatatacccagtaatgggatggctgggtcaaatggtatttctagttctagatccctgaggaatcgccacactgacttccacaatggttgaacgagtttccagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatgttttcatgtgttttttggctgcataaatgtcttcttttcagaaatgtctgttcatatccttcacccactttttgatggggttgtttgcttttttcttgtaaatttgtttgagttcattgtagattctggatattagccctttgtcagatgagtagattgcaaaaattttctcccattctgtaggctgcctgttcactctgatggtagtttcttttgctgtgcagaagctctttagtttaattagatcccatttgtcaattttagcttttgttgccattgcttttggtgttttagacatggagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcatttccccatttcttgtttttgtcagctttgtcaaagatcagatagttgtagatgtgtggtattatttctgagggctctgttctgttccattggtctatatctctgttttggtagcagtaccacgctgttttggttactgtagccttgcagtatggtttgaagtcaggtagcgtgatgcctccagctttgttcttttggcttaggattgacttggcaatgtgggctcttttttggttccatatgaactttaaagtagtttttttccaattctgtgaaaaaagtcaatggtagcttgatggggatggcattgaatctataaattaccttgggcagtacggccattttcacgatattgattcttcctatccatgagcatggaatgttcttccatttgtttgtgtcctcttttatttcattgagcagtggtttgtagttctccttgaagaggtccttcacatcccttgtgagttggattcctaggtattttattctctttgaagcaattgtgaatgggagttcactcatgatttggctctctgtttgtctgttattgttgtataagaatgcttgtgatttttgcacattgattttgtatcctgagactttgctgaagttgcttatcagtttaaggagatttggggctgagacgatggggttttctaaatatagaatcatgtcatctgtaaacaaggacaatttgacttcctgttttcctaattgaataccctttatttctttctcctgcgtgattgcccgggccagaacttccaacactatgttgaataggagtgatgagagagggcatccctgtcttgtgccagttttcaaagggaatgcttctagtttttgcccattcagtatgatattggctgtgggtttgtcataaatagctcttattattttgagatacgtcccatcaatatttaatttattgagaatttttagcatgaagggctgttgaattttgtcaaaggccttttctgcatctattaagataatcatgtggtttttgtctttggttctgtttatatgctggattacgtttattgatttgtgtatactgaaccagccttgcatcccagggatgatgcccacttgatcatggtggataagctttttgatgtgctgctggattcggtttgccagtattttattgaggatttttgcattgatgttcatcagggatattggtctaaaattctctttttttgttgtgtttcagtaaggctttggtatcaggacgatcctggcctcataaaatgagttagggaggattccctctttttctattgattggaatagtttcagaaggaatggtaccagctcctccttgtacctctggtagaattcggctgtgaatccgtctggtcctggactttttttggttggtaagctattaattattgcctcaatttcagagcctgttattggtctattcagggattcaacttcttcctggtttagtcttgggagggtgtactctcataacagtttttgtcataaagtccattttgtctaatattagtatagccacttcaactctcttatggttactctgcgtggtacatctttctccattttttaaacttccaatctgtttgtatttaaatatataaatatgtgtcttgtagatagcatgcagttatatcttgttttcttatccaatctgacagtctatgccttttgactgggttatttaatccacttaaatttaatgtcattgatttggtggaatttattttgttggtttttttctgtatgtgtcatgactactttgttcctttgtacctcctttactatccccttttgtatttaatgaatattttctagtgtaccgttttaatttttcaatgattttcaactattttcaagttattctcattgtggttgttttggcacttatgatatacatcataagttatcagaatatacttcatatttatagtaagttaattcttataatatattttacatttacttttatatagttccattcatttccctgttgtctattattttatacgtattatgtttacatatggtgcaaacacaacaaaatattcttttgaaaatccaagatgcaactttagtacatatttcattctacagaatacttatacacttaatcattttccaaagtacattttgcaagacatactggtcttcaccagtaactactgttacttcctctttttaaaacagatttattgcttttatactgttggcgggaatgtaaactaattcaaccattgtggaagacagtgtggcaattcctcaaagacctaaaagcagaagtaccatttgacccagcaatcccactactgggtatatacccaaaggaatgtaaatcattctactatagagacatgcaaatgaatgtttattgcagcactattcataatagcgaagacatagaatcaacctaaatgcccatcagcgatagactggataaagaaaatgtggtaggaatactgtgcagccataaaaagaaatgatatcatgtcctttgcagggacatggatggagctgaaagccattatcctcagcaaactaatgcaggaacagaaatccaaacactgcatgttttcacttataagtgggagctgaacaatgagaacacatggacacagggaggagaacaacacatattggggcttgttggggggtatgctggggagatggagagcgttaggaaaaacagctaatgcacgctgggcttaatacctaggtgatgggttgataggtgcagcaaaccaccatggcacacgtttacctatgtaagaaacctgcatatcctgcacatgaaccccagaacttaaaataaaaataaaaattagactgctttccacagtggctggattattttacattcctagcacctagcatgtatgaagatatggagaaataaaaaccctgtgtgtgagggtttttatttatccatatcttcactaatgcttgttgttacctgattctttgattctagccatgaagtggtatctcattgtggttttgataagcattttcccccgatggctaattatgtcaaccatcttttctctcttccttttttttttttttgaaacagtctcgttctgtcacccaggctggagtgcagtggcgcggtctcggctcactgcaccctccatctcctgggttcaagctattctcctgcctcagcctcccaagtatccgggactgtaggcgcacaccaccacgcccagctaatttttgtattttttagtggagacagggtttcactatattggccaggctggtctcaaactcctgacctcgtgatccgcccacctcagcctcccaaagtgttgggattacaggcgtgagccactgcgcccagccacgttaatcatcttttcatgtgtttgttggccatttatatatattgtttggataaatgtctactcatatcctttgtctgtttttttttcattgacttgtttttctctttatcattgagttctaattttctttacatatccagatactatcccttatcagatatatggttttaaaataaattctcctgttctgtgggttgccttttcactttatagtgtcttttgaagctcaaaacttttacattttatgcagtccaattgatctattttttcttttgctactcatgcttttggtatcatacctaagaatcctgtaccaaatcaaaagtcattaaggtttacctgctttttcttctagtagttttattgttcacatttaagtctttgataattttgagtgaatttttgtatacagtgtgacatagggatccagtttaagtctttttgcatatgggtatcctattgtccctgcaacatttgtttaaaagatgattcattttctattgaattgtcttggcacccttgtcaaacatcagttaaacataggtttatcggtctatttctgaactctcaatgccattccattgctctgtgtgtctatccttgtgccattacaagactgtcttgctttctgttgtttttaaataagttttaaattgggaagtgtactagtctgttctcagctgctaataaaaacatactcgagactgggtaacttataaaggaaggaggtttaattgactcagtttcacatagctggggaggcctcacaatcatggcagaagatgaaggaagagcaaagggactccttacctggcggcgggggtgggcaagagagaatgagagccaagcaaaacaggaaacctcctataaaaccattagatttcatgagacttattcactaccacgagaacagtatgggggaaactgcccccatgattcagttatctcccatggggtccctcccacaacacatgggaattatgggagctacaattcaagatgagactggggccgggcacagcagctcatgcctgtaatcccagcactttgggaggctgaggcaggcagatcacttgaggtcaggagttccagaccagcctggccaatatggtgaaaccccgtttgtactaaaaattacaaaaattagccaggcgtggtggtgggtacctgtagtcccagctactcgggaggctgaggcaagagaatcacttgaacccaggaggcagaggttgcagtgagccgagattgcaccactgcactccagcctgggtgacagagcaagactccatctcaaaataaataaataagaaaaaagaaaaagaaagatgagactgggtggggacacagccaaaccatatcaagaagtgtgagccctcgtactttattcttctttttctggattgttttcagtattctgggtcccttgtaattctgggtcccatatgaatttttgaatcagcttgtcaatttgtacaaacaagtcagctgagattctagtaggaattgcttcaaatgtatagctcagtttgggaagtactgccatcttaaaaatgttaggtctttgaatttatgaatgtagtgtagtttttcatttatttagacctttaatttctttcaacaatatttagtagttttcagagtgtaagttttgtacttcgtttttaaaaatttattccaaagtatgttattctttttatggtattggaaatagaattgttatgctcaatgtcattttcagattgtttattgcaagcagataaaaatacaactcatttcagtatattgatcttataccttgcaaactttttgaccttatttattattttagtagatttttagtggattccttaggattttctatatataagatcatgccattcttgaaaagagaaagttttatttcttcctttccaatttggatgtcttaaatttccttttcttggctaatttctctggctagaatatctagtacaatgttgagtggatttgacgaaagtggacattcttatcatttttctaatcttaaaaggaaagcttgtagtctttcattatatgtatcatagccagttttgtgtgagtataacagaatagcagagactagctaatttataataaacagaaatttattggctcacagtttttgaggctgggaagttcaagattgaggggcagcatctggtgagggctttcttgctgtatcattccatggtggaagggcaaagagagggcatgcatgagagacagcaagagttggatgaactcatttttttataaggaactcaatctagtgataacagcattaatttattcataagggcaatgccctcatgacctaatcacttccttttaggccccacatctgaacaccttgcattgggattaagtttccaaaatgtaatgctctgggggtacacatttaaatgatggcagtgtggatttgtcatagaagcccttatcaaattgaggaagttctcttctattccatgttattcagggttttatcatgaagaagtattggattttgtcaaatgctctttctgtgttgattaaggtggtcattgattgtttggtttttattctattgatatgatgtattacattaattgattttcagatgttcagccaactctgcatctctcagataaataccacttgccatgttttataattctttgtatatgttgctacattcagtttgctagaattttcttgaaggtttttgcatccatataaataagacattgttgtataggtttcttgtgatatctttgtctagctttggagtcagggtaatattggcctcatgaaatgatttggaaagtatttcttcctcatctgctttttctcttgaagagttttttaagaatttatattaattcctctttgaatgtttagtagaattcagcagtgaagatatctgggcctaggcttatctttgtggatagtctttttattacttattcagtctcttcacttgttaaggttatctgttacttcttgggtctgtgttggtagtttctgtcttcctagaaatttgtccatttcatctaagttatctaatctgttggcatataattgtccttagtattcctttataagctttttagttctgtaaagtcagtagtaattctcccttcaatttttgattctagtaattgagtcttgctttttttctggtcaaactagccaaagagttgtcagttttctgatcttttcaaagaactaccttttggttttattgattttttctattgtttttccattctctgttttattaatttctgttctgatttttattatttccttccttctacttgatttgagtttagtgtactcttgttttctggtaccaactctggatactagcccttcccttctggagcttgttattgttatttgcttatctgtttagtaattggctggattattttagtgaagtttacccctccagcacacacgcagtcttaaatctttgatgttgcccctcatttaggcacaactttgggtgtgcccacaatcaccctggaatgactgtggtggtactggcagggctgttatcctctttccttggccacacccagctgttaagttctaccaattgaaggccaattattctgttgtttacaacaactccctaggacaagaattcttctacaaatttatctaatctgagtgtggctcttttcaggaaatagtttctgaggtcagtgtttgatacttttttcggaccacaggaaggctcctaccagctgtcttattctccaattctctcctgcaaactagccagcctatagtcttggctgtatcttcattagattcatgagtctactcccaattttctttatcataacctccaattttttttagagtgtttttaggtttacacttatccatgctctcttgcaaatgaagtcagcctctctgaaaagagattagtagctatccatttttataggctgcttctccccttaggtaaaatctctgggctctggtagggacaatggcaattgtaggagctgacttgactttgtgcatgactttcacaactgtaggagctgagtgctaggtggagaggtgtcactagcctgaggtcctcttggtttgccttttctggtgtggaactacaatctcagaactgagagaagggctattggagctctggtgttcataacacaccatgaccatggtagatcctctcttccatgagtggggattggatggaagacaggatccccatctcttgacctcagtcacctggaacttattctcagccacagacagcttagggacaaatgagaaatgctgaagtcctgttcccttcagaagaaagcctgctggctgggagctgaggggagaaggagttctgtgttcttagctgcagcagtgtggagtggagtccccagatcactaggctgggtggaagaaggagagagggaaagaggggatagagggggcagtttttgttcagataccacagacttgcttttttttttttaaaccaaatttctatggattttcttcaataaatatttcttcattttctgttttgcccttaggaccatttccagaggctttaaatggttcacctgttttaatgcgacagagtcaacagagcacctcatattgtaatgccagaactcaatctcccaataatatattttataattatcattttatataaccttatatcttttaaagaagagaggaaaagagaacataaatatctttatggcttttaaaaaataaccttctcatttaccattttttattctcaccatttctttctgtgtacttgagttaccattgggtatcgttttcttactccaatacagcttcattctgacgcccctcctatgtggtgttattgtcatatgtattaaatttctatatgttataggcccaacaataaattttgtagttaatgttattttttttttttttctttttctgagacggagtcttgctttatcacccaggctggagtgcagtggtgcgatctcggctcactgcaacctctgcctcctgggttcaagcaattctcctgcctcagcctccagagtggctgggactacaggtgtgcaccaccaagcctggctaatttttgtatttttgtagagatggagttttgccatgttggccaggctgttcttgaactcctgacctcaggtgatctgcccaccttggcctcccaaaatgctgggattacaggcttgagccactgtgccaggcctgtagttaatgttctgtgcaattgctttttatttttttatttgatttattttattattatttttttgagatggagttttgctcttgttgcccaggctggagtgtaatggggcgatctcagctcactgcaacttccacctcctgggttcaagcaattctcctgcctcagcctcccgagtagctgggattacaggcatgtgacatcactcccggctaactttgtatttttagtagagatggggtttctccatgttggtcatgctggtctcgaactcccaacctcaggtgatccgcccgcctcggcctcccaaagtgctgagattataggtgtgaaccactgcacccagcctgcaattgctttttaaatcagttaagagataaaaggtaaagaaatatattccttgtcactacctacacaattaacctttaacacaatgctttgtttttcatgaaaattcaaattactctctggtgtcactttgatttagcctgaagaatttcctttagattttcttgtaagtcaggtctattagcaatgaattctttcaggtttttattatatgggaacatcattattttgccttcatttttgaaagatagttactgagtatatgatacttggttgatgtatttttttttcattcagcactttaaatttgttatcccactaattttgttctccatatttttctattgagaagttcactgttagtcttattggggtttcctttagatatgattagtagtgttttgcttgatgctctcaagattttttctttatctttagttttaatattttaaatatgatgcatctgggtgtggatcattgagtttcttctactggagtttgttgaaccttttggatttgtaagttagccttgtccatcaaatatgagaaggttattgtcattatttttctaatttttctgagtctctttatttcctctccttatggtacttgtaatatatgtatgtttgtgtgcttaatggtgtaccatatttctctgacgctctgtttctctttatttttttctgttcattttgtataatctctattcatctgtattcaagtttattgattctttcttctgccaacttaaatctctagtgaatatttcatttggattattctattttcaactccagaatgctatcttgtttataatttctgtctctttttctattctctatttgatgaatttttatcatacttttctttcattcttcaagcatgctttctttcagttgtttaaacatatttataatagctgctttatagtcttgggtaagtccaacatttggactctgtcaaaagcagtttcttttgcctgcttttcttcctatgtatgggctgtgctttcctctttgtttcatatattgtaatttcttttgaaaactggacatttaaaataatatgtgatctcttttccacatcaatgatatgtgtagcagctttaagtaatgaccatctcccacccccacccccaatttttgggacttgctgttatttgtttggttgtctgtttattttttgacttgatagtctatttccagtagtgtatgcagcctctaatatccattccccaattttttttctttgttcttattttttatcctgtcttcttaggggtcacccttgggtgcacatgaaccatttaatcaccaaaggttatgattactccccttagtcagttagactctttacttttgcatgtatttgtagctttgagtttgttttcacagttgagggtgtttatgatttttttttacatttagccagatgttctctctctggtcttttctatgagggtgcagccttgggcatgcacacaatgtaccagaccactagggattagttttactttgtttttagacctgaattcctagaagcagcccttgggtcagaatagcctattgttcagccagtgtttcatcaggagttgtgcaaaagccccttgatctaatggatctgtgtgtggcttggagaatactttcaagtctgccttccttctaactctgattgcttctgattaggtgtagcctagcttatgcacacaggctttcagatgtccagtgatgttggtgaccccaggagggctctgcttggctatttcttttttttctttttctttttttgagatggagtcttgctctgttgcccaggctggagtgcagtggtgcaatctcggctcactgcaagctccacctcccaggtttacaccattctcctgcctcagcctcctgagtagctgggactacaggtgcccgccaccatgcctggctaattttttgtatttttagtagagacggggtttcaccgtgttagccaggatggtctccatctcctgacttcgtgaaccgcccacctcagcctcccaaagtgctgggatttgggctatttctatggctctgtcttttaaacttctgatcagtttgcatttcactagtatcacagagctaccagccttcttgaaattgctcaccaagatctccattgatttaataacattgtcagacataaacttctccatattctgttccaaataaagtcaatcccctcaggcagaactgctaaagccttctgtttttattacctgcctctccctctgggcagaagctgtggatcattgcactggagctgaatgtagcaagagcggcctgtttcttctagattgacacccctattatatgagcaagtcctggtatagggtatattcattttcacactgctataaagaactacctgagactgtgtaatttatgaagaaaaaaggttgaattgactcacagtttcccatggctggggaggcctcaggaaacttacaatcatctagaaggtgaagggaaagcaaggaacatcttacgtggcagcagaagagagagagaaagtgaggaagtgctacactttaaaaccatgagctcttgtgagaactcactcactatcatgagaaaagcatgggggaaactgccaccatgattcagtcacctcccaccaggtccctcccttgacacatggggattacaattcaagatgagatttgggtgggacacagagccaaaccatatcattctgccccagcccctcccaaatctcatgtccttttcacatttcaaaaccaatcatgccttcctaacaattccccaaagtcttaactcattccagcattaactcaaaagcccaattccaaagtcccatctgagaccaggcaagttccctctgcctatgagcctgtaaaatcaaaaacaagctagttactcttaagatacaatgggggtatgggcattgggtaaatgttcccattccaaataagagaaattggccaaaacaaaggggccataggcccaatgcaaatctgaaacccagaagggtattcattaaatcttaaagctccaaaacaatctcctttgactccatgtctcacatccagggcatagtgatgcaggaggggctccgaaggccttgggcagctccacccctgtggctctgtagggtacagcccccatggctgctttcatgggctggcattgaatgcctgtggcttttccaggttgtacagtgcaagctgtcagtggatctaccattctggggtctggatgatggtggccctcttctcacagctccaataggcagtgccccaatggggactctgtgtgggatctctgacctcacgtttcccttccaaactgccctagtagaggttctccattaggcctctgccctgcagcagaattctgcctggacatccaggcatttccatacctcctctgaaatctaggcagaggttcctaaacctcagctcttatctgctgtgcacaggctcaacatcatgtgataagccaccaaggtttgaggcttgcaccctctgaagcaatggcctgagctgtacgtttttcccttttagccatggctggagctggagtggctgggatgcagggcaccatgtcctgaggctgcacaatgcagtggggccttgggcccggcccaagccatttttccctcctaggcctccagcttgtgatgggaggggctgccatgaagatctttgaaatgccttggagatgttttccccattgtcttggtgattagcatttggctcctcgttacttatgcaaatttctatagcaggcttgaatttctccccagaaaatgggtttttctcttctactgcatgctcaggctacaaattttccaaacttttatgctctacttcccttttaaacataagttccaatttcaaatcatctttttgtgaatgcatatactgtacgcttttagaaaaagccaggtcacttctttaacactttgctgctcagaagtttcttctgccagatatactaaatcatctcttaagttcaaagttccacagacctctagggcaggggcaatgccaccagtctcttcgctaaagcatagcaagagtgacctttgctccagttcccaataagttcttcattctatctgagaccaccgcagcgtggacttcattgtccataacaccatcaatcagcatgttggtcaaaacaattcaacaagtctctaggaagttccaaacttccccacatcttcctgtctcttctgagccctccaaactgttccaacctctgcctgttacccagttccaaagtcacttccacattttcaggttatctttatagcagtgccccactcccaataccaattttctatattagtctgttttcacactgctataaagaactacctgagactgggtaatttatgaagaagaaaggtttaattgactcacagttccacatggctgggtaggcctcaggaaacttacaattatggcagaaggtgaaggaaaagcaaggcacatcttacatagcagcaggaaagagagagcggaagtgccccactttaaaactgtcagctcttgtgagaactcactcactatcacaagaacagcatgggagagactgccgtcatggtccagttacctcccaccaggtccctcccttaacacgtggggattacaatttgagatgggatttgggtgggaacacagagccaaaccatatcagagggagatatggccctgatactctctgcttgcgcctcccaccgtggaacctatgccctatgagcaagttgtggtgaggtgattggggccttagtattcttggcctgctttgccagagcagagcccttggcttatgagtggagcgaggtgggggaaagagacccagtccacttagctgcagcttcctagagcagcattttcataacaagggcctactgaggataagaggtgccagtggatttccccttctggggtgaaatcctagaataaccttagcctgggtcttagtcttgactatgagctggggataaagggagccttcctcttttcttagccacatctgccttgtatccataaaactgggatagagatgggttaggaacaggtcatgtatcaaatgccactgactcctattgttcttaccaaaattcactaagtttacttgaataaacatttcttcactttccataagccattaggacaatttccagagactttaaatgggagaggatccaccgagctcctcatatccctattctggaagttctatcagcaacgatttcttatatacaataccaaagacataagtgatgaaaagatggataaagattggacttaatcaaaattagaaacttttgttctttaaaagacactgtctagaaactgaaagggggccgggcacggtggctcatgcctgtaacccccgccctttgggaggctgaggcaggcggatcacctgaggtcaggagttcgagaccagcctgaccaatgtggagaaaccccgtctctactaaaaatacaaaaaataaaataaaataaaataagccaggtgtggtggcgcatgcctgtcatcccagctactcgggaggctgaagcaggagaatcacttgaacccaggaggcggaggttgcagtgagccaagatcgtgccattgcactccagctgggcaacaagagcgaaactctgtctagaaaaaaagaaagaaagaaagaaactgaaaggacaatttatattagttttctactgctgttataggaaattaccacaaacttagtagcttaaaaaatacaaatttatcattttacagttctgtacattagaaatatgacatgagtctcactgggctaaaaccaacatgtcagcagggctcatttttttctggaggctcaaggagagaacttccttgccttttttagcttctagaggttgcccatattccttggctcatggctctcttcttctgtcttcaaggagagtttataggctttaaaaggccatgctgtaacaggcaagtgataacaggctttagtgctgtgggatgggatattggcgttgagcggggtaagggtgattaggttttaatgggatcgtaaggggtgcatcatccatcaccaaggagggagtagaggtgtcctacacttgtggattaaggtggggagatacaaggagaggatgtgaaggaggctttgaactgggggaaaaggtggcaatgaggtgtggctgtgcagggaagcagataatttagttaaaatgtctcgacctaataagggaactaggcaggtggggataactaaaaaggagtgcataaaagaatgttgtccaatttggcaccagagctggggagttttaagaggtttagaagcctggccgtcaatacccacaacagttacggagggaagggatacaggcccttgaaaagaagataatgtggagttggtagcctctgtattgattaagaaggggacggacttaccctccactgtaagagttaccatgggctcagaggcctgaaaggaacatggactgactgtatatgagctcaaagctctgatcatcagcacctgctgtagccccagcataccctcaaggtgtggactctcccctctaaccaaggaaattaaagcatcagaatgaaccaaaagcatttaatgggtaaaggcagccatcagtacactcataggaagcccacactcctaaagaacaggagggtcttgcaaaaacctcccaggcttgtttgtttctccctctgtttctctctctctctctctctctctctctccctcccttgctccctccctccctccctccttccttccctccctgcccctctccccctcctccccctccctccccccctccccccaccacatttctgaaatagagcccagatgagaaacctgctcatgtgtatgtctgtcccatttaagaatagtagattctgactcatgggcaatttcattcctgaaattccaattgcagaaaaaagattagcagaacaggttttatttcattttctatccccctccctttccatcatttcccttgacatcacatatgtcaataagtagcatgtacggaagcactgatcatttcttaattaatacctttacagtttctttttgaggacaatggaaatgttctaaaattagattgtggtgatggttgtacaactctttaaatatactaaacaatcattgcatttcgcttaaatggatgaattttatggtatggtaattttattgtgtgtaaattatatctcaataaagctataaattaagaaacaatcagtgcttccctacatgctacttattgatgtatgctatctcaagggaaatgatggaaagggaggatagaaaataaaataaaacctgctctcctaatcttttttctgcaattgagatttccggaatgaaattgcccatgagtcagaatctactgttcttagatgggacagacatacacatgaacaggtttttcatctgggttctatttcagaaattcatggagagagagagagagagagagatgaaaggaaggatggacggaaggaagcaggcctggaaggcttttgcaagaccctcctgttatttaggagtgtgggattcccgtgagtgtattgctggctgcctttacccattaaatgcttttggttcattttaatgctttaatttccttggttaaagggagagtccacaccttagggctgcgctggggtttagcaggtactgatgaccagaggaaaatctactgagtgctaaatgcaaacaagtcaaggactgaagctggcctgagagtcagggaccccttcccttaggtaggttttagcctaacttctatacatttgctgtaactgaagccccacccccagcagctacattccctggccttcccagaacattgctgtgggcccccatactagatttccctccttcctctggacatctctagaaacatcttttctgcattgctgcaaactttcattttaactccctctctgctattacttaactcaaggacagaggaaatagctgcagtccagaaacagaataaaacaaagaagaaagaaagagaagaagccccaaactcctcccaaatctttaagaaaacaatcctgtaggatttggttgggaattgccatgcaatgtggggaatgtgaaacatgtgctaatcatggccctttctgcttggatcctacctgacttctctccaccacccccagccagctgggctaggctaggcccaggggagccacaaagctgccagcttagaaaatggagacaaatgaggaggccccagaggacaaagcaagacttgttactagttttgaggccaaagcaacacatacagtatttaagggctatgggggtagatgctgcaaagcctggaatcctagctttgagcttaaagattcaggctaatttgcagtgactgactgtgtcagaggtgtttgaaccagagcaactccatcttgaatagaagctgggtaaaatgaggctgagacctgctgggctgcattcccaggaggttaaggcattcttagtcacaggatgaggcaggaggtcggcacaagatacaggtcctaaagaccttgctgatacaacaggttgcactaaagaagccagctaaaacccaccaaaaccaagatggcgaccagagtgacctctggttatcctcactgttacactccatccagcaccatgacagtttacaaatgccatggcaacatcaggacattatcctgtatggtctaaaaaggggaggcatgaataatccacccgttgttgagcatatcatcaagaaataaccataaaaatgggcaaccagcagccctcagggctgctctgcctacagattagccattccttattcctttacttccttaataaacttgctttaactttacagactcactctgaattctttcttgtgcaagatccaagaaccctctcttggggtctgaatccagacccctttctggtaacaactgttctggagtcagtagtttctgagctaggcctcacttggttcaccatcttgactcttgccttgattattgccagactttcctggctcggtgtccctgcatgcagtcagtgccacagtgatcttttcaaaacagagatcagagatctgatatcagtactccctctcttccagtctatctcatctccaggagaaaacccacattccctaacatggcatatgaaatgaaaccctttataatctggccttagttgctctcgcttcatattctatcacctgtcctcaccctcaggtgatcccacaaaactatttatactttcttgaacattttttttttcttccccacatcagtgcctttccatctgctattccttcagccaggaatgaatgcgctttccatctttttctccattaggttataatcccactcttcatttaagactaagtgcctctgtgaaaccttaggcttgctagggaggggttttcagctttcttcttgttgccagatctcactgaacataccttgggaaggcagagttgtgcaatggaaagaacctacatgatagagtcagacacactatgggatggtgagtaaaagactttatctctcagtttcttcatctgtaaaatgggagtatgaatcactacaaggcaaaaaggtttatattggtaagtgccaagcacagtacttaatacatagtaggtacttgggcaatattgtatgttgtagaagaaatagaaaaatgattcctttactctcagttggggactctaaggaggagtttctgagcagacaaccaagtggatggtgttctctggggcctgtttacctgtcttcttggggttcacctgcctttggccaccctcatgtctaaatgatattttgcaattatcctgccttgttgggagcagccatcagctgctttcccattcatgtcccttaaaaatctgtgtgggcaatcataagaggagagggaagaaattttcacatccccttcttttcttccccatgtccttgtcttgcccccaagcctcagattgtctagcagtcacttcatgtcggccttaccccttcctgcaaacatgctccccctagtcttttttctgcaattgagatttcagaaacaaaattgcctatgagtgggaatctactgttctcagattggaatggacatacacattagctggtttctcatctggactctatttcagaaatgtacacaagatgtcaaaaatataccatttggaaccagagcaatatttattttgaaaaaattagggagaaaagtttccttgcttcaattcctactggaatgtaaaataactatgtgctgatgctgcattttgacagcattgagttagttaccctcagggtcactagatgagtggtgcacagacacacacgcacacacatgtgtgcacacacacaaacacatatattcagagtgctttgttgttgactggaaattgcaggcagtctgatgccagagttaggctttaatggatcaagccatacattaacaacactttagtaagtgttcccttatgtgccaaatcttgtgctaggcggggagaagaaaaggacaagtcacagatggagtaatctgaacacaacaagagagcataaagcactaacacattaatactgagagtaaatatttaaagaagaaggggttgaggttactgaactatagttaccagggaaaatttcctggagggaatggtgagacctgagcaaggacttggaggataaaattggcgactctgatttatccacagaattctcttagaaatgactattagaatagatagaatgaatattagtttgcaggaggtggaaacaaaaatgacctgaaattgtatctgaaggaggttatatggaaaagattgagaggaacatgggaccaagaagtagaaggcatcttagtcgtagagtcactactgactcattgtgaatgaccttaggcaagtcctttctctttgaaggacttttcccgtctctacattggagctaaataatatcagccttactgacctcctaggactattgttaagagaacaaatgagataattgtgtgactgtgcttggaaaaatagagaagactatccaaaaatatagtttgggtttatgaaggcagagtttatactgtagccactctcttgcagctgggaataggatgacctcagtatttgaatgaatttttcttggcaggcctcttgcctgccataattacagcctgccagccactagttgagtatacatactgaagcaggatctgcacacaagcatgcatgtgtgtgtgtaagtttgcattgggctaggagattgtagccaagagaataaaaagacgggagaattcttaggaaccaaggagatctatagaaatggagatttatgtaatcatctttgggcctgccacttcagtaattcaggacatcatccatcttccttggtatattacaaagccttcctacttatctgcctgacttcatggtgccccaatctagcccatcttccacactgctgctaaagtgtgtttccaacccaatgacattttggggctcctggatgaccacaaggtagcactcatgctcattcacatgacatagaagcagggctgtatttaactagtattcactgatatgaccacacttcttgttaaaattatgggatcctttgagaggctctttgagcctcttcaagacccctcctgctgccccagctgcccctcccaactcttggacccagccactaaagggttagtgcccagcacagcaagggacctggaggacattgttccatgcactgacctgcatctattctgctttgttggtgctgctgctgctatattggtttttatatatgtttaggattacttttgcattcatgattcatctcatcccagtgcatgtttccagcttatctctcacaacttttccacacagatatcagcaaattgaaattatcatattccgcatctggatttatatgcctgtctctaccacaatactgggaaccctttgagagtagggacaagtggcttcctcaccaatgtagccccaaagccaagctctggacccagcacacagtggacactcagtatatgtttgttgcttatcatagaggatgttggtagatggagccattctgtttgtaatcctctaaaaaccttcaggatctaggcctgaacctggtgcagggcactttcttggtcttcttgcagacctcatgaatgttattcacatttccagtgtccttggaagggagggaaagagcaagtattatttccattctattactggggaaatggaagtattccaagagtacatctcagccacacaatgaatgtttaatggaactgagacataaagtcatctctctggaaattttccttacccacagtgctggaaagccttttgagatttggggtgaaaactgctgccctaatgtgagtaattgaagactgctgccttctggggagatgctggcttggagtctttttaagtgggctgaaggactatctggtggaagtgatgtaaatgttcttgtcccttctgtcccagcactgccaagagagacactggtgtgtggggttgaggtggagaatacattaaatctcttctgatttggttgcttggcttctgctgcaaccaattaacatggcttcaagccaggtatggtggttcacccctgtaatcccagcactttgggatgccgaggtgggcagatcacgaggtcaagagatagatcgagaccatcctggccaacatggtaaaaccccgtctctactaaaaatacaaaaatttagctgggtgtggtggcggtcgcctgtagtcccagctactggggaggctgaggtaggagaatcgcttgaacccgggaggcggagcttgcagtgagctgagatcgcaccaatgcactgcagcctggtgatggagcaagactctgtctcaaacaaacaaacaaaaaaaccatggctttacaactggtggtcccttcagcaacaagttaactttcatttcaggaaatcctctggcaccctttctctgagatggatcccccttacccctacaagaatagtcccttgtagtgagccagcctggaagtgctgtagagaaggccagactgggagaatgactggagccctatctttaagaaatttagtcttcctgggaagcaggcatcgtacgtcaggtacgacttaggctgcaagtaactgaaacccaaactctaactggcttaaacaattaggaaatgtattatctcacataacaagaattctagggaagaggcaggctttaagattggttgattcagctgttcataatgactgtcagcgggtatcaaggtaaatcattactttgttctccagttgaagtgagaggaacctaacaagtaagtctgggaaaccatataggtgtcaaagtttctcagttctatctttataaaaaggagagaaacatgggcactggaaaacaatagggtagattcaaagtatccactgagttcatattagctgtgtggccttggacactcagttaattgctccaagccaattcccttatgtgtcaaatggcagttgttaaaatatttgacttgcttctaaacaggctgctggtaggggtcatgtgaaataatgtgaagacatttggtaagtcacataaggtgccatatacctttgaaacctttgtaaaaaaattatttttaattgacataaaaattatatatatttatggtgtacaacaggatgtattgaaatatgtaaacactgtggaatggctaaattgagcgaattaaaatatacattacctcacatacctgtcatttttgtggtgagaacacttaaaatctctgtgattttcaagaatatgatacattgttctaactatagtcactatgttgtacatctcttgaacttattcctcctgtctaactgaaattttgtatcctttgaccaatatcttccccaaacccccttccccctacttatctgcccccacccctggcaaacaccattctaccctttgattctaatagttctaataagctctcacatgagtgaaatcaggcagtatttgtctttctgtgcctggcttatttcacctaacgtaatgtcctccaggttcatctatgttgccacaaatgatgggatttccttcatttttaaggttgcatagtgtttcattgtatatatctaccacattttctttatccattcatccattaatggacatttagtatcttggctattgtgaataatgctaccatgaacatggttgtgcagatatctcttcaagatactgatttccttttttttttttttggaatatatacccagaagtaggatgactggatgatagggtagttttattttaattttttgaggaaccttgataccgtttttcataatggctgtactaatttacattcccaccaccgctgtgcaagcctcaccacagcacctaaccaccacctttcctccacagcctcaccaacacttcactcttgtttttttgatagtagccatcctaacaggcatgaagtgatatctcgttgtgattttgatttgtatttccctgatgattggtgatgttgagcatatttttatatgcctgctggccatttgccatgtcttcttttgaggaatgttttggcagatcttttgcccattttttaatcaggttatttgttttctgaggccttttaaaaattactatcatcagacataacacctactgtgtaaaaggcactgttagattgaaagtttaaaataaaacctaggtactaaccttaagtttccccaaacagtgcaacacacatctactgagcacccataggtgctggggacacaggtatgagagagaccccctgcccagtagagcaggggacacagacttatgaacagacaacttcagtacaacttggtaagtgaacacaagagtagaggtgtgtgcagagtgctctgggagtgcacaggccttactaacctaaccaggcttcacagggaaggggtaggcagaatgtcaggagcgtatcaagcaataagagggatatgaaaaaatctgtataacatagaaacatatataagcaaagccctcaaacagccttcttattttgtattttagggacacactaaggggtagagtctatagaaaacaatgagtaaacaacagtgtaatgaacttttttctccctcctctccatctgttgtggttaactggcacatgttccctagagcttctaatcaacagtctgaaaactaagcctctctatgtaacagggtctcaaaatgtctctgaacatggaccttcattggcagaacagtattctctgaagcttcatgatcttctgtagcatatcctctgggaattgcagaagattgagcctctaataactggttgggcaggtgtatcaactttttcaggaaggattatttgactacagagtttcacatatcctatcattaaaagttgcactctcctatactgtgttgctatcttaacatactgtaaattaaagttataatttaaaagtgttgaagtgcattttaaaaacagtaaatattatttaaatataaaggaatctcccaccccattgtccagttttttcctttttttcttttattgatacataatattctacatatttaagaggtacatgtgaatatttgttacatgcatataatgtgtaatgttcaagtcagtgtatttggggtatccataccttaagtatttattatttctgtgttggtaacatctcaagatactttcttctagatactttgaaatatacaatatattgtccattgttggatgaatagtttgcaaatatttttcacagaattggaaaaaataatcctaaagtttgtatgaaagcaaaaaagagcccaaatagctaaaacaatgcttagcaaaaagagcaaagctgcacgcatcaccttctgacttcaaaatatattacaaggctatattacaaaacagcatgctgtcggtatgaaaacagacacataggccaatggaaaagaatagagaacccagaaataaagccatgtaaataaataaataaagccaacagatttttgacaaaggcaccaacagcatacagtggggaaaggacacccttttcaataaatggtgctgggaaaactcaataagcatatgcagaagaatgaaatgatttttgtatctctcaccatataaaaaaatcaaatcaagatgaattaaagatttaaacataagacctgaaactataaaataactggagaaaaacctagggaaaactcttcaggacattggtctgggcaaagattttatggctgagacctcaaaagtacaggcaacaaaaacaacaatagacaaatgggaccatgctaaatttaaaagcttctgcacaacaaaggaagcaataaacagtgaagagacaacacgttgaatggaagaaaataaagcaatcttttcattttttcaagtgctagtttaatcagtcccatcagtactgtgggtggcactgtgaggacagggtgaaccttagggttatttttaaatttatttttacttttgttttttgagacaagtcacccaggtgggagtacagtggtgcaatcatggcttactgcagcttcaacctcctaggtaggttcaagcaatcctcccacctcagcctcctgagtagctgggaccataggcacatgacaccatgcccagctaattaaaaaaaaaattttagagacagggcctccctatgttgcccaggctggtctcaaattcctgggctcaagcaatccccccacctaggcctcccaaagtgctgtgattacaggcatgagctactgtgcctgccccgaatctttgggctagatgttgagtcccagtgacaaataattgcttgacatcactctcttgtgtagacatcattgctgccaaagactttttgcctcctaaaatgccttaattatagcctgattaggtctgaccactataaagtctgctgcactttgggtgcatgatttcctgtgctacatagagctctgctgttaaacaggctcgtaaagaaccctcccggacagcttctcaggcccaggtttcttttctgctgtgctttattatctcctggggtggatacccgcctgcctgctctcgagttgcttccccagacccagagtttggcagtgctttcctggcagaacagtcaaccttcctgttacctcaaaccaggtaggggactcagagaagccagacgcaaccccttgcagaggagcatacacctacccttgaaaagcagactgtttcacctctctcataccaattagtgaatgatgggatacgcatcaaggggaagagtgctgagagaatcctctcaggaagtgaactgaaaaggaaaccaacaagggttgagcatgttttccaaatgacaggattctgttttgtggggagtcatcccagagctggaaaagatgtcagaactatgagagaaggtaagcaagagagtgagtcaagtgttttcaccatgggttcaaatggatgtaggcagaactaccttagaccacactccagctttaatctcttgcttaaattttgctttatactcctttcagaaagtttctatttttaattaattttggggtacgtaataggtgtttatgtgttacatgagatgttttgatacaggcatgcaatgtgaaataatcacatcatggagaatggggtagctatcctttcaagcatttatcctttgagttacaaataatccagttacactcttttagttattttaacatttacaatgaaattactatttactatagtctccgtgttgtagaaggatggttaccagaggctgtgaagggtaatctttctaatttttcttgtttgcaaaggggagtttgaaaaccaaaactcaattgaatgtcagggagtcagttgaaacatatgaacactatatacccaccataatataaggtcgtggcccaggctgcaattttcaagaaacaaaaagtgctcagcaatcaagctgaagctgacacaaaagaatttccatagttgagatcccctacagatcccacaggggagaggaacaagtagcacttaattgagagttccctactcaatatagctctcattaggtggtcagcaattgaagtgtaatttcaacaataaccaccctgggaggtaggtgttattattctcaccattaaacaaataaggaaacaggtttcagagaggtgaagtgacttgcccaaggtcacactgtcactaaatggcagaaccaggatttgatctagtgccttgcacatagtacgatttcagttcatgcatattggaatgcatacatcaatgaaaggtctgtgggacaataaaaatccaaattttttacttgtttttgtgtgtttctgacgttttataacagaatgttttaaatttacagaaaagctgaattttacattaaacacttatatatacccatcacctagattctactaatctattcctgctatacttgtttcatatctattcatgtattgattttctctattcactcatcaatattattttctgatacatttccaagtaaattgaggacatcagtgcaggtccccctaaaatttcagcacgtgtattatttactagagttcaatgtttgtttacaggtgttcttttccttttgaggtaaaatttacagacaatgaaatacaaaatctgacgtgggtgagttttgacatcccatgcacttgtgtatccaaaatctctattaatgtatagaacactaccatcaccccagaaattcccctcatgtgtgttggttttaaccatgctgtgtaacttccttacctgaaccagaatctctgttggtggttagaagtcattgattctaactgggaggctgtgttgagatctcttttctttccttgactgatgctttgggagaaaaccaggtggcatacaataagatttggtcctcagtgcacttcactttgataagtttcacctggaagcatttcttttccttttcagcaaatgtttgtgaaaggttgcccattgattgcagcagttaactttgtcggtttaaactgaggtgaaacaatgactatttgttgtaatttattttaatttaatgttactaaggtataagggctagcattaagtggtggttctttacagcagggactctttcatctgtgtttgtttaaaattaaaaataaggctggtaaacataaaatgttcctggcttggtcctagagtgagctctagtcagttccttgagacttagatcaaggctaagggcgaaaacagtcacagaatactcagaggagtgtgtgtgcctgagtaggatttagatgaaaaacccaaagggactttggcttatttgaaagaatcttatcaaagcagacaggctgagttacctttgaaacccaggcttcaaggaattgggtgtgtagtaagattcagactattccatgacccaggaattgtgagatattttttatttattttttatatgtgtatacatttttaaaaataatttcaactttttagattcaggaggtacatgtgcaggtttgttacgtgggtgtatttcgtgatgctgacgttcagggtacaattgatcccgtcacctaggtactaagcatagtacccaatagttagtttttcaaccctcgtccctctccctctcccctctggtagtccccagtgtttattactgccatttttatgtccatgagtacctattgtttagctcccacttataagtgagaatatgtggtatttggttttctgttcctgcattaatttgcttaggataatgacttccagctgcatccatgttgctacaaaggacatgatctcattctttttgtggctgcgtagtattccatggtatatatgtatcaccttttctttatctgacccaccactgatggacacttaggtggtttccatgtcgtagctattgtgaatagtgctgcaatgaacatacaagtgtgtctttttggtagatcaatttattttcttttggatactcagtagtaggatttctgggtcgaatggtagttttaagttgtttgagaaatctgtgagagttattataggctaaattagcagagatactgatgggctagtgcctgcccctaccaaacatgcctgtgactttgattcttttggttaatattattgttgctggttggcaatgtgagcatcaccaggaggacttctaattcagagatttttacactgtagcattcgtcagcatcacctggagggattaaaacacagattactggcctcacccacagagtctgtgattcatttgacctagggtgagtcctgaatttctaacaagctcccaggagatgctgatgctactggtccaggtaccacactttgagaaccactgctctgagtactgaatgaatgaatgtataaataggatcccttgtgccagacacatttcttcccctctataaatatggcattatttatgattcagtgaggacaggcatgccccttagctccagctgcattttagagtgaagagattctaggaaagacacatagactactccttttctccaacctgcacagcaggaatttcagtttgtactggacttattatgaccctatcttttcacagtcctaactgatcttgctgcatacagggaaagaatctaggcccccaaccacatggcatagttttaattaactcccttctgtgttgggaccctcagaagagataatatgtggctatggagaccatacacccagatttcctgggacagctctgatttcatatattctatccttttgtcctcataaatataattgtcagaccatgttctgcttttgggttcagaaaatattgttcccatatgcatggcctaggggccctgtggagccaaaagcaagtcttcgcttgctttcttgggattgtgggggccagggcaaaagcttggctcattgtgagggatagaaagttggggagaatctaaatgtttaagatcaccagcaagcttctcgttgcttctttcttttcaagtgtcccagtgaccgtgttacagatcccggaatgttgcaaataagagattctgagtgctgaaagggactaaattggacctctggctgcctctctttcctccgtcccccacccctctggaaggaccacacagaaatagcagagaagagccactctaaagaaggaaattccacaaccttcattgactgaccactcagtctaacatttacctattttgcctggcaggaagttcttcctccttgcttatatcagtccttctcgttgcaatgtcagtttcttttcctttgctctgctttcaatcaaaattgagaacagctggtccttccctctaaattttttttatgtgcttagaagtcatattaaaccattcttcctgggtccaggtttaaccatccttggagctcctttatccttcccgcatgtatctgacttgccaaccatttcatcattttgccataggaaagcagcttaggcagcctgggcgaacagtacagcaaagcctaaagctttatggcttgtgctaatgggcgtgctaaatgtttagtagagactatttttgagcacgcaattgtgaacaatttaaagtggaccgtacatggaacccatttcctctcctggctcccccaacagggcctccccttagcagctgaaatgagttagtggcaatcagcgcaaagtaggaatcctgtggtttctgcccttccctcctgctgcttctatggcagctagtctcttaaaatgagcattctctctagaatagccagtaaatgtgacattggaatcagttggacaaagggtctaggagtcactttagctaaatagcaggaggtgctagtgctgaagcaccactggaggttttaggagaggttgaggggacagggttgaacagcgattgatgaaagagtttggacccagaatatttgctatccacagaacggttgtacctcagagttgtacatgccttttttgcaagtttgtagaggacgtttctggcctttgttcacttggcctttgtccactgtctcaactatgctaaagtgatgccaggaatctgtggcagaatcccagcttcagggccagttgggttcctaaaagagaggagggtaacttgccatgcatgggattcttctgtcaggcaggctacctgcctttgatgggatatgttctttgattactcaagtgatttgggagggctgctgccttaagttggcctgcagggtgggtccagggcccatgttagggtgaattggatatatctgatggcactgcagagaaaagggatattgtcctgttctcatcttctgactgttggctcctctgttttaatcaaaccttaaaagctcttctctttataagcaccagccaggcagtttgtctcagcagagctacaggagcacttaatatatgcagccataaagaagaaggaagaaaaagagacggagaaaaaaaaaacctttggcatttgtatgagagtgtcactgaaggcttcatcacagatacactcaagacttagaaactgaaattgtcttggggtgggggtggggagagcagtttgattgaagcgttagctgccttggccctgagccaaggcaaattgccagagaaccattaaactctgtgtaattccatataactcacagcagccacaggtaatctgaatcagacctgacaaaacttcactatcacttattgtccattagcactgaatgcatgctacagatattaaactttttaaagccatatcatggtggccatattttctaaatcccaatcagaaaacctggcttgacaaaggatttattttctgacttgtgaatttgtttatatgaaaagcctcacaaaaggtataatcactaactcacagaggtataaaatactaaacccactgaacaaatggtttttaaggaaagaactatagttgcatgaaattgggtcagggcaaactcatttggacattgatgagggttccccccaccccacacatactttttgggggtctgagggcactggttaacgaagcactaaatcaaattagaatctggtttatgcccatcatctggatttgctcttaaatttttcagggatggtgaactgaaagagcctgttgtaatgtctgtacacacgaaggtggagtcgatgttactttgaattcccagatggtgggagtagttaaatatcccactgttcatggtctgtttgtgagggcttgtgtgtgttttaaattaacttcctaaggcagagaatgttaaaaactgaggagaatcatatctggatacaagttattattgccatacacctcagtttccttaaaggctccattccttccactaaattgagagtctaacattcaccctggggcacctcgtgacaaatgggatatttagctcaaaggataattattctggattattctgagccaataataatgctttttacaaagtttaaagtgtctctttagcaagaactcttagtattgctagttaaggatcatgaatagcaatatacccgtgaaatccaaaaggttttgtcacaaccttgcagaagaaagtatcttaaacctaatagatgctctatcccgggcaagtcatataatatccctgaacctcagttatatgaaaaacaaagtgaaaatattgttacttctccagaatcagtcaaatgaatagggtgatatcctgagatcccttttaattctaatttcaacaaatatttgttgagcaactacaatgtgttcaatacagacatttattttcctaggtgccagtgacagagctgtataaaggcattgactatctcccacactataatgtatcttgacagcaagtaaacatacatagaaataagtgagatcatgtaagatggtggtaaattctatgaagacaataagacaggtaatgtgatagagagtgatgagatgtgggtagagaagagaaggaacattctttatgtggttggtcaggaaaggcctctctgaggaggcaagatctgagctgacacctgaatgataaaaggaggtatgtaggatctagaagaagaatgttctcaacagatagaatagtaagtacaaagatcttgagatagggatgggcttgacctctctgaagaacagaaagtttggtatgacgtgtgtgtgtgtgtgtgtgtgtgtgtgtgtgtgtgtgtgtgtgtgtgtagaggatgagaggttgtgggaaataaggtcaaaaaggcatgcatggccagatcatgtagagcttctgatctgctgctgtttacattgtaaaaatcattctttggtctgtctgatttaattaatgaatgttagtaccagatgttaatgacaggagggcttgaagtttgcccataggaaacccaaggagagggtctgggtgtggagtaggggggcagaaggggaagatgaagtagaaaaggcgagctcaaatgccttgttggcagggcagggagaggtgggagtggaaaagataatgtgtagggagggttggaaaaagtttgagggaggaggaaaagcaccagagtgacctcggctgtgaggaacaccgtcagtgccaaggttgtggagtctgctatcagagggggtcaacctttataggagaagggacaggactgtactcttgtttaaagttagaagagtgagaatgagcaggaactgaagctaaaaatctggtcctctctttttatccagccttaacttaaaaagcaggtctgatgtcagagagaatggcgttcacattgcttgccttatttattttccaggtcttgaactcaaatgcctatcacttcctcctgcattttcttctcaacttaatcctgtcattgcaaaaggaaataatctctgatgcaagagtcccttcccgccactaacacataagcaattgagtgcattttttttcttttttttcagttgtggaaactcagttttgttttatgttatttggcacgttttgttgagtaggaaagagatggtgtgtcatttctcagtcatgatgtgaacaggacagtagcttggaacagactgtgtgatggctcacttattcccagatttgtagcactatgtgaaagcagcagcaagtgtgctgatttaatataaaatgggatctgtcctaggctcagtaaaggatgttattattattgcttttgcaacatacatgtatgccttggtaggttatttatttgggagctgtttgctttggtagcagttattcataagggtaagaggaagttaaatctcttttctcctcctccacctcccactggtcagaggtctaagtggagaccagagattaaaattactgccaaggaaagggggcctgggcagggtcaaataatgttctgggagtggcatgcaggtgcccacctccgggaaatagaaaacaaaccccctctcccttcgtccacatctgctggagggtatacaggctcctagtaagctggacaagtggttttcaggcagcaaagcaggcctagtagtttccagaggcagccttttgtccctaccccgaagggtgtttagtccctgggtccttttccagtcagaaatgactaatgttggctatgtgtactctttagaaactgtctttggctttttgcataatggattataaataaatggctttagagaaccagcagtgagttattgagtgaacctggctttgggatggttcagattccagatagttaatcacatcctcttgggctggaagactgtatccaactcactcacattcagtaggcaagttaaaaaggcatttttgatcaacttgaaaaatagttttcacatcaacaatggcttgttactgaagaaataaagattatattaatccaagtagaattattcccatcactctctaacagtctggtggaatttaacacacctcttgttttaatttggccatttcttacaagtattaatgcacagtttgaaaatgacaatgaattgatatgtcctctttatagtgtttttatattaggcggtaggtaaaagactgttggtcttttcagcctcctaaggctcacctgctagatttgtacacagtgctctcttaatgctggaggacattatggactttctggtttgtcctagactattttaatgctatacaagggtaaactctgttgctgacaactgcttctggaaatcaggagcaaattcacttgcactctaccatattcattcctccggtttgttccactctggttctccctgaactctctccaccacatcagctttgcaaggttctctgatcatttgtatcactgaaagtcatatcttattagacagtcaagaaacataggcaatctaacaaagagactgcattagtccattctcacactgctataaagatactacctgagactgggtaatgtataaacaaaaaaggtttaattgactcacagttccacatggctggctggggaggcctcaggaaacttacaatcatggcagaaggtgaagtggaagcaaggcacgtcttacatggcatcaggtgagagagagcgtgaagaagtgccacacttaaaaccatcagctctcatgagaattccctcactatcacaagaacagcattggggaaactgcccccataatccaatcacctcccaccaggtcactccctccacatgtggggattacaattcaacatgagatttgggtgggaacacagagcctaaccatatcagggacagtaatggtgcctgaggaaaggctagttgcctgtgtgacaacagcctgatgaagttcagcttctaggagtaggtgtcacgaactctggggaccgtaagaaagaaacatatctgagattgacatgaactctggggaccataagaaagaaacatatctgatattgacaagaggagtagcagtagatggctccaacattggatgaggaattgattctatttttataatatgtcaagacaaaaattggctggagattaaaaatggaatcaaatcattaagacttttcacctttacctgtcaactggtaaaataaagtgttgttctttattttcattttttactgaaatcctctaccttctaagaggtagggaggatgaatactatctcaaagcagacaggaacagtgggtagattaatagattatagccctattgtgaaggctaacgttttaagagaaatgttttgccttgattaaaactatgagtatgtgaaaatgatgctggagtcttggtgcctacctcagaaatataagctgaatagtctagaattaaagactaaagaataaagaataaaccatcaggtctcgtgagaattccctcactatcacaagaacagcattggggaaactgcccccataatctaccctctttttccttgttggtatctcttagaatctgatctaattattcttttaattctttcttaaattaaggaataatttacatatagtaaaatgcacaaatcttaatgaatgtttagttatgtatattcccatatgatctgcagccagataactatgtagaacatttctagcaccccccaaaaattatgctcatctgcctttacaatcagtagtacagagttaaccattttttcaaattatcacctctcttctttaccttcatataaaatgaaatcatacagtatgtgttgtttttgtctggtctctttcatgcaacataatcttttagacattcattttattacatatattgcttttttttgactgctgtatagcatgtcattttttgtatgtgtatgttttgaaggacatttgggttgttcctactttctattattaataaagctgctgtgaacaatcaaatctttttatggacacgtgcacttatttctcttcggagtctctaagtatggaattgctggatctgagagtaggcatacagatttccaaaatggttgtacagctttatactcctgccagcaacgtagagagatcaaattgctgtacattctcaccaatacttaagtctttttaattctggccattctggtggatatgtagtgacactttactataattttaaatcacatttccctaatgaagaattatattgagcaccttttcagatgcttattgggtatttggctatctcttttagtgaagtgcttgttcaagccttgccaattgttaattggctatttgcctttttcttattgatttgtagttcttttaatattctggatataagtcatttgtcaggtaatatgtattatgaatattttcccagtctgtggcttgtcttttcccttttttagagctgaagattttttttattttgatgaactccaatgtatcactctttcctttatgattactaccttttgcatcctgcttaaaaaatttttgcccacctcaaggtcacaaagatatgctccatgtttttctctaaaagccttatgattttagtcctctcattgggtctgtaatccagctaacatttttagtaaaaatgtacatcagtaaaaatgttttgagtatgtgtccccagtatacacaattttatttatggatgatctaatttattatcaccaatattaaatattaataaagcttgatttttaaatttttgtagatatataaacagaagttccagtggatcaccttgtacacagcctgggatatatgtaccccattctgaacactattgttctataccaccaaagactaacatttgccacaaacactgatagcattaatgtcagaagaacacttcagtgtaaacaaatggctagaggtgacagagccccagtgagcatatctgctagcaatgtaagaaaccctcagtttactcttgtgccgtcacgtttgtctccccttaccagacttatagagacagcaggacgatctgacttggcaggagcaaagacaaatttgcctttggttgctgacataggggacagtgctcttgagtcttcttcccctgtcctcaccaccaaattcctagagctggtggcactgggctgagttttggcaaagatgcttagaatttgactggagctaatccccagggaaatttaatgatttggagcttagacggcctttgttgtgaggattagtaaactagatggtgattaagcagctggggaggaagaagctgtctgttgggctaggtcatgctgtggggcacagcgcatagttccgttggctcaaggtcaggggagcccttgggcctgattcacagagctttatactctggggcagctccttgtaggatttgggcatctgcttattagctggtagagggaaagaatggcttctcccttggtgtacacctcttccctctatccacatatagggattactcctttgaatcaggtctacttacatctttttaattggttattgtttttcaattctcattgaaaagtttttgttgtctgttttgccttttggaaaactggtgtaaagtacggaagatgaaattaggaacagagtttcttggttttctaatctagactgcttcggaaatttgagagcggtttttaagggaagaagttgctgaaagagacaagttaggtattgaaagccatggcaagaagactgccgaggtttgaaagcctgtatctcccatgtccagggaaccctgattaatttctcctagcatgatcagattctaagagataccaacaaggaaaaagagggtagattagaaacagcccccaacctgtggtttgcttaagatttcaaactaagtttcagaatgagcaagcactttattcattctttgatgctcctacttcttaatagttaaacttcccaaagccagcttaaccctagctctacatttttctattcgtttcccagaaaaggccaaattgatgaacggatgcctggagtgttagtaaaaacttgaaaatctttctaagatgctaaaaagatattcggaaggtatattctttctttaaataactggactacagtattctgagtggatcttttctgtctatttgcaaaaacaataaaacaaaaacaaaaaaacaaacacatcaatttaaacaattatgttgtttgccttctttagatgatagacaagctggtggaggtagcagtatgggctggtaatttggccagaagctcttggaactgaccaagaaagtttcagttgatgcccattttttccaataaatttcctgtagcaggcagaggtattcacaatcatgtcactgatttttaatgctgctcttacactattgtaataggtgttcagtacctgtcagttattgctgcagatggtgtttctcctctgaatgcatttttaaattataaacctgatttaataattcttctattccctttttcatctcctaaatgtattcaaagacccaagcaagtatctgttagtatctgactaaataaaagctactagaaagccagcaagtgctgttaagtcaattgttgtttgcctttactctcaaggggccaacttgtcactttgttgacagctatcagagtacttcatgcttcattgaagacccatcaaaaatttccaaattgctagctcattagcacaaaatagggcttcaggaatctctttctctcagtgtcctgactgggccttattaagtgttccaaccttggtggaccactctgaaacagtggataaagaccaggggaattgagagatggatgttaattagtcaattttgaaggagtaaaacatgggtgaaggcagagtacaatgggacaaaaagctgagattatctgtgtcagcagaaggataatgcatgactttgctaactgttcacaggtcactgaatgtcagagctgaaaaggcccagagctgtcagagccccaggagatcatctggtcagtccctcttacacattttaccagtaagagaagagaggctgcaagaagggaaagggacttgtccaaagtcaatcagctcttcctagctttccaggcaccacctggcttttggttatatgacctctatgtaatcaattttcaattacttgggccactcactgctagcccagcaatcacttgggtaatccaaaatgacacataagttaaccatcgtttacattgagctttgtgatgtgtgtttataccgacattccaatgcatctgggtctaatctgagaattcacaacacttcaactgaaacaagaaagccaccctgaaggtctgattcaggaagagctggaaagcttactgaatggatagcatcatatattgttatacagcccctcaaacaaggtatgttaatttcaacaagtttgttgattcacacctttccagggccccagccagagttaggaggaggaaggtgggaaggggaaaacaaaaccttttacggaagaatatgcatatcatctttcgcccctccatcccccttcacccttcctctcattcatttttccttccttccttcctttcctttttttattgatagaaacatgaacatctgctttgtcttccatataaacaaatatgtggctgagacattgacctatagaactggctgtaaggaggccagacaataaatagaagacgtgctagacctcagaaatctagaggtagagtggggaggagaaagaccagtgagcagtaatttaaaaaggaccaacaagtctggaagagtatagagtccattgcacagctcagtaaataccctgggtctggaaaagggctagtctgggatatagttgaagggatcttcaaccaaatggagtcttacttcctgatctggacccttctgaactcttggattatgctggggacccaaaatttgctggctttttgtctgagcatcttcagacttgcactaaagtaggattatttcacttaacatatctcttaaggaggaggatgctggtgactgagaaggggcatggaacagaaaaaaggggtatgaacagttggcctgatgctgtagtccaagaaggagtctgtgcaaggactcagatagtggcagctgaaggagcagtaaggaatgccaaatgcctgagcttttgctacagcaataattaagcattttagtttaaaaggttttccccttttatcttttggtctagaataaacagagatcttgctgctgtaacagagtgtttaattaacgaaagatggtacttaatacatattgaggggaagacttgctatgggtaacagtaatatggataattaagttgtatgaattaaaaacaatgggtagagtgaattaagactaatgtacatcaacagggaaaatctattagcattcattagttagacttctgtttgtggttctttgttagcctcgggaaactctttcaaatggctgatccctgttgaaagttctgactggtgctaagggccttctatggatgccaaagtaatgagtcattcaaatagaacttctgaaattcaagtacagcactttccttttctctctctctttttttcttggcggtaggcagcagtgactgtgaagtaataatgataatgacaatggaaataagagtgtaatcctgtttaatttgcttagagttgttccccatttaccaatattggcttgtttggtgttgagtgtggcccgggtaccggaacaaaggcatatatattcaatgtcacttggctaacctatgatttgtcagacaaaggttaatttttttaaaaaaaagttggattagcagcaataaatgtaataacattctgtgatttaactcagaagttcaattaattcgatggagtttaaaaaatcctgaacttaattttttctctgcactcaggaggtctcatctgccaaatttgcacatgagctggccaacctaaagctcaacaatattataacttccatggtgtggggatagatggaggagacattataaaagactgagagagagattggaacaagagtagaagtgtaaaaatacctccagtgaataccagcccttaattgccccatttagaatctgccatcccctaaggactatacaatttaattatccttacgttccctttccctggaaacaaacaaaaacaactcctgattatatcagtgagttggagccttttttacctgaccgtcttagttgataaacaagctgtagacaactaatttctgcccctgaggctagaaattaggagccttgttcatttttatatctctagcatgtagcatgttgtcctgtacataatagaaatgtgattcaatacttaaggaatgattaatggatggatgagatgactcctttcatggattatcatggatggaattgatgttctaataggtggaaatcaccttcatggtaaaaggaatgtaataaaaatgaatgtataaaattagccataagcaaggacccccagagacattctgctttgctttgctttgcttttgcctgccccagtggctattatttctgcctttgctttcaatacccctcagtctgacaatcttcttccccagattgccctggttagtggaaattctataggctgtgttggaacagtaaatacccatatttccagctttctctgaatgctcactgtgtgtcagacactagaagcactgtgctgggcacatgttgaagagacatagataaagaagcagctacattgtacctacttgtatcttttgaatttgccattctactcacagaatgttgaactgtaagccactttccaggtcttcagagtcaactcccttgttataataatcagagctcatgttaattgaggacttactgttctcagatatatactatactaacaactctgtgaggtagctagtcttgttatctacatgtcacgtaggagggaattgagacacagatgttaagtaacttcctaagggtcacacagctaggaagtagcagagccaggattcaaacttacgtttgtcagacttcaaagcctgcccaaagataggaaagagcttaccaaaggtcattttgatggagcctagctcttctggctctaatttgtctgcacgttttggtaggccacgctgctgctttagccacatagtagggttcattccaagcatcagtttcgtatttagaagttctagtcttcccagttggactgctcattcctccagtcagggattgcattatttccatgttgcctccttcctcaaaggtttgcccaagctttgccttcagtaaataatgacctgtgatcagctcctgagctactcccaggagctgcctggagccattccccagtactacttgtggctccagggttggaagaaacaagtagaattttggggagaaagtcatctcactacctgctttctgttttgttctctgcaacacagattgaagatggaggcaaggcagctttgtcccagaagatgaggactggtgatgagctggtgaatatcaatggcactccattatatggctcccgccaagaggccctcattctcatcaaaggctccttccggattctcaagctgattgtcaggaggtaaggtacagggagattctccgtaaggtgcagaggccactgaaacttggttggtaataaagctcaatagagtcatgtctctatcaatattataaaggaaagaggtgtttcacttgaatagaattttgcagacaactgaagcagaatagcacaggagaaagagcctttggttcaaatcctggcactgccacatagacacataatcttggatatatttattagtcctctgcaagactgtttccttatttgctataaagaggactaaattactcattatataccaaagggctacctaatccagtgtttttcaatctccttctttataatacactatcattcctgaaccacatatcaatggagacttaaagagcccctactacagccatggaggctgtagcaaactcttagaaaccctttccttgaggattgcacagtctagcaggggacaaaatatacacatgtgactaagtagcagtatatttttaaagaaggcaataaagccttgtgtgtgattatcaaatggattgttcagacaaaaattgctgttagagaaagagatcactgcagaaggtattgatagggtaagacttcatagaggaagtggaatttaagctaaagggtgagtataatttgaaaaataaaccatcagaagaggaagacattgcaggtaagtgcagtggcataagcagaaggaagggaaggacatatttgggcacagtcattctgctaccaccaaaagcatctgcctattggtgaactttccacatggcttttctttcattttgctgctgcgcctttgctttgtattattggagctcagccttctccctttctattgtttttttttttctttatcgtatatacacacctaagtttttccatcttgcatcttcccacaatctcacttctccctctggctcctgccccgtctttctccttttgttcatactcagtctcaaaggaagagtctatagtcactatctccacttctccacctgccatttagctttccaccctctgcagccagaatttgaccctcagaactccactgaaactactctgtcaaaagctacaaattattgcctaattgtcaaagtcaatgggttatttttcatattcatcatatatggcatttaacattatagctctagattttgcccccaccttcctttatgaaactcaataccaaaaatctcacacagcaactcaatagcaaaaaaaaaaaaaaaaaaaaaaaaaaaatccaacttaaaaatgggcaaagacctgaatagacatttcttaaaagaagacacacaaatggccaacaggcatatgaaaaaatgctcaacatcactaatcttcagggaaattaaaaaccacaatgagatattatctcactccagttaaaatggtttttattaaaaaaaaaaaaacagatgctggtaaggatgtgggaaaatggggaatcctggtacactgttggtaggagtgtgaaatagtacagccaccatagaaaacagtatggaggtttagcaaaaaactgaaaatagaattatcatatgacctagcagtcccctgctgggtacatattcagaagaaaggaaatcatataaaagagatatctgcacccccatgtttattgcagcactattcacaataaacaagatatggaatcaacctaatccatcagtagatgaatggataaggaaaatggggaatatatatacaatggaatacgattcagccataaaaagaatgaaatcctgtcatttacagcaacgcagatgtaactggaggtcattaagtaaaataaggcaggcccagaaagacaaatattacatgttctcactcatatgtaaaggctgaaaagagggatctcatggagatagagagtagactggtggttgctagaggctgggaagtggggaggttgaagagaggttgatgatgggtataaaaatacagttagatagaatgaataagatctagtgttcaatagtttggtagggtaactatagttaacaatctattgtatatttcaaaatagctagtagagaagaattcatatgttctcaacataaagaaaagataaatgtttgaagtgatggatatcccaattttcctaatttcattattacacattatatgtatgtatcagaatgatacatgtacccccaaaatatgtataactgttacgtgttaataaaaaaaaaaaaagctcttactttttttttttttgaaatggagttttgctctgtcgcccaggctggagtgcagtggcatgatctcggctaactgcaacctccgcctcccaggttcaaacaattcccctgcctcagcctgctgagtaactggattacaggcatgtaccaccatgcctggctaatttttgtatttttagtagagacggagtttcaccatgttggccaggctggttgcgaacttcggacctcaagtgatccccctgccgcagcctcccaaagtgctgggattacaggcataaggcactgcgcccggccaaacctcttactttcaagatagtcagtttccttgttattttcctacatccctgtccattttttaaaaaccaggctctttactacctgctcttcctctgaccattccttaaatgttggtgtttcccatagttccaccatttttaacttaatgtaccctggaaaatctcacccagccctatagcttcaatttattttctatatctcctatgctccagaccatataaccaacttcctattagacatttatacttaaatgtgtcagagatattgcaaacacaacatgccccaaacctaacacatcatcatcttctcccaagatcgctatctatgaccaggaccactatgtatgtactcagccaaccaagtcagaaacacagaagccatctttaattattccattatcctcatgttctatatccaaatgatttatcctgaagagagaatatttaaggagaaaggctttggacctaggaagaatgaggttatgtaggatcccactgacttctattacctgctggtacctaagattaatccatacctgcccatgtacatggataggaggtgacatgttaagtaatgccttatataatagatacattatcactgattaaatcttggattggtcaagatttaggtcttaaataaggcttcttggaggggtaatttggtgaatttggaagcgtttttgttttggagttagatattcccatgtttgcaacttcctaggtctcttatatgacaaataataattcctatataatggcattattgtgatgattaaataagataatttatgtaaaatgactgtcacataatgggttgtcagtgaatttcattcccatttgtttccttagggtctaaaagaagcataattggaataaacaaacattgttaaattgggagagcatcagaatggtggtgtgctttgcagcctaacctgcagagaatgatgtgctaaggaatcattaggggtggcaatgatctgaataagaaataaaggcccctgtgagatgctggttgtacagagacaccagcaacttagagggagtgtgaacactatctagagtgtcttctgagccagtcacaagaatgagagtgttcaggtgtttcacccactcatctcgccagggtgagttccatgtcctctttcctcatactgtagcaacatctgccactatcagtcacttaggagtggctataattatgggcttggactagcagggccctttggttttcatggtgtggcaggtcctatggctcccggaacctgtattttctacccttttagcctccccatctcagcccctattggtgaaggcttacaatgacataatttattaggtgatgctgccctcttgtggaaaacttaaccttcacatgtggactaccttgggcacggtataggaaattaattccctctcgttcagtccaaatttttcgtcaactttatgaaagagctcttaacacgtaaaagaagtgtgattaccctaaaatttgtgaatattcagcctagtgttttatacaggtagaaagactttggtttgagtaaacaatcagctgacaaagatccaacacttagctttaggtctgggcttgagtccttttgggatgaatataaacagaaggaactttagaacatggccaattctgaaaagccaacccagctcttcttcctatattgctgtctagataatggtcagctaaatcagaaatgtaggtgtcaccctcaactcctctctcacccaattcaattaattccaagtctacatagacctcttggttgcctttgtcttaatccagccactcatgatttctcacctggactattctaagagccttcccactggcttctcagctttcagtctcactttttcctaatcaatccattctccaaataggtatttgagcatgtcacttctctattaggaaaaaaaaatcaggaacaatgaccacacaaccatgttgatcccaagatattcattttatattgattgatgatacaaaccgtattgaagatattatatttatgaaccattttttttttgcaaaaaacatggcatccaaatatataaagaaaaaactgtcagctatacaaaaagtgatagaaacttctgtatgggagagtttaacataatttaattgacaataaagtagaccaaaataaagtacttagaagatttgaaaaacaattcattagatccaattaatacattttgaaaattgtttatagactgcatattgtctcttcaaatattgagataatatttttaaatgatcatatgtatgtcacaaagaaaagctttgcaaactctttttttgagatagagtcttgctttgttgcccaggctagagtgcagtggcacgatcttggctcactataacctccgcctcctgggttcaagcaattctcctgcctcagcctcccaagtagctgggactacaggcgtgcaccaccacacccagataatttttgcatttttagtagagacagggcttcaccatgttggccaggctggtcttgaactcctgacctcaagtgatctgcccgccttggcctcccaaagtgctgggattacaggcatgagccaccaagcccagcctacacacgcttaagagtagaaatatctgatgataatgtacaatgtttacaatttaaaaacaaattttaaagtcttcaattacttgaatattttagatcacatttatatgtgaatattagcacaaagaaacactagcagactaacaaacaataataaaaatgagatcatgacttaccaaaactttgagaatattcagaagtaaattcataaccttaaatattttattattaaaaatgaagaatgaaattaaatgactaataattcaatataatatgaaaccaaggactaggtttcttttcagagggatgaattaaatagataagcctttagcaaatttaatcaagaaaacaaagatgaattaccaataaaatttaaatgacaaatggaatacaacaacaaagaaagattttttaaattaaaggcgcactactataattgtaccttaatatatttgaaaatctcagagaacttaaaaatatctaataaaatattaaatgccagaaattattgagaagttgaaaactaaatggacatgtaacagtagaaacttcgaaaacaattatcaaagagaaacttccaaaaatactttagggacatctaaaaatactttagggctttaagggacagatatttttatctgtgaattccttcaaattttctagaaatagccacgtttaattctataagtatgttatagtattgaaaatgttgcagaattattcacattgtttttgaagctagcattactctgataccaaaacctgacagactgctctaagaaagaatattctatccaatttgtgaatttagatgcaaaatatatacatggaattctatgaaatctaattcaatagtataggacagtaacaattcattacaagtattaaaataatttttaaaaggcaaaattttgattcttacgtagacaaaaaatgaacatgttaaagattgtatttcactcattaatgaggaaaacgtaaagtgttacaaccagttcaaaggagaagtcaaagagtaacaaatttaaaggtaacaatagaccacagtaatcaattagaagctatatggagaaatttatgtcattcgtaatgggaacaaactcataagcaatcaggaatgcccttaagaaatatgcatgaaagaaagaggttgtgtatggaggaaattacaaaaatgtacagacagagaaaatgaacacaagtaatttttgatgatgtgggtaaagtcttagggtactgtattactttttcttacaaaaaggcaagatacaattgaatgtacagtatattgacatattctggtttagccatgctctccatagacaacttccgaaccatcattcctccaccctcatgtaagattcccttcatttttgaagctcagacaagcagggattatcactctcatttccttaccaatgtcatttatcagcctccaggttattctttcacttccattttttaatttattttaactgatacatagtacgtatttatggggtacatagtggttttccaatgtgcaatgtatagtgatcagatcacagtaattagcatatctattatctcaaacatttatcatttctttatgttgggaacattcaatatcctttcttctagttatttgaaaatatataatacattaatcttaatgctggtccaggatctagataccaggttcatataataaaaactagattttttgctttttgatcagtgtacccaaaattgatcagttatttaaaaacagtctttcaaatatccataatcataataaactgaatggaatgtcatatgccaatttaagtgaccacgaaaaatataactatcaagaaaaccagttactcatagttcctacttccctacatgaggatgtgtaaaaaaaaaaactcctgagtccttcctatgtgtcatagagtgtactaggtgctgagaacgcaacaatgaacaagcagcccctgtcctcatggttctagtctaagggtcattttttttcctctatagagccaaataaatattttaggctttttgtgtcacacagtctgccacaactcaattttgccattttgtattatttaacaaatctctgtatatccctcccttccccctaccttctcaccctctagtaacctctgttctactctttacttctatgagatcaatatttttagcttccacatatgagtgagaacatgtggtgttcaactttctgttcctggcttatttcacttaacataacgtcctccatgttgctgcaaatgacaggatttcattctttttatggctgaataacactccattgtgtatatataccacattttctttatccattcatctgtttttgaacacttagattgattttatatctcagctggatactgctgcaatagatatggggtatagatatctctttgatatatatatacacacatacatacatatatgtatatattttaaatggttggtggaaaaaagaatcgtatttcatgatatgtgaaattatatgaaactcaaatgtaagtgtccataaataaagttttattggaacctattgatttatgtactatctatgcttctttcatactaaaatggcaaaattgagttgtggcagactgtgtgacacaaaaagcctaaaatatttatttggctctatagaggaaaaaaaaatgacccttagactagaaccatgaggacaggggctgcttgttcattgttgcgttctcagcacctagtacactctatgacacataggaaggactcaggagttttttttttttacacatccttatgtagggaagtaggaactatgagtaactggttttcttgatagttatatttctcgtggtcacttaaattggcatatgacattccattcagtttattatgattatggatatttgaaagactgtttttaaataactgatcaattttgggtacactgatcaaaaagcaaaaaatctagtttttattatatgaacctggtatctagatcctggaccagcattaagattatgaaaaggaactgccatatctttgagccttgtctaggccacctgccagcctccctagctgtcctgtctttgttgttgtcataatactcctgccatctataattaaatggaaggggttacaactgttgaaacttgttaaaactgaagttgtcctaccatgtattaatataccagggataggaagatgtttacagttggcacagtgttagagaagtcctggaaaggcaagagagagaaaaattaaaataataatataaaacagaggtggggtaaactatggtctgtggccaaatctggcctgctaactagttttccaattaacattttattggaataaaagcaactggagcaggcatgctgatctatctatgtgttgtctatagctgtttttaaaaaaaaaaaaaaaagacaccaaaatggcaaagttgaatagttgcaacagacactatatagtctacaaaacctaaaatatttactacctggcccttcacagactaagtttgctggcccctggtataaagcattctccaaaaagaagaccttgaggctctctctaaagcttaaaaagactgaaagagaaccatcgtagtctacaagtgagaatgaataaaaaaatcacagaatatttaagccaacaaacatggtaggcaaactgctggattcttgagattcaattattcttttgaatttgggcaatgatgtggttggtacagggtaaaatgaatggtatatgggttcacacaagtgtgtgtttgcttgcctgcttccttctgttcacaagatatttattaaatgctacttccatctagatacggagttagctgttggggataccatggagaataacatagacacattccctgcccacatggagcttataaatctgttgtgtttgactctggcacgacccctacaggttgtgtgactttgagtaagtttatataacctcttttagtcattcttttcccatccgtatgataagaacactaatgtctcttttgcaagtttgttataatgatcaaatgacattatatacacacacatataaaatatgtgtatatataaaatatatacatatatttttcaagtcattcaaacaatattgaaaactatgtgctaagcactattttaggtattagtgatatatcagttaataaaacagatttaaaagaaaatcttgccttcatgtaaattaccttttaggtaaatatatgaaagtacctgaaacagagtagccatttggtaactgctcttttctttttcctaagtaaaaggaaggcagtacttatccttcagtactgattttagcaggcagtacaatactggttaaaacttcatccggccaggcgcggggactcacgcctgtaatcccagcactttgggaggccgaggcgggcggatcacgagatcaggagatcgcgaccatcctggctaacacggtgaaaccccatctctactaaaaatacaaaaaaaaaattagccaggcatggtggtgggcgcctgtagtcccagctacttcggaggctgagacgcaggagaatggcgtgaacccgggaggcggagcttgcagtgagccgagatctcacgccactgcactccagcctggaagacagagccagactctgtctcaaaacaaacaaacaaacaaaaaaacttcattacacaactcatagaccaggtgttattatcaatcacatagtaccctaataattgtcaatcagaatgatcattaggttggatagctcaagttgtgaaaatgactagttctgaattcattcatttctcttttcttaaatgtgcctctttgccattgtatactatttcttgatctagaaagttatctacctctcttgccaaaacaaaggccaaagtcaagcttcaatcaaaggaaaatgtactgctagagctaaaagaggtttctgtaatcaccgtattcagtgacctcattttataggtgagaagattgaggattagaatgagaaaggactttcctaaggccacacagcgacagaggtagactagactagaaccagcagcttcttcttaccagtcaaggtttctttccactgtttctgggatgtttcacatttgctacctcctctaggaagcctttctatacttgggggaaatgtctcctttctgtacctaaagtaagtttgtgattctatcctttgccttaactttttcctctgccaattcatcttttatgaatttatccacttccaaaggtttcacctctctcctggatataggagactgccagatctctcttcccagctttcccttcttcctgagctccagacttccattccaaggtgtacattaacccttacccaaccaaccccctccagtgtcctaatatctctatttcagtctatggcatctttcccatccttgtcaatcaagctcacaatagtagaatccacttaaattccctcttttattcccagcagtcaccaagtcctttctgagctccctgtgcagtgtttctaatatccatctcatctatttccttttccttcgtcctgctactgccagggactcattacctcttgtctggatgccctccaacccattctctgcacttctgccaaattaatcttcctaaagtacatctctgtatttatttcaatcagcagtaattgtgctttgggtaaatctcatgagttatgaggtctctattgtgcttagcctggctcatgtcatttcctttctcaaaaaagctccaactgcctgcagaaataagtctaaatacttcatcccagcatttaagaccctgtatagatgaatctacgtgacttttttctatccttatctttctgaaacccaaaggggtatatcttaaaagagtttacctcctcacttggacatacccaattttttcacaggtgtcctggacctcattctcctccactttttaaagaaatcttgctcctttaatttccactctccctttttcaggcattttcaacctgttacccttctcttgtcctagttttttcccctaagtctacaaaccagctcaagtctcccattttgaaaacacctttcccagacctatagtcatctttaggtattgtgctcttttttcctttcacaggtaaactattttgaaaagcaatgaactccttttggttcctgtgttacttcacctctgtattagtgtcctagggatgtcacaacaaagtgacacagactgggtaccttaaaatagcagagattacatagttcaggatactggaagtctgaaatccaagtgtcggtagggccatgctctctctgaaggctctaagggagggtccttccttgattcttcctagcttctggtgtttaccagcaaccctaggcattccttggcttgtagacatagcactccaacctctgcctccatcttcacatggccctttcccctgtgtctctgtgtgtctgtgtctatgtggccttcttgtaaggtcaccagtcattggatttaggtcctaccttagtccagtatgatttcataataactaattacatctgcaaaggctctgtctccaaacagggttgcattcaaaggttctgggtaaacatgaattttgcaggggcaccattcaactcagtacaacttctcatcagcacttaacattgttgaacattattgtcttctaaaaattttatcttcctttggctccagaaacactatgcttcccctggtttttctttgctttctcttgtctattccttttttatggttcctcttcctctacttgccccttatgtattaatattctctgaagttctgcacaagtttctctactcttctaacactgtacattctgggtgatttaattcattccatgatttaatttagcaaataagacttctaaatctctcactccatcccatacctcactcccatttataccacttctttctaggtatcttcatttttataccccacacgtatctccaaaactctatatgttaaagtcattaacttctacctccaaaccctgataaaatctgcttctcctcctgtgtgcctctataaaggtaaataattcacagtgaacccagttttttcagctccttattgctatatctaattgagcaagtcttggccattttatatatgctgaaaatttctcaaacttcttctctcttgtttgctcactgcaagtctctcaatttgtttacctacctctagttttaccatgctccctacctcctgaatttattctccacagtgcaaccagagtcatcttttaaaatgcaaatctcatcatgaaatctttactcaccaaaacccttcaaagttccctattgtgttcaggttaaaatccaaactccttaatttggtgaacaggccccttgaaatagaacgcctgtttatctctgccatctccacacaagcctgcactttatgttatggccacattcaactgcttatatttctccaatgtattcgtcagagttctctagagggacagaactaataggatatatatatgcacacacacatatatataaaggggagcttattaagtattaacttacatgatcacaaggtctcacaataggccatctgcaagctgaggagcaaggagagccagtctgagtcccaaagctgaagaaattggagtctgatgttcgagggcaggaagcatccagcatggcagaaagatgtaggctgggaggctaggccagtctctgcttctcacatttttctgcctgctttatatttgctggcagctgattagattgtgcccaccagatgaagggtggttctgccttccccagcccactgactcaaatgttaatttcttttggcaacacccacacagacacacccaggatcaatactttgtatccttcaatccaatcaagttgacactcagtattaaccatcacatccagctacaacatattctctcatatctctgtgccttttcacattctgctccttcttcccaaaatgatgactgctccttcctcttctttgtttagctaactcttattcaacactcaagacttgacctaagctttatcacttctaagaagtgttagggttgatatccccagactgtattaagcttcctcccataaacaacaccctttaatttcctctatctagaatcgtaacagcctgtttacttgtctatttcccccctgtaaattttgggcagtgtccatgtgttgtttttcctcctatcttaagtatagtgatcatagtgcttagcagggttacatgctcgatactcattgaatagctaattgaatggaatgaatgtatgccaggcaagggcagtaagggttattgcagtgaggattagaggctgagacttttaggggtattgggttgtcaggcatccaaatacttgaaagctgagatagtggattcagcaaaggaaagagatagagtcaaagatgagtgcaaggtttcttgccaaattggattgagttaaaagatactagttacaaatgctatttataagaactagcatttattgagtgcctcttagacactgagcatttgactaggtactttatatgctttatatcaaaaagaaacaaaataatgagctagttttagacatgtggaatttgaagcatctgtaagacgtccaaatataaaggacgagtagacagttgtaactatggttcttgggtacacaaagaaaaaaatgactcaataattaaattgaaagttatttgggtcgatagtaattgaagccattgggatggatgggatcttccagaaacagtaatgtagggaggaaaagaagacgatcagggaccagattctgggggacatatgtgagctaaatgcaaagaggggaaccattcattcattcatctaacaaatatttactagagccatggtctgtgtcgggtactattttaggaactgggggtatatcagtgaacaaaatagccttttccctcatggagctgatattctaacaggaatgggagaagtagacaataatcacaaatacgcaaacatgttatatccattactggtaagtgctataaaggaaaataaagcaatgcaaaggcatataaaatgactaaatgtgggtgtggtaggagcagcaggggcaggggagactttagctcattcagggaagaccactatgaagatatttgaaccaagagttaaatgataagaaagaggcagccatataaagatctggggagaagagcattccagccagaagaatatcaagtacaagagctcttaaatggaaaaatacatgatgtattcaagggtcagaaagaaagctttaaaactggagtgtggtaagcaaaggaagcatgaaaggagaggaagccaggcatataatcacacagggccttgtaggctctggtaagaagttcaaatgtgtacaaatgtattctatttgcagaaggaagctgttagagagttctaagcagaacagtggtatgattagttttggattgatagatgatcaccgtggctgctgtatgggaaacagactgtagggggcagagaggaagcaggaaaacttgttaggaggctacttggaataattcaagcaagagatggtaatgagtcggatttggattttagtgatggagatggtaaaaagttgttagatttaggatttgttttggaggacttgctgatggatcaagtgtgaattgggcagggctgtggtagggaatgggtaggcaaggactaaatgcttccttgggttttgacctgaataactgggtggtaccatttactgaggcgagaaagactggaggagaaacaagttttatgggtaacgggaagaagtaggaaagaagtagcttggttttatacacattaactttgtaaatgtaatgacatgtctattggacagctacatgctaatgttaactaagaaattaggtagaagagtctagaattgagaaaataggtcaaggttaaatatttaaattttggagtcaccctctgataaagctttgacaccaggtgagaacattaatgggttaagtatattataaaatggtattaatataaaaattcctgaatttgataatagtactgtaattgtataagataatttctctccttaggaaagacaaactgaagtatttagaggtaaaggggcatgaggtctgaaactctctctgaaatagatgagtaaatacatacatgcatattaatttatatgtctagagagagagggagtgaaaaagcaaatgtgacaaaatgtaatcagttggtgaatctagataaaggctacacaggaattccttgtactgttcttacaactctatcatacattttaaattatttcaaggtaaaaaatatttttaagcctaagttggaccagttgaggaggcagcctctaattttggcaggagctaaaaccatggacattaaaaggaaattaaatcttgataaaataaagttacctttaatttttttaagtgtaggcagcaaagaggagaggtccttgtattgagccctgggatactccgatatttaaagatagggcagatgaagaaaaacccaaagaataatctgaggagaagtggccagtgaggtaggagaaaaaccaaatgagagtggtatcccacaatgcaagtgaagaaactgattcaagaaagagggagtactcagctgtgtcaaatgttgatgagacattgattctgagaattgactattgattttggcaacatgaaagtcattggcaacccagagacaaaagcctgaatggattgtttcataaaagaatggacagtgaagaagtgaaggtagtaagtctttctatgagtttagttgtaaaaggagtatagaaaaataagagtgttagctagagaggcaattgggataaatatatggtgatttttgtcggttaataaaattaatttttaaaagaaaggaataagttccagtgtctgatagcacagtagggtgactatagttatcagtaacttattgtatatttcaaaatagctttaagagaagatttggaatattcttaacatgaagaaatgataaatgtttgggtgatggatattccaattactctgatttgatcattatgtattatttgcatgtatcacaatatcacgtacccccaaagtatgtacaattattatgtatctataaaaatacatgcacacaaaacaatatatatgttaaagggacacattcaataaaagtatattaaacataaggggaaattttaaaatcacaaatattaaatatctgactgctaatggaaataattcagtagcaagggagaaattgatggtatagaaaagaaatggacagcatagacaaatataattgcagcagcaaggtccttgggaagatcagagcagaagtgcggagttgaactttgttaaggataaggataattcacccatattaagaggagataaggcaaggtaggttggtgatgcagcggtggaaagaagaggaagttcttttctcaatgcttatctttttaaatcaactataaggagaagctgtctgctgagaggaaagggagaaagtggtgtaaaggagagaaagaaagggcactcagaaatgtaggaggagacgtgggagagtggtgtcatggaaaccaaggacagggagaggatttcaagaaaaagcagtccaacaatcaatagtgctgaatattcttgcattttagttggatgaatattgaaaaaagactattgagtttgctaattcagaggttactggttgactttggcagaaaaggctttattaaaacattatgagcagaggcccaatttcagtgaagagtgaatgggagatgaggaattgtattttctttagaaaaggagggtggcagggggtaaattggggagagggacctatttatctcctgtattagactgtgaattccttgagagagaacatgtcagattcactagggtatgacactgctagttttcaacaaaagttgagtgtgagagtgaaggaataagttctgcacccagatagattcaacaaaatcttctaagatgttcttctgaattggatctgttctgccagaccctcaaaacatgtggttagaaaaaaatcactgaggaagtacttctgtaccctagagaagtagaagagtggaggtgacaggatgtcattgaaatgcaatttgtggtctctggacacctgccccactgcccaatgtataggaagagacctggaaggtctgacctcagaactgcaagaaattagttggtgttttctgcatagggtaggaaatactgagatggctagaagttatggtggggttgcagttttgtctgctgagtttagcttaagattaggtcagccatggtggagaggggagagaatttgttatgataggcatatagctatatttgaaggatataaatacagcagcaaaagaggaattgcatagaatgagatcagggtagatcagagcttaattagatgaaatcaggacaagggctgtttaggctgactatcagagaaaccatcttgatgctaaaaattactggagcgtgggctaacctttgagaggaaatggtggaaactttgccactgagtcatttataattatttacaattatacaggacaattttgttgaaaaataatgtagcataatacaaggagtggttttgctctgttcccaggatggaatggatgtgacttaataactttttcctacgctaatttggttgattgtgtcagagaaaagataggttggtcattttgtttttccccttttgaatgactcatacttgagttgatcacagccatacaaccaaaagaatacccactgattaggcagataacagaatgtagaatgggaagtcaataggttgacttagaactcagacttacctaaaacttggagaattggtcaggaaccaataagtttccataaagctaggccttgtgtttttcaccattaatctccaggacgtggcttcagagcctggaatacagtatttgatgaataaacaaatagtcaatgaatgaatgcatgaatgtcactttgggaagaacacctaggaccaccagtataagattagcagtggactgataagttggacgtctgccttaatatctctgggtccattttctcacctctttttcactgatttctactgaggatgaaatgagagcatgcagatacttagaatttagcatctttagaagtattagctgtcttttcccctttatttttctagactcaatctcaccagtcaaatcaaactttatgttttaccacattaggaagagagaaaattatgccttttgtctattaaaaatcctagatatcggtgttgagatatcttagattgacattaaccaaaaccactggcaattgtagaacaatttttaaaaacaataaacagctaaggcactaccaggtatgatactccttcactttgccttttatcagctcatcccaaatcttaatttaaattcaaataaaatgaaaatgttctctagaagcatgttttcatccttgggcctcccttagtatccaaaatactcaagtctgccattctcagggattaactataattcatactgtgttggccattgatatgttcccctagccttgactattggagctaactagtgggaaactccaactttacctgttcaacatctttgctttcagatttccttccaccattctttgtccttccacaccagacagaatttatagaaaagggaatagcttcattaaggaagtgatgccactatgtatgtaaaaatcccgtttctctctttctttaagcaggaaatattttctatttttatcctttgcattacttttcttccttccactttgctgcttttcaagctggaattaagagacaccagtttaatttggatacaataactggacttgattaatattccggtacagctcacttcctttaacaacagggcctgacactttttttttctctgaaatgtttttttcaagggcttatatcccttgcacagaacagaatgttttgaacaatatttaaacgcagtttttgatcagagagttaaagtgatcctatcataatagctaaagatgggtacaaagaatttggtgagcaatcaaggaagtgatataaaataattaatggatagaaaagtcattcaagtgaaggctttgtgaaagaatcaagattattcaacccagagaagataaaattttcaagcccttagaaatagccacttgccatggatggtttcaaacacaaaaacaaaacaaaaccaaagcaaaattgccgacttaactcatttcacagccaatttaatgtccataggggagttttgccttgcaaaataaataagctgtgtatttgattcttcatatatttgttttgtaagacaagaagaagtgatttaataactgctttcaaggactagaaaaaaaaaaaactacttttctagaataccaggaattgaatcccataatcttatccacatctttttccctgtcaaccctagggcctcccatcagccactttatttgtcttgaaaaatctacttccccatgctgtccagactggaaaacataattccatgatacacacaatagggtatctaactgtcttctttttccattaagacagcacatgaagaaacagtatcatttgtagcaggaaggattttagctaggtcttctagagaactaaatcactttctgcagtcagtaataaatcaccaaagaaagctatggaattttctttactgacttcagcagatccttacctccccagagatgctatgtggagatagaagagaagggagttggcagcaatggctgagaaatggcagccttttcatctctttgtcttattcaagccagagttctctaaatgttaatgcattgaggggaatctaaactagttttgtgaagaccgaatggcaaatagtcaaaaaggaacattggactttgctctatcaatttttttttgtctctcagacacccagcttctcagtgtgccctttcagtatgtaacataatttactactatagcatcaactatttgaatactgatgcctcacacatttacatctctagtccagaactattttctcaatactaacttcatatttccagttgtctggaggacatttttgccaagaaacacaggtacctcaaactcaatatgttttaatactttccccccatccagaaacaagaatgccctctcctcctttcctgttcctgatcacatttaatggtcctagtcctttaaagtaggaattcaagaagcatcttgatcccctcttctctcagctacccacttcacctttatcaaatcagttaccaaatcctgttggttctacctcagatatgtattcattcaaatctcatttttcaaaacttttattgtaagttcaggggtacaagtgaaggtttgttacataggtaaagagttaataggtaaacttgtgtcatgggggtttgttatacagattatttcatcacctagatattaagcctagtactcattagttatttttgttgatctctccctcctcccaccctccaccttccaaaaggccccagtgtgtgttgttcccctctctaaatgatgacaacgtatggacaaatctcatacatttagcctccttgaacatattaaccgttccctgaatacagtgtcctctcatgtctctgcctttgcagatactgttctctttgcttagaatagtgtcccactcctttacctgctaagtctctgctcattgttaaaggtttctgctatgtattacaaactgttcctcatccctacaggagagctccgtcctctgtgcacttaaccacatctcatcataactgttagtttagatattgcttttctctactaaactatgatttccttgaagacaggggctgcattttaattatctgtaaagtctcagtatccacaacatgatagtctatgttaacaattaatgaaggaatgaatgatgtaactcaaatccaatttatcggtttttcctttgatgaattaatatatacttttggtgtcaagtctaaaaactattttcaatgtcctagatcccaaattttttctcctatttttttctaaaatatttatagttttacatttacattacctctacattaagtctatgatccattctgaggttttgtgtgcatgtttaagtatcagacttaggtcgaggtttgtttttaggcctgttgttgtctcattgttacagcaccatatgttgaaaaggctatctttttttccattgaattgcttttgcaactttgtcaaaaataagtttggcatatttgtgtgggcctatttctgtgttttctattcgattccattgatatatgtgtctgaccctctaccaataccatacagtcttgactgctatagttatcaaagtcttgaaattgggtatattgattcttactttattcttctttttcacaattgctttatcctagttgctctgcctttctggaacaattgtgtctatatcaagaaaatatcttgatgagattttgataggaactgcattaaatatgtataaacatttagagaggattaacatgtttactatattgcgtcttctaatccatgaacacagtgtgtcttcctattcatttggatttttttcttttttcagcattatgtggtttttagcatgcataccctatacatgttctgttagatttacatctaagcatttcatttttttgcagcaactgtaaatggtattgttttttatttgttttcacatgtctattatttgtatacagaaatgtgattgcttttggtatgttgatcttgtatgcttcgtacttgctgaacttgttttgtttgtttgactgattgattttgttagttttagattctttgggattttcaacatatgttatctccaaaaagcgacagttttattttatcctttccaaatctgaatgccatttatttctttggttgcttactttatctgctattaatatagccattctctctttcctttcattcacatctacatagtatattttttgtctttgtactttcaacctgcttatattatttgaagtgaattactgttgacagcatatagttgaatcatgtgtttttatgcactctgccagtctctgtcttttcattgatgtgtttagaccacttacatttcacatacttattaatatgttagggcttaaatcttgttttgttttctctttgttctcttttttactttctttactttcttttttctctgccttacagtaggttacttaaacattaattagaatcccattttgatttatctttagagattttgagtatatctcttcatattgattttttagtggttgctataggtattagatatacatcatgtatcacagtttattgatattgtcattttaccagtttgaagtatagtaactttacctttctttacatctctttatgcttctctttttacaataaaattatcttaaatatttcctttacatacatttagaaccacatcagacaatgttataatttttgctttcaccatcaaacataacttagataattcaagagaaaaaggaaatctattttatttacccatatacatacatacatattttctatgtcatttcttctttcctaatattccaggaatccttcttttgtcatttcctttccatttacagaacttcctttagccgtacttttaaaataggtccaccagtggtgaatgctgttagttttgcctcatctgagaatgtcctgatgactccttcattcctgaaggatattttctcttgacataggattctggattgaaagttcttttctttcagtagttgaaaaaaatattgtgccacttcctctggctccattgatttctgatgagaaatatgatgtcattcaaattatttttcacatatcagtaatgtgtcacttctttctctctgctttcaagatttttttgtttgtctttagctttcagacttttgactaagatgtgtcttggtatgaatttctttgggtttatcctgttgggattttcttaccttcttgaatcttcaggtttatgtcttttgccaaatttggggaagttttaggtattatttgttcaagtatatttttagtcttgctctgcttctctccttctagtacttcagtactatgaatgttagatcttttggcatggtcccaaagatccctgaggctctgtttattttttcagtctattttctttctgttgttcgtattgggtaatttatatttttctatcttcaactgtactgattcttttgtcttctccattctactgttgagattacaggcatacctcattttattgcactttgctttattgcactttgcagataattatggtttttacaaattgaaggtttgtggcaacctgtgtcaagcaagtctattggcaccatttttccaatagcatgttctcacttcatgtctctgtgtcacatgtaattctcacaatatttcaaactttttcattactatcatatttgttatgatggtctgtaatcaatgattttttgatggtactattgtaattgtttggggcaccacaaactgtgcccatataagatggcaaactgaattgatgtcaaactgtcaaattgatggcaaactgaattgataaatgtcgtgtgtaccgacaggccattcctctatcactctccctctcctcagacctccctattccctgagacacaacattgaaattataccaattaataaccctacaatgccctctgagtcttcaagtgaaaggaagtgtcacatagctctccctttaaataaaaagttagaaatgcttaagcttagtgaggaaggcatgtgaaaagccaagatgggctgaaagccaggcctcttgcaccgaacagccaagttgtgaatgcaaaggaaagttcttaaaggaaattaaaagtgctactccagtgaacacatgaattataaaaaaagtgaaacagccttattgctgatatagagaaagtttcagtggtctgcatagaagagcaaaccagccacaacattcccttagccaaaccctaattcagaaaaaggcttgaactttcttcaattccatgaaggctgagaatgctgaggaagctgcagaagaaaagtttgaagctagcagaggttggttcatgaggcttaaggaaagaagctgtctctataacataaaagtgcaaggggaagcaccaagtgctgatgtagaagctgcagcaaattatccagaagatctagctaagatcattgacgaaggtggctacactgaacaacagatttttaatgtagaccaaacagccttatattggaagaagatgccatctaggactttcatagctaaaaacgagaattcagtgcctcaatttaaaacttcatgggataggctgactctcttgttaggggctaatgcagctgatgacttttaagttgaagtcattgatcatttaccattccaaaaatcctagggcccttaagaattatactaaatctactctgtctgtgctctataaatggaaccaaacctggatgacagcacatctgtttacagcagggttactgaatattttaagcccattgttgataattactgctcagaaaattcctttcaaatattactgctcattaacaatgcacctgatcacccaagcaccctgatggatatgtacaaggaggttcatgttattttcatgcctgctaactcatccattctgcagcccatagattggggagtaattttgactttcaagtcttattatttatcaaaaagtgggcgaaagatatcaacagacactcctcaaaagaagacatttatgtggccaaaaaacatatgaagaaaagctcaccatcactggtcattagagaaaggcaaatcaaaaccacaatgagatgccatctcatgctagttcaaatggcaatcattaaaaagtcaggaaacaacagatgctggagaggatgtggagaaataggaatgcttttacactgttggtgggagtgtaaattagttcaaccattgtggaagacagtgtggcaattccttaaggatctagaaccagaaatagcatttgacccagtgatctgattactgggtatatacccaaaggattataaatcattctgctacaaagacacatgtacacgtatgtttattgcagcactgttcacaatagcaaagacttggaaccaacccaaatgcctatcaatgatagactggataaagaaaatgtggcacatatacaccattgaatactatgcagccataaaaatggatgagttcatgtcctttgcagggacatggatgaagctggaaaccatcattctcagaaaactaacacaagaacagaaaacaaaacaccatatgttctcactcacaagtgagagttgaacaatgagaacacatggacacagggaggggaacatcacacacaggggcctgtcagagggtggggggctaggggagggatagcatcaggagaaatacctaatgtagatgacaggttgatggatgcagcaaaccaccatggctcatgtgtacctatgtaacaaacctgcacattctgcacatgtaccccagaacttaaagtataataataataaaaaaagaaaaaaaaagaaatgcattttgtaaggctatagctgccatagacaatcctctgatgaatgtggccaaagtaaattgaaaatcttatggaagggattcaccgttttgatgtcattaaaatattcatgattcaagggaggagatcaaaatatccatattagcaggagtttggaagaacttcattctacccctcataaatgactttgaggggttcaagacttctgtggaagaagtaactgcaaaggtggtaggaatagcaagagtactagaattagaagtggaacctgaagatgtgactgaattgctgccatctcataaaaccttaacagacaaggagttgcttcttatgtgtgagcaaagaaagtggtttcttgagatggaatctactcctggtgaagatactgtgaacaatgttgaaatgacaacaagggatttaggatattcaacaaacttagttgataaaatagtggcagggtttgagaggattgactccaattttgaaagaagtcaggccaggcacggtggctcacgcctgtaatcccagcactttgggaggccaaggcatgtggattgcttgatcccaggagttcaagatcagcctgggaaacatagtgaaaccccaactctacaaaaaaaaaatttagttgggtgtggtggcatgtctgaagtcccagctactcaagagactgaggtgggaggattgcttgagcccagggaggtagagaccgcagtaagctgtgatcacgccactgcactccagcctgggtgacagagcaattctctgaaagagaagagaggagagaggagagggaaatcctactgtcggtaaatgctgtcaaacagcatggcatactacagagaaatctctcagggaaggaagggtcaattgatgcagcaaactttgttgttgtcttattttatgaaattgccacacctactccaatcttcagcaaccatcaccctgagaagccagtagccatcaacatcaaggcaagaccttccaccagcaaaaagattatgactcactgaagacgcagatgatcattaacattttttagcaataaagtattctttcatcaaggtttgtacattgtttttaggcatgatgctattctacacttaatagactacagtgtagtgtaaacataacttttatatgcatggagaaaccaaaacaattcatgttactcactttatttcagtatttgctttattgcagtggtctggaatcaaagcaatatctccaaggtatgcctgtattcattttgtttttttattttgaatattgtatttttaagttctaagatttccagttggttcttctttatatattctacatctttgccaagacttgctaattctttgtaagtctttctgttttttcatttgtttcatgcatgtctgtcattactcattgaagcatttttataatgggtgctttatcatatcattctaacatttctgtgatcttgtggtgtctcatgattatctctctttcattcagtttgagatcttcctggttccagcatgatgaatgattttttcattgaaatctggatatttaggatattatgttttgagactctgaatcatatttaagcttgttttagctggcttcctctgacaccactctggcaagtgatgggggttgctgccatattactgccatgtggaggtagaaagtccaggctctccacttggcctctattgacacctgaggagggaggctgcttgtttctgctaggctttcactgatatctcccttgctgggagtgcctctgacaccacagagaaggggagtggcttgcttactgctgggcagtggtggaggttctaacaccccactaggccgcctctgaacaccacctcagctgggaggaggggctccttgttaccgccaagcggggagcggatgcctatgctccccatgtgttctccattaacatcatgagtaggagacttgttatcacctggcatggatgaaagtcctgtctctgtatttggtctttcctaccaacacctggaggaggagatttgcgacaccttattaatagcctagtcagagtggaagtctaggctccccactcagccttcattggcatgagggtggctggggccacagttttcctgtgctgtttgactggagtagagcagttattatctaaaagttttatgtcttggtgtctacccctctcccagtcctctggatagtgagagcaggctcttattggggcttatatttggtccgtgcccacaagtatttccaggttgttgcttctcagctccaaatctgggctatagaaggtaaaaagaaaagccagagaccttatcactgtgtcattccttggaactcaaggtccctcactggtttgccttcttaatgtaatagaaatcattttcattacattaacacccttctaactagattttttttactcctaagttttgaaatttcttttcatgttctagatactagtcctttgtcagaaatgtgttttgcaaatattttctcctaatgaatggtatcagaggcagtcagctgagagtcatcttatgtttgttttatacataatgtccaagggttctagttatattagtgaaaggaatgggagaaagttcatctccattttcccagaagcagaagtctcaataaataatgtttttgcccccaatcctaagatttataagtattacctccccatatctttaataaattttaaagttaaataaatatatttatttaaaacccaatatctttagtaaaacagctaaatgaagcaaaccttaagtacctaagctgtttgtttcagctgatgaaataaacgtgtgaattttgaagatgttgaatatgcctcaccagtctattacttaacaacttcaagcctcagtcttaaacttgggttctgataagcatgccaactctggatcttagcgcaaatgtcaagatcccttctggggattagtctctgaactgccgactttttggacatcaggccagtttctatcctgagtgagagctccaatctaacaagagtgcattgattgctttccagctaatcaaagggaaagcatgggttggctgttctggcacccttgttcagctaaaaatgattgtctctggctcctaatgcagagatatattcttccttttttctgtgatgaaggtgtagaatatccctcaattttgttaagtataaagttaatgaatgcctttgaatagtctttgagaagttatacatggtagttttttttttcctctgggggaaagagtagaacatcacctgcccttctctcagtcataaaaaaaggcttgatttaaatttacacacattgaaggttacttacctgaggttttccctctttgcacttcagaaagatatttcttaaagtacccatggcccttccaaaagaatggaatattttgaacaaaaattaaaaacttgttttggtgtatgcattttgtatgagattaagaaatgtttctcttgttatattcctgcctccccacctcctctctctctcagtatgtgtacctgtgtatgattcttttctactttctatttcctgggaaaggcctggagttgagtaaaggaaaagtttaaggatgagtaggagaggctgctcatgaagtgatgaagagtatggctggtctataatatgtgattcagaatcactattatgatgaatttcctagaacaagaagaattgctagaggcccctttcacgccacagtaagttatcaccataaaaataatttcttttcccctccccataactcatcagggtaaaagcttgcaatgaccattggtttgtcccagctagactgggaaagtagctctgtgttgcctgtgtgttgtatcccaggatctgagtagcttgcttggcctgagacctcatgccatcatggaatacaatagtgatagcaaaccaaggctcaaatggacatgtcagttgtctaagaccacaaagctagtaagtgtcagagctggaactcaaattcagtctctgtgtttgactccagatcccatctattttccctgtataaacggggctgagttttggagaattccattcattaggagtatcgtaattctacagctcactgtgatagtgccatatcagtccttggcccaacagttggtctgaaaatattaagaccaggaaaagataaacaaaattatccttagggatttcaatccagaatgaagagttcttccatgatgccttcccacctaacttagaggcttggccagaaccatgattactttcagatttaatagacactccgtaaatgttagttctgtccctctatcccagcacatacggtgggtgaaatacagtgctagcagctaacaaatgcatcatgtcatttaattggcacagctctcttatgaggtgtagggataaatacatccccacattacagataaggagactgaggtacgaagaaatgaagtaactgacatgtccactgtctcacagccagatctatctgacttcatatctagtttgctcatatctagtttgctctctgtagcacctcaattggttcctactgatgtacctacctacctctgtctcagcggtattttcagaggctttaaatgaaatattttgactgggttcttcagaaatccttatttgagtttaaaaatcaagttgtgcatgctttctcccttgcctcaccctgtgttatcctcagtagtaaccttgacaccccagtaaagcccagagaaaaagaaattgtaaattgatctgagaggataattgaggatttctaagttacccaggctttaactttgcctcgacctgagatgctcaccagtcttcacagaagaataaactgagttaattagctctttgattggatgagggttaaggttctaggtgtgggtctgcttgcaactaaagtgatgattgttggctcctaacgttaagacattagtagccatctgttgggtgaaggcatcctcttttctgatttgaagctaggtctcagtcagtggaaaaatgtcatttgtattctgcattcctcctgtttccttggggtatgctatgtttaataatgtatgcattaggagatgctgaaaagtgtcttttcagtatgtctttttaatctagtctttttctcccaataggtttaaattgtccccaaagtgtgtgtgtgtgtgtgtgtgtgtgtctgtgtggtgtgtgtggtgtggtgtgttgtgtgttttagaccaagtattgctggagaacacctcattatgtgtaggttattgcatttgtggagcaaaatctcccttaagtaatatatctactatgtgtcattaaaaatgtattcactttatatgtgcatgttttcaattcaggcatctttaatagggaaatatattctagtagattaatttacagttgtttctaaatagtaaatcataaacaccaataaaagaaaacatgcaaaatgtgcatatttgagagtcgattatatgttgattaaccttatgtgcttttgctataattcttactattgtcatttcccttgctgtcaaacaacaattcatttctggaacatatgatgcataattatgaatgttaatgcaacacccagctgcatctcatctccctttgcattatggtacaagtttactttggggacacaaaggtactttctctcattagtgacagaaactgtaattagacactaaacctgagataaaaatatactcattatttacctattttcttaattagaattttcatatcaaaagtacagaaaaataatctttttaattcaagtaagaacaatatgatcctgtttaaaaaataaaaatgaaagaaaaaatctgtgttgtggagaatagagcaatggacttgggggttttgaatgcaggctgtgagtactctgtagaagtagtagaaatactgggcaagtctttaaacatgtcatagtcttctctttatggtttcagagtaataaccttcacccgacagggatctggtaagaattaaataggtacttcaagagaaagtacctgatactgggtacatagtcagtgaatgtgtattgttgttcttaatatggcatttgagagttttttaaaaaggcattttccaaaattaattcaccaatgatctcttcaaatggcaaggtctcatgatacaatttcattgatttaacaaatatttttgagtgctgagcatgtatgttaagcaatgtggtggtgatcatagaaggagtatgctctagccctgtactctagttgagagagataagacatacataggcaaaatgcttgagcagggaagtacgtggttatcaaaatgagtgatgccagcagcaagtgattttgaagattagaggaagaaaacataacactatgcttgcaaacaagagggggagctttgcttaattcctaaatagttcataggaatgcataaaaaagggatggaaagaaacgtagttttgggaaacataaaggaggtccatccaacttaagatttatataggggatcagtgagagataaatgtgaacaatctatagaaggcccagaaaaagcaagctttacttagtaggccatggggaaccactgcaggattgcaagcagatgaataagtatgagattggaatttgtggaaaattggtgtgggttggattggatgtaaggagctcatgctacacaattgcttatgtagtacagggagcagtgacagtaggaatagacaggacaagttaataggtgaagatatttcaaagccagcacttggtgactaattcagtataaaggctgaagaagaggaggagtacacaatgattaccaggtttgagccagtcagacctttaaggatttaaaatgaacaaacaaaacaaaaatagaaagagctaggcttggcatcaatttttgtttggtttttgttgtttttagtttggggtgatagaagatatagaaagccagtgggcagttgtagggagtaggtagaactggtgtggtatttaagtgagaggtcaggactagagattgtcctggagccttagaatgaaatttctaatctaaattaatctaaattctacataaatatttgcaggtggtctcttcatcctaaaaacataatctgcccttaacctttaccctcatccaactaccaatttcttttccttcacagccaaacatcttagacattggctctattttctcacctcccatttcctcactacagtctgccttctactcctaccactactatgccactgtcctctgtatggttccaaggtgaattaatgtcttccagattgaaaaaaaatccaaggagcgtagtttcttctccttttctaatgtgcaatttttcagtaagtttttaagccattattatatggtagaactggtgtcaaatcacatataagctagatgacctttggtaagttacttaatcacagtttccttttctgtaaaatggggataatgatatttactttattacatgagtaaatgagctgatatacataagccctttggaaatagtagttgcttaataaatattattttgtttcatcattgcagctttgggcactgttgagcactttctagaaatttgttttcttttattatcataacacttttttttttttgagatggagtctcacactgtcacctaggctggagtgcaatggtgcgatctccactcactgcaacctctgcctcccaggttcacgtgattctcctgcctcagcctcccaagtagctgggattacaggcacaccccaccacacctggctaatttttttatatttttagcagagacgggctttcactatgttggccagactggtctcgaactcctgacctcatgatccgcccaccttggcctcccaaagtgctgggattacaggtgtgagccaccacgcctgacgcataacacttctttttccttgttttcctactactagttatcttgagctctttttccttaatttgtcttatccacagatataccctagaacagtagttctcagatttgaacatacgttaaatttccctggagagtttatattaaagaacatactgctcctcccctgtctccagagtttctgatctagtaggagctcaagaagttctcagataatgctgatgctgcgggtgtggggactgaattttgagaaccactaacctagagttctatctcagcctcattttcttattctatgaacttttattgaggggcttcaggtaccactgatgactcccagatttctatatctagggaagaacacatgcccagattccagattatcattttcaactgcatgttaaatttctacacacggagttgtcctccagacgcattacaatccaacatgcccaaactgattctgaagtacatatgtaagactagtcaggaaaggtctgaataaaagaggaataaaagacaaagcagctagtcctgttaaaacatattataaaattacagtaattaaaatactttggtactaagcacatgaatagactgatcagtaaaccgtaatgaagtctaaccatgattcaaagacaattgtttagtatataacttttagtatatgatcttatctttaaataagaaaagtctttctaagcaaaacacaaaacctgggtgctggccgggtgcggtggctcatgcctgtattcccagcactttgggaggccgaggcgggcagattacccgagctcaggaattcgagaccagcctaggcaacatggcaaaaccccgtctctacaaaaaatacaaaaattagccaggcgtggtgttggacgcctgtaatcccatgagaatcacttgaatcctggaggcagaggttgcagtgagtggagatcgcaccactgcactccagcctgggcgatagaatgagaccctgtctcaaacaaaaacaaaaacaaaaaacaaccaaccaaacaaaaaaacctggaagccataaaagagaaaattgttaaatctgacaacacgaaagttgaaatttaaagcacccgaaaaatacaaaaataaaatccaaagaaaaaaactggggaaaaggttttgcatctgatatggcaagaggctggttcccttaatatataatatataaagagctcttgagaataacaggaaaatgccaacaaaccattcaaaaaaggaaaaaagaacctgaacaggcagttcagacaaaaagaaagtgggcttataaaaacaaatgaaagatactctgttggcacagtgtctcatgcctgtaattccaacattttgggtagccaaagcaggaggattgcttgtgaccaggagttcaagacaagcctgagaaacatagtgagaccctgtcttgacaaaaagtctaaaaattagccaggtatggtggtgcacgccctgtagtcccagctactcagagaaggctgaggcgagagcatcacttgagccagagtttaagtctgcagtgagccgtgatcacgcccctgcactccagcctgggcaacagtgcaagaccctaactcagagatggagaggggaagagggagagagagagggagagagagggagggagggaggaagggagggagggagggagggagggagagagagggagggagggagggagggagagagagagagagagagaagctcaacacttacaattaaagcagtatagattaatttaagcaataagatgtaactttcacctatcagaatgggaaaaatcagagcgtttaatgtacattttttggggggcaggcatgtggagaaatacatgtgctcttataccttgctactcaaagtgtggtccttggatcagcagcatctgcatcaactgagagctttttagaaattcagctccaccccagatctactaaatcagaatctgcctgttaatcagatccccaggtgacttgtaggtatatgaaacttcgtaaagcactgctctgacacactgttggaagtataaattagcataacctctttggatcttagtatattttatcacaattaaacattgatgtactttttgacctatagttccacttgtaggactttatataaaatatataatcatgtatgtgtgtgaagacatgtaaaaaggtattaatcacaacattatttgtcttagcaaaagcaacttcagtattcattacttgagtaaaggctaaataaactataaaaagttcacttggtgaaatactattcagttatttaaaatttatttaagaaaagtatatgtggatacggaattatctccagtatatatcgttaagcacaaacggcaaggttccaagcagtattataacctgccttttctgtgtcccattattataattcccattttagagataatgtaagtgaggcagagaggttaaataactagcccaaggacatacagctggaaatggtagattcaaatacagacagtcttgttctagagcttatgttcttcacactctgccatattgctgctcagggataaacaacaaactgttaaaagtggtttcccctggagtatggggcactcctttttcattgtatatgcctttgtactatgtgaatggttttccttctacaagtattgctttaaataatttaaaaatacttaaaaactgcaatttttctaaaaccgaactaattctcctccccactcttctgctgatgctagcgacaggctgaatcataaactagagtgaaaaatctaatagacactgtatactccctcttatttatccctcacatctgtctcatcagctaccaagactaactgattttacctcctagaccagacatttctcaaacttgcccctctactctatccctgcattatacatcacttggactatagtgttcatttcctctctgatccacctgcatcttttctccctacaaaatgccaatggacacatctttccaaaatgtgaatctgattttactattctccatgttctggcccagtttgcctgtctggccttactgttcaccacttctcttcctcatatatcctaccctcaggacaccattgttcccctttcatttccatgattttaatatgctattccttctctagaagtacctttcatctgagtgaatttctacccttccttgacaaccagatctcaatttggatttccccctggatgcagactgttagtagacattatatattctgtattatgcatgtcagaatacctcaagtttcatgctccttcagtgttccataagaaatgtccccagcatcaaagcattcctgcctgaatgctgtgcattcacattccttgtagactcctctgctccccaacatggatgcagtatcctgcggactgcttctccagatctccccatggctaattcatggtttttctttgtcctaagttctctcctggccctcagcactcttcttggtcatgaaggatttctgggaggctttcccttttattatcaatttcaggttcatcatcttcccttcctatccctctacctgtacctgtagaggagggaggttagaatagtggttaagaacaaggaaggtctaggctgccaagctaatgaatttggacttttcccataagtactaggaagccagtgaagaattttaagcatgagagtggcaggaccagatttgcactctgaaaagatgtattcattggcattttgcagggagaaaagaggcaggtcaaccagttacaaaatgaatgctatagttaaagtgattcagggatagagtggaggggcagatttgagaattatatagtctaggaggtagaatcaataagtcttggtgcctgattagacagatttgaggggtaaataagaggagggagtccagagtatctaccagatttctcaccttagtaaatgtcacctgtcaccagcaccagcagaagagtgggaaggtgtcttagttcgtttatgctaccacaacaaaataccttagagtgggtaatttataaggaacagaaatttgtttctcacagttctagaggctgggaaatcaagaccaaggcaccagcagattcagtatccagtgagggctattctttgcttcaaaggtggtgccttgttgctgtgtcctcacatagaaggaaagcaaaggggaaaaatgctgtgtcctcacatagcagaagaagtagaagggcaaaagaggcaaactcttcctcaaacccttttataagggcactaataccatccctgagggcagagccctcaatgcctaatcccctcccaaggggccttatctcttaataccatcaccttgggagataagtcccaatatgaattctgaagggacatacatatttaaaccatagcaaaaaagaattagtttggttttgtaaaagttgatttttaagtgtttcttttttttttcccaaagcaatacttgcagaaggaaaaccattcaaatagtacaaaggcatatacaatgaaaaatgagtcctctacacttcaggggaacattgttaacataccataatgctatattattttccttctgaggaacatagattcacctacccccaccttcgcaacccattccccactgaatttccttatttccttactgcaaagatagttcaacatacacaaatcaataaatgtgatataccacattagcagaaggataaaagtcttatgatcatctcaatagatacaaaaaaagaatttcacaaagtgcaacatgctttcatgataaaaaaaaaaaactgtccaaaaattaggtgtagaaggaatgtgcctcaacacaataaggctatatatgagaagcccacagctaacattatattccatggtggaaagctgaaagcttttcctttaaaatagggaacaagacaagggcacccattttccccacttctactaaacatagtactgaaagtcctaccagagcaattaggcaagaaaaagaaataaaagccatatcaattgaaaaggaagaagttaaattgtctttatttgtaggtgacatgatcttatacagaaaaccctagaagtccaccaaaaggctcttagaaataataaaagaattcagtaaagttgcaggatacaaagttaccctgtaaaaatcaataatgtttctatacactaacaacaaacttagaaattttaaaaatgatcccatttacaatagcatcaaaataaatctaaaatacttaggaataaatttaatcaatgaggtaaaaatctgtatactaaaaactataaaatattgatgaaataaattaaagaggacacaataaataagacaaataaataaaaaataaagatattccatgttcatgggttagaagaattactatcattaaaatgtccatactgctgaaaacaatctacagattgaatgcaatctctatcaaaattccaactacattttttcacaggaataaaaaattctaaaatttgtaaggaaccacaaaagaccccaaatagctaatgaaatattgaggaaaaaaaaaaagctggaggcatcatactacctgatcccaaatatactacaaaactatagtaatcaaaacagtatggtactggcataaaaacggaaataccattcaatggaacagaagagagagcccaaaaataaatccacacatttacagtcaactggtcttcaacaaaggtgtcaagaacacataatggggaaagcacagtctcttcagtaaatggtgtcatgaaaactggatattcacatgcggaatgaaattggactcttatcctacatcatatataaaaaccaattcaaaattgattaaagacttaaacataagaccttaaactctaaaactactacaaggaaacatatggaaaagctttttgacatttggctttggcaaagattttttggctatggccctaaaagcacaggcaacaaaagcaaaaataggttggattgcatcaaattaaaaagcttctgtacagccaaggaaacaatccacagagtaaagagacaacctgcaggattggagaaaatatttgcaaatcatatttgataaggagttaatatccaaaacatataaggaaatcaaacaagtcaatagtaagaaaacaaataacttgattacaaaatgggccaaagatctgaagagacatttctcaaaagaagatatataaatggtcaacaggtatatttaaaaaaatgtttgacgtcactaatcatcagtgaaatgcaaatcaaaaccacagtgacatatcacctcacatatgttagaatgtctataatcaaaaagacaagtgttggtgagggtgtgaagaaaaaggaacccttatacactattggtagaaatgtaaattagtatagccattatggaaaacagtaggggggcttctcaaaaaactaaaaatagaactataatataagccagcagtcctacttctgggtatatatctaaagcaaatgaaatcagtatgttaaagagatgtttgcactcccatgtttattacagtactattcacaatagccaagatatggaataaatctaagtgtccaacaacacttgaatgaatgtgttataaatgaatgaataaagaatgaatttattctttatgatgaataaagatgatgaataaagaaaatatgttatataatatatatttcatatataaaaatatatgttatatataatatatatttcatatataaaaaatatatgaaatatatatatacacacacacatatacaatgaaatactatacagccataaaaaagaaggaaatcctgtcatttgtacaacatggatgatactgaaggacattatgctaaggaaataaaccaggcacagaaggacaaataccacatgatctcatatgtgaaatgtaaaaaagctgaactcttacagagcaatcccattacttggtatatacacaaaagaaaataaatgtttctaccaaaaagacacctgcacttgtttgttcattgcagcactattcacaatagcaaagacatggaatcaacctaggtgcccatcaatggtgaattggataaataaaatgtggtatatatacactatggaatactatgcagccataaaaaagaatgaaatcacgtcctttgcagcaacatacacagagctggaggtcattgtcctaagcaaattaatgtaggaacagaaagccaaataccacatgtttagctcccacttataagtaagaacaatgggtactcatggacctaaagatggcaacaatggacactgggacctactagataggggagggaaggacagagggggacaaggactggaaaactattgggtactgtggttagtacccaggtgttgggatcattcataccccaaacttcagaatcacacaatatacccatgtaacaaacctgcacatgcaccccctgaatctcacatagaggttgaaattatattaaaaataataattataatagtaaaacatcaaactcatagaagcagagggtagaatggtggtcaccaggaatggggcgggtggggcaggaaatgagctgttgatcaaaggctataaagcttcagttgaacaagaggagtacgttctggaaatctaatatacagaatagtaactgtagttaataataatgtattgtatacttaaattgctaagagagtagatcttagatgttctcaccacaaaaaatgataagtatttgaggttatggatatgtaaattagctttatttaatcatttcacaatgtttacatgtatgaaaaaatatattgtatattataaatgtgtacaattttatttgtcaactaaaccttaataaagctatgcaaaatgaaatgaacagcttgatgaacttgaggtttgtgaatgtaaatacctcagaaagagaaatttcccaagggcttatgtgaacattgtggaaccagacaaaagccttaatgaaaagaagccttaccagggaagtacatatatggcaactgctcaccagcacttatctccccctgacaagggcagctgtgattcaagaattgccctcttggtcctgggagcttcctcaccctaaagaagaacattcctgtccctggaacctaaatactttttaagcagctgccctctattatacacatagcactgatagctaaaggtaggcttccagcctaccttggaaagcagcaccccacaagagccaaaatagcagcagcccgtatttagaagtcacttgaaaatctgttttaaaatgtatgctacagtaatggttctcaaacttatgagcgtgcattagaatcatctagaggatccaccacgatcaagtcggcttcatccctgggatgcaaggctgactcagcaaatgcaaatcaataaatgtaatccatcacataaacataaccaatgacaaaaaccacataattatctccatagatgcagaaaaggccttcgataaagctcaacacccttcatgctaaaaactctcaataagctaggtattgatgaaacatctcaaaatagtaagagctatatatgacaaacccacagccagtatcatactgaatggacagaagctggagacattccctttgaaaacccacacaagacaaggatggcctctctcaccactcctattcaacatagtattggaagttctggccagggcagtcaggcaagagaaggaaataaagggtattcaaatagaaagagaggaagtcaaattgtctctgtttgctgatgacatgattgtatatttagaaaacccaatcatctcagcccaaaatctccttaagctgataagcaacttcagcaaagtctcaggatacaaaatcaatgtgcaaaattcacaagcattcctatataccaataatagacaaacagagagccaaatcatgagtgaactcccattcacaattgctacaaagagaataaaatacctaggaatacaacttacaagggatgcgaaggacctcaaggagaactacaaaccactgctcaaggaaataagagaggacacaaacaaatggaaaaacattccatgctcatggataggaagaatcaatatcgtgaaaatggtcatactgcccaaagtaatttatagattcagtgctctccccatcaagttaccattgactttcttcacagaattagaaaaacgtactttaaatttcatatggaaccaaaaaaagagcctggatagccaagacaatcctaagcaaaaagaacaaagctggaggcatcatgctacctgacttcaaactatactacaaggctacagtagccaaaacaacatggtactggtaccaaaacagatatatagaccaatggaatagaacagaggcctcagaaataatgccacacctctacaacaatctgatctttgacaaacctgacaaaaacaagcaatggggaaaggattccctatttaataaatggtattgggaaaactggctagccatatgcagaaaactgaaactggaccccttccttacaccttatacaaaaattacgatggattaaagacttaaatgttagacctaaaaccataaaaaccctagaagaaaacctaggcaataccattcaggacatagccatgggcaaagacttcatgtctaaaacaccaaaagcaatggcaacagaagccaaaattgacaaacaggatctaattaaactaaagagcttctgcacagcaaaagaaactatcatcagagtgaacaggcaacctacagaatggaagaaaatttttgcaatctatccatctgacaaagggctaatatccagaatctacaaggaacttaaacaaatttacaagaaaaaaaacccatcaaaaaataggtgaaggatatgaacagacacttctcaaaagaagacatttatgtggccaaacatgaaaaaaagcttatcgtcattggccattagagaaatgcaaatcaaaaccacaatgagataccatctcactccagttagaatggcaatcattaaaaagtcaggaaacaacagatgctagagaggatttggagaaataggaatgcttttacgctgttggtgggaatgtaaattagttgaaccattgtggaagatagtgtggcgattcctcaaggatctggaaccagaaataccgtttgatctagcaatcccattactggatatatacccaaaggattataagtcactctactgtaaagacacatgtacacgtatgtttattgtagcactactgacaatagcaaagacttggaaccaacccaaatgcccatcaatgataaactggataaagaaaatatggcacatatacaccatggaatactatgcagccataaaaatggatgagttcatgtcctttgcagggacatggatgaagctggaaaccatcattctaggtaaactaacacaggaacagaaaaccaaacaccacatgttctcactcataagtgaaagttgaacaatgagaacacatggacactgggaggggaatgtcacacactggggcatgtcgggggttaaggggctaggggagggatagcattaggagaaatacctaatgtagatgatgggttgatgggtgcatcaaaccaccatgacacgtgtataccaatgtaacaaacctgcacgttctgcacatgtattccagaaagtaaagtataaaaacaaaaccaaaattcatattgctgggccccacccccagagtttctgatccaaaaggtcgaggatgggtccccagaattttctttcctacaagttctcaggtgatgctgatgctggtctatagaacaactttgaaaaacactatttgggggttgggggacatagaaatttggatgcaaaaaacttgtgttcaagccttatgtgatttatttcacctccctaagcctgagtttcttcttttctgaggtggacttagtaaggttatgagaatgaaatggaatggtgtatatgaaagttctttatgaactgtaaatgttgcataaaaatattagcagttagatggctttacaaatggtacttgctgccacacctccaccaccaccactaaattttcttgtacttttgttccctctctagccaactttgtcccaccaagtctatcaggcagctggaaaagaactaaacccaggaaggccctgagtagtgtttttttgttggtttgtttgtttgtttcaacacactgggcatggccttgatactgaccttgacttgacttctcttttcctttgcctggcctcctctcaaacttgctcctggttcttccagccctggtctactctcacagcaaagaatagctcccagtgctaatattaagggtaaaaaactgtcagatggaatttttaaaaaatagtaagacaaaagaatccactgccaagcagcaaaattatgtggaaaaaaagcattttgctaggttggtgggctctaggctgatttccctgagggaaaaatctagatctttgaaatagttaagtgaaatcaccagtataattgcagattcctaatttaagaatatgtcagacagttatatcagacagttgcctgggtaaatgatatgtccatgtagaatggtgacatttttctttagaaacctctttttatggctggttgcggtggctcacgcctataatcccagcactttgggagatcgaggtgggcggatcacgaggtcaggagatggagaccatcctagccaacatggtgaaaccccatctctactaaaatacaaaaaaaaaaaaaaattagccaggcgtggtggcacgtgcctgcagtcccggctactcgggaggctgaggcagggccatctcttgaacctgggaggcggaggttgcagtgagccaagatcacaccactgcactccagtctggcaacagagcaagactccatctcaaaaaaagaaacctctttttatttaaaaggtaatacatgtgtggtgtataaaatctagaaatgatttaaaagtatgaaaaataaaaataacccttaattccaccacacaaagataaatacccactgatacaatattagtacatttacatccagcctttcaatatttgcatatctgtataagaatatgtatatatgcatatatagttcttgaattgaacttgtaatatgttcaggtttatatacaatttttaaatttaccattacattgtgagcctttttcaggatcattaagtagtcttcaaaaacatggtttgtaatgacaaactattattcctccatgtaaatgcacaatatgttctaactcttcctaaatgttggacagctaggatattccaaattttaccattatgaataaccctgcagtggaagacacttcaagtacataaataaatgtgtacatctttaatggctttcttaggataaaatcctaggagtggaaaaactggatcaaaggatatgaaatttcttaaatataattcacataccataaaattcactatttcaagtgtgtaattcagtgggttttagtacattcacaaggttgtgaaaccattaccactaattgcagtaaaaatacagagcatttcacaaatttgtgcattatccttgtgcaggaaccatgctaatctctgtatcattgcaattttagttatgtcagccaaagcaagcacagtagaaacattttaagtcttctgataacatatgccaaaattcccttaagcaagtgtgtacccatttccattcccacccaccaatgtatatctatttccccacaactttgtcagcacttacctttagaaagtattgccaatatgactgaaaatggcatttcattgttttgtctctattaccagctcttcttcctcttctcactgaactatagctctgcagagatctatcatcccccgtctcctttgcatacattcaccgtgggcagtcacatccacggcaacagcctcggctgcctcctctggatagtgaccacatgtccataccgtgccccaacctctttctagcactgcagtccacacatcaagctgctcgctgggcacacctacctacagaatttgctagcataacaaactaatatctgaaatcaaactcatgtttcctaaagctggttcttgcctatgactttgctatttagattactgatatcagccttctaggtgcttcacagtcatctgttctctctgcttatgtaattagcagtccaacgctgttgattctctgtcacattcttcctttctgctccatccccactgccattgctctgattttaccttttattgtgtctattccattagcttactcacttctctatgcttccagtatctatccacataatttatcctacacatggctaccataataactttcctataataccgctcgtaccatattgctctcctactctggaacttccaagggctctctcttgcttattggattatgtgaagtaaaggctttaacttgactcttaaggcccaccatgctcttgaatcattctaatttcacttcctctgtgccttataaaaactgtgttttcttccttcatggtattcctgtgcttctcacttctgttcatgcaaatctggcatggcctctctcccagtcatcttcagtggtgattgtattgactcttccaaaatcagctcagaggctctgtgatgccattcttgattcaggcagcagtgctctctccttcttttgactctcattttgttagcatttcctttctgatacttctgacattccatcctttttaatggttttctaggtatttttcatccaccctctaccacacttaattccttgagcacagggattacttcttcttcattttggcatgttgcctagtacctctccaaacaccttaaatgtagatagaggagctctgtaaatgcttggacaaaacaatagtgaagactgccaattttctttttagagcccctaatgactcagtttcaggaatgaatactgtgctaagaaggtacagatgccaggtgactcaagtatcatagctcattcttttttcctcattctccatattcagtccatcaacaaatactgtcagccctacctcttcaaaatacctctaatcaaatctcttgttcttgtcccaactgctactttcctagaacaaaccaccattatctcttacctataatagcccctttaaatggttctctggcttctactgttgacccccacacacacaaatccatcagccaagtcaaacctttataaaacttacatcatgttagtcccctgcttaacaacctctaacagcttcccatttcactgagaataaaattcaaactgtttcagcctttggaaactccatgatctggcctatgcacctccccagtatcatctcccactgcagtccaccttgctcactgtgctccagctctgctgggtcttggctcctcctgattgtcaagttgtatcaaagcagagtgactgggtgttcttgtttctattggggtcctaactgttgttggttattgtcctagggctccatgtctttagtagtagagatgacctggggagtggccagaagtagttctgaggattttgagacttgactctggggaaaacctttatggattccatcagacctctgaaaagtggtaggtcgaacagtgagtttgaactgaaagggataatgggctttaaggaggaagaaaagaaaactggtattattcctacagcctctttcccaagggacgctataaatgttactgatagaaaccagagctggaggacaaacatcctccaccttctttatcgctttgggtgttggtttaggaaactgggcatcatggcaaaacctttaaggctatctgttgagtcagatggtgcactgtgaacttgatgccattttccctatgtgctcctctgaagtctcccttagccctctggtgttgcacccttaacttctgtacatagaagggagagggaaaaaaactctttcattattcagattctggacttgctccccttgctcctagaagcttcgaaatattcactatccacctctttgcctttaggatcattgataagatcagccagctttttccctcttctgtcagttaaacaagtctatgactggtatgttttatcacactatatatagaaaaactagaaatttctctctagcccattctgaaagagaatcccgagtactgcatttctaaagtactaagcattttcctacccgctgctatgtgcagagctttcccgagtcatctgtatggttacttcctgccaaccttctttggaaaaagaggtgtccccctgtgtcttaaagatttcaatgtgaaaatggagaaatggaagcagagggtcaaatgtaatgccctagccagatgaagttatcactccctatgcagaaagacaaagagcacccctgacacacaccacagcatttgtggggagtctttatttccactcgaacattcccttcttttcttattccctaccctgggtttctttgtagccagggatggattctgaggtggagggtggagagggggacccagcagatttacatggaagaacttgaactggctattcagaggaggtggggagaggaggggaggcagggaggcagagctgggtaccaaaagccccttctccagagagtattcatctctcagatgacccagattatagctttcccagactgatgagaaagccattgtcctgaaagttctctttcaaattacacacacacacacacacacacacacacacacacacacacacacacacactcttccccccttggttgggtctataataaggaagggtttcctgattaccaggctgcaaggaccccagccaacagtgggtgggggtgggccttcagagctctgtgtccctccatggtgaccaggcagcttttcccctcttctgtcaaataaacaagccatgcattgttctgtcctccggcttgtctgtgggcttcccttcctgctgagcctgccagaatgagcttgggcttcttcgtgtggggcaggtggaatgtgctgtttggagggaggctggaagagccacagaaaataaacagagctaatcaaggacgttattttgtgcttctatttatataaatactttaaaaagaggaaagtacccacactctgttatggtccaggcctcaggttgagcacaaccacaagcaacaggggttacattttcctttttcccctaagttagagcagagtcatggttctctttctgctcatcttctcccaagtatctcttcaggggtctgctgggagccaggctcaaagacagatggtgctatcggaagatactggggtgacagctgactagcgcagctggagactgactcctttcagaattggtccacctccacccctcacctctcacaagagcctttataaggcctctcctgggagccagcttctggcttttctgctgcatgtgcccaccctcctgtgcccccatgccaagttcacgtctcctgagtacttggaaaagaagcagtcatctttaccgtcccctgagcacaggaggtcatacttgatcatgttatctggaactcagctccgctaaatgggagcatatgcccttttccctccaccacctctcccaacctcttccccaaatcccaaactggctaaaccgctcaagtttctctctcatcttccctcaacgaaggatttcttgagtatacactatttgtgcccacctgcctactcctcatctgatgacatcccaactctcatcttcgcaccctttctccctacctcagccagctccatgaacatgcttgcacctctagtcacaatttcttcagcctcacctggccactggcagggtcacactgataacaaaccagttgctctttattttgttaggaagtggggattggcaaacttcttcaggcaagcgtttgcatgggctgggccactgagcaaaaggagaaagacatttggcgaccagaagagcaagggcggccggacacccaggcctgaggaatgaaatgaaaagagattttaacctgatgcattttttggaccagattatgtcctggtatattgccactcagaatgtggttatcacaccaggagcatcagtatcactctggagcttattaaaagtcagaacctgggcctcgctgaatcaaaatctgcattttaacaagatccccaggtaattagtatgcccactacaatttgagagtgctgttccagagtgtactgggtttggcatttgagccttctcttaactagtcctttctcttttatcttcatttggattgaagaaatcagttttcttattgctaatggtacctcgctcattattattttgcatacgggtaatattaaaaacagatagcatttattgagtgccttttacatgccaggcatgttttatagatgaggaaaccaaggttctgtgacatgcccaaggccaaacaactagtgaatggtagagctgagactgtaagccagatccatatgctcctcaaagctcccaaactttcccctatacagttgataaaagtcaacccagactctcctgtgagatacagagggaagaaaggggaaggggcctccaggcatgatttccccagagaggaaaggccctagcatacatacttcatgtcctaagggagtttgcataagccctctcaggagccagaaattactggaattgaggccagaggccaagggaaactggagtagggaattgggagtgttaatgaaaggaaaaccctgactctaattccccaagataaattaaatcctggtgcctgagcctgggcttagggggtgcaacaaatccacatagggctgctctggattctggctactgcgctaatcacttagggcatcatttggaacctcagcctggggcctaggactactacatcatagcatgctagagtgggaagggtcatttgtgacgattgaattcaatgttttattttacagggaggaaacagaagcccagagagtgggagtaagttgccagaggtcagagtgaattcatggcaaatccagggacactgaccccaaacaccacatttccagcattgctaatgggcaccttttctggagttgaagtctctggtgtaaaattgggttttctttggatctgctcaagtccgcacaggaagtgcagacccctgtaaatacatccgaaaatgtttgtgagccttcgtatctcaccaggaccttcaccttggaaaatctctcagtcacttgcccccagctatataaaatcagctggagtgctactcctctggacctggaggctgctagtcctggcttatctgtacttttctggggcccagaggacctgcagagatggctgggtggggtcaactcagtccaggaagcacaggaattcttttaagtgtatgtgtctggggtatttttctctctcacttacgtgtatttttaaaaattctttttagacacccgctttatctttcccaaacatcatttccttgctcctttcctgagttctagcagtggctgggggcccagcttccttattggcctctgagctgccgagggggtgggccagggctcagaggaggttggagtagggagcaggggggctgtttatgctgctggaagtgcctttcatccttccctttgccaccagggtgctggctggttcctggagcagcgtcttcactcctatccagctcttgacactggctttcgttccctaaggctgtggccatatctaggtccatccaggctgatggtcataccttgccttcagtgctactccttcctgttcttagaactggaacctgactgtgcctgagccccttggatcacactcagcatcttgggctgatggtccctcgccccagaaggtcttaactggagggcagatgggtcccagctaagggaggacgctggctggagggtttgtcaacgagagtctgagctagccggataccccgctctctcccaagccatctctccaccctgggcaacttccatggtaggtacagccagtagccatggctgctgccactcttccccctcttgctttctttcttcaatatctctttctttttgcttcctaagaaaagcattttggagtaatgaaggatgggatgaggtgtgtgcttattgatagtgcctgagccagccttaggagaaaggcaagcactggggtcactgccttcacatcttggcctagagctgcatggttggtcgtaggcattttcttacttttctgtttgtttctcctcctctctctccccactgcctatggagggaatggtttcagctctaggactaatgagacctccctttgctgactgcttcttgagggaattgctatgggaaacctcaggaatacaggctttttcagatagactcttccttggagaggaggggtcgtgtggtatcctaggaaaaaactggaggatctgagtttcattcccaattctgctggttattagctatgtgctcttggcgaatcacttaagctttatgcatctctggttctccatttgtaaagtggggataataacttaccagctggacatggtggctcatgcctgtaatcccagcactttgggaggctcaggcaggaagattgcttgaggccaggagttcaagaccagcctggccaacatggtgaaaccccatctctacaaaaaatacaaaaaaattagccgggcacggtagcatgcacctgtagcctgtagtcctagctactcaggaggctgagacagaaggatagcttatgcccaggagtctgaggttgcagttagctatgagtgtaccattgcactccaacctgggcaacagagccagagaggccctgtcttaataataataacaataataaaactgtttcacataaggttagagagatgattaaatcagttaatgcatgtgaaatgcttagtgcctggcacatcttcagtgttcaataagtggtcctgctgtgtgttttctttaagtttatacagtatgtcaggcactatgctggttgatttcacacatgggactgcatttaatccaaaacataactcatgaaaaacagatggtcatcttccccattttgcagataaaaaatctgcaactcgcagaagtgacttgcccatggccacacaactacagtttgaatgcaagtgtagactgacttcaagtctagggctattccgagctaataataggccaaatagtagaccatatagatagtttattctcctgtcccaaactagggttagaaggctctagctctggctccagctccctctgtttggatttttcttcttccagtctttagttttctctgtgtcctaaaagcccccacttccctcttctgtctactttgggattggttcctactcctggagaaaccctagaaagagtaaggggccagccaggcgcagtggctcacgcttgtaatcccagcactttgggaggccgaagcgggtggatcacctgaggtcaggagttcaagatgaacctggccaacctggtgaaaccccatctctactaaaaatacaaaattagctgggcatggtggcacatgcctgtaatcctagctactcaggaggctgaggcaggagaattgcttgaaccagggaggcggaggttgcagtcagccaagattgtgccattgcactccaggcttggcgacaagaatgagacttcgtctcaaaaaaaaaaaaaaaatagtaagagtctttgtaaggtatgtttcacagtgtggcaaggtagtggtacagtagaacctcaacagtggatggtaccctaggtgtgggtactcttgagccatcaaaaggtacaagtctgagctaataaccattattatagtacctgctacttactgaccacttgctgtgcatcaggctgtgtcccagatgctttgagaatactatctctaatccccacagtcacctagccagataggaattattgtttcctttctcagataagaaaactaaatttcagatgggttaagcaacttacagatacacacatctaaagtggcagaggggatctgaacctacatctgtctcactcatttttcacccattgcctactggcttggtatagttggtgagatgagactgacacacatgaaatgatgatgggcaatatcaaatatcatattattatggacccaattgtgagggctagattaccctgaacaagcttcctggaggagatggtacttgagcagtaccttgaagaacaggtaggatttaggttaacaaaaggagagggggcattccaggcagagggaacagtcatagtcataactatgattggtcgaggccttgccaggcctgattcaaagcacttgcattgtctcatttgatctttcaacaatcccatttggtactattatccacattttactgccatgaaaactagggctctgagaagtgaagtcacctgtctaaagcaacagagctaatgagtggtagagctgggattcaaacaaaggtggtctgaccccagagcctgtgttagatcaacaggaatatcaacagcaaaggcacagaatcaggaagggacagagctggttgcaggctgtgattggagcagagaaatgagagattgagctgatgggtaaggatagcttattgaagactttgaaactgatctagtttacgtttgatgtgggacagagtaagaaatagggagccagtgaagattcttgaataggagagtaccccaattcagttggcgtttaacatgatatgacctaaaagcagtgactggaggtagaacaaggcagacaggccggcagacttctgcagtatttggggcataaagtttcaagggcctggactagaacaggagctgctggtggtgggttctgggagaagagctgtggttctgtctaatggccacagtgaaaatggagggggggtagggggagagagagagagagcaaaccagggccagagaaacatcataaaaaaaagactcagtagaactccgtgtgggattggatggttagggagaaggtggcaccaaggctgactgcccgcactttaaacccagaactcaagaaccctaaatatggaaaaaggcttgaaataggaaggataccctgttcaccactatatcctcagtgtctaaaagcataggtcatagtagatacccatggtacatagtactactactggtagatgcttgacaaatagttgttgaccggataactacctggtagcagcagctggagagatttcccggcagtgtggctttgtgtgtaggactccagagcaagcatagcccccaaggtctccttgtgccttcagcccccactctgggcactctgaaatcaataatagaacaatgtgattacaaagctaggggcttcacctggctttcctccgcttaaatcttagccactgttgctgacctgtggctatacttcctggcctttgacaaacagcttcccctgcccttcctcctatacctcctggtctgtgtctggcctattaccactcaatccttgttttccccagcaaggctattcttctgaagactatctttttaggccttagccctctagagccttgtactactgagatcttctatgcttctgctggggtgaggggcatttccagctaggatggaatcctccagcttgagtgtgaccatgaatgctcctgggaggtagagagctgctttatctcacgatatagccagcttgttgaaggcaggggcccttatcctattcaaccctgtgctaccagtgcctagtctggaccctggcacagtaaatatgaataaattgatgaaaataatttttctgtttacttctgtatcatctacttatttatcatgtttcttttactctgccattcacctctttctctgtcatccatttctctctactatatatttctctacaatctttctcagagttttctctttttctgtcatttattttcccctctatcatctctccttcttatctctatcatttgtctggcgcttccagcatctctctctctccattctctctctactctccctccttctgtcattctccctcccatcaatcacctttttatctcctggcattatccatgccccacatgtactcttcaccacactactcttccccactcgcaagggtggcaactgctcatgcgaagtatgccaggggacagcgatgggtcctgtatgtggcagtcagtgcaaaagttgtggctgtattcagagtcatggcctcaggcctatttccctttatatacccctgacctgctgagcagccaatctcctctgtcagcctaacatggtgcattcaccactttgttctatcttccctcacaggagttggggcttcctgccaccagtttgcctaccaactcaggtgtctcacctctgtacccatcttatctttcactctgtcaatacctatcccatgctttgtttgaaccagctctgtctctcccattagtctgtaagctctcaagagcaaagactgtattggattcatctctgtaatcccagagttacacgtagaggacacacagtaaacatacaacaaatgcttattcaatgaatggctaaaaattggagaattgacagcccagtgttgacctgttcaaacttttcaatcacttgcccattcctttctcagagaaaaatgggaagattgaccagattgattttctttctcaaagagaagtgaggatgtgctcactgttcattaggcagcagcactcatttattccacaaatatttattgaacatctactatgtgtccagcactgtgatacgtgctcaggatactcttgtgaacaaagcagccctatgaagctgacattccatatctccagaatgaaggagacttgagaactaggagctcaggagggccactaagattcccacaccagttccttgcaagatgttctactttactgaaggaaaagagggggtggggcggaagctgcctgggaagtgatttcagctctggttccttcagcccacttcctgtccctttcttgctgtaggaggaacgcccctgtcagtaggccgcactcatggcatgtggccaagctgctggagggatgccctgaagcagccaccaccatgcatttcccttctgaagccttcagcttgtcctggcattctggctgcaacacaaggtgagtctagagccctcccctcaagacaggctggagggtagacaccttggacactcctcctcctctgctctagtccctgttggatgttagagcctcaagtactataatggaaaagcaagtgggagtccagagtacctgagttcaagtgctagtctcttgctaattctctgtgattttgggctagtccctttccttctggatgatgtttccttgaaatacctcattgggcttacaagacaccacactgtcctgcttttcattctatttcactagctgttctttctccgtatctcttttcctaattccttttgttctcctgtctcttaatgtaggaggaccccagggctcagttctggcctgcttctctgtcaatggcgactcactggtgcccttatctggtctttattacctctgtcacatagccaaagccttcaaaatagggaccttcctgaataaccattgttgaaacagttgcccaagaggcagacaacgttttcttcaggctgagagccagcaaaggtgctgcccttcactgccttttcccttccacaagagcttccctccaagaagggatttctgttgcaggttcagagaaactaagggttgcgtttaccccaattcggtgactttatttggaaaccaagggctcagggcacaggcagttttgttctggaagaatatgcagaaacacactttgacattcttgagcttggctcctgtttgagtgaggatttgtttttgtttttgttcttttcagcaggaatagtggtggagtgggtagcaggttcccttgccaataagaaattgatggattccttgcccagagaacaagtgagctgactgactaaggggcaaggcagggagcaagaatgagcagaaaatgacctgagggtctcatgggctgctgccacagttcaactctggctttctagactatggcctttctgagagcagcctgcaacctctcgggttctagtcaaagggagttactggcatgacttggttcagtttggctttgtgtttgggaaatggtacttaaaattgaagattgcatctgatcctagcccttcccttggtcttccaggtttggctttgctgtgggagttgggggaggcgtgggtgggcagaggcccctatattatcaatactagtattagagaggatcctgatggcaaaaactaataatcaagagagtagcagctgccatgtattgaacccttgctaggtacctgggctgtggtaaggactttacatttactatctgctttatctacacatcaaccctctgatatagctattactattattcctatttaaaagaccatatggcagtagcgctaagacactggactcaggcctgattcagattccagctgtgcttcttcagcagcttagtgagtttgtcagtttactttacctctctaagcttaagattcttccattgtgaagtgtagataataatctgtcccataaagatgggaacaatagacactggagaatacaaaagcagggagaaaggaagtgggacaagggttgaaaaactacctgttgggtactctgctcacttcccaggtgatgagttcaattgtactccacacctcagcatcatgtgatatacctttgtaacaaacctgtacgtgtacccccggaatctaaaataaaggttgaaaaagaaaaaaaaagatctgtcctcttcagcttgaaatgaaaccttgtaaagtgtccggcacattgtaggtcctcagtaaatagtcaggattgctattatcaagaaaagaataggggaacacctgaattacagccctgtctgtgccagtagttagagctgggtgttcttgagtaaatcaccatctcaaaatcacttccctttgctgggcttgctttacaccagtggttctcaaaagtgtgattgctggatgagcaagcagccccagcagcacctgggaagttgttggaagtacaaattctcaggattcaccgagacctaaagctctaggatgaggacaagtgacccgtgtttcaacaagccctgcatgtgattctgacgcacatgctcaagtttgagaatcactgatttatttacaaaatggtccggctaaaactgaatcagccctttagggcccctctctaatgctgatattctgtgattgtctcttttggcagggagccacatgctgactccctagggacagggacagcctagaagcaatttcagacttgctaatgtcagggaaatagaggataacccccatagagctctcccacttttagtctttggggtgtttccccatcttttttccatatatcatcttgtgtcccattttactaagcccctgaggcaccccaatgtccatcttcttccctgtttccctttcttcccccttttttttttttgcctaccctcctctcttttgtggcatgggtacctctgggctggcctgccctctcctatagtagggctggccatgacttcgctaactaaccagtatgccctgtgtcttacagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcaggtgaggacttggttcttgggtgggtaaccttcattattgtctttgagaggggaaagctacgtaaattatttaaaaatataacaattataattccttgaaactgtacagcactggcttcagtagttgttagcttagtaaccttgaaaaagatactcagccaccaaaattgcagttgtctcatctttagggttagataaaagtaacttttgcttcataaaatgggcacaactgagatttatatcctgactataaaattgatatctgagtgacccaaagcaagtcattcaaccacacaaatttgaagtatgtaattctaaagggaaaaaataatttttctgtcataaaatagccagtattaagaagagtctcactacctcatctctaaaatggaggaatatcatggccgcctcatggatcacttgtgagaatcaaatcagattgtgtctatggagttctaggcccagtgcatgatacaaaatatcacttattgcctcccattttctacttcagaagtatttagagatgcaaaacttgcaaatatccccaggctttgctttcagagatctgacttgttgggtttttaaaaagacaaatcctttcccctttctccatcctgtctctgttggagacccaggtctaaactggctgctcttatatcccggttatgacctattaccataacacaagctaccaccatcccccaggctacttctgggaggactccctaggtccttgcctactcactgccagattacttccccatggcatccctgatgccatcttttggccggtgcattcaaaccagaagttaattcctgtgttcagctgttgcatacacagacacttttgaaatgacttagtatctgaatttgctcaatatatatccttggtaaaaaggaacttcaagggtgatagaagccttacacaaaagactatgaactctacaattccttttatatgaaattctaaaacagctattctatgggggaacaaattcagaacactgctcgccaatgggaggtggcacagagattgactggaaaagggcagagggaacttgtggggtggtgacaatgttctatatcttggtaagagtttgagttaaacatatgtacctgtcagaactcaacaaatgtatagcaaggctcctagacagccaatgcacttagtatttgtgcatttcactggaagtaaattttgcctaaaaatgttgtaaacaaatattaaactttatttaatatgtatgctgaagtgtgtttgaagtatactgctgtattcaacttatgttttcagcatacaaatcttgtacatattttgttatatttgtccctgagattttatgaaagcgccgaatcctagccacccaaccaccagggatatttgtccctaagattttatgtttttagatgctattataaagagtattattttcttaatgtcaagttgaaattcttgattactagtctatagaaatataattgaattttgtgtattgacattgtatcctgcaaccttgccaaactcacttattagttctaatagctttttggtggattataaaacattttctacatacacaatcatgccatctccaaatagaatttagtgtcttcctttctcctgtacatgcccttttctgggagagagaagagccttattgcactctcaccttcaatacaatgtttggaggaaatggtaagagtggacattgtagcttttttcttaatctttgactataaagtttgatgttagctgtaggatttttttgtaggtgccctttaattgaggaaaatctcttttattcttagtttactgagagttttcatcagaagtggatgttgtattttttttcaaatgctttttctgtatctgttgagatgatcatatagtttttctcttttagtctactgatgtggtgaatgacattgattgatttttaaaataaatagaagcctagcattgccaggataaatcccacttggtcatgatgtattatccttttatatgttactagatttgctaatattttgttaaggattttgcccttatgtttatcagggattttagtctatagttttattataacatctttttctgttttttgttttttttgtttgtttgtatcaaggtaatgctagccttaaaaaatgagttgggatgtattcccttctcttttattttcaggaagagtttgtataaaatgtcttccttaaatgtttgcttgaattcatcactgaagccatctgggcctggaggttttttggtagaaagctttttaactacaaattcaatttctttaatagatttggggacatttaggtcatctatttctccttgagtaagctttagtagtttgtgtctttcaagaaatttgtccatttcatttacattttaaaatttatggggatatagttgttttcaacttactttaaaatgcaccaggattttaagatggattggtagatggatagaggagtaaatggatatatgataaggcaaatatatcaaaatgttaattgtagaatctaggtgctgggtatatgggtgatcactgtgaacttctttcaacatttttgtatgtttgaatatattcataatgttgaaaaaaagaggagaggaaatataaaataatggttttaagggcaccgaagctggaaccagactgcctggttttgaatttcttcccccgaacttacaatgcctaagctttcccatctaaaagcatgggggtagtaacaacacctacttcataagttggttgtggggattaagtgatgtaacacatttaagactcagagcagtgactgccagattgtaatcatcttataagtgagttatcatctcttaaagggacattttggcttagcttgagagacttttgctggaagaaggactcacagatagacagtagacaaagggggctgagattgggggtgagtggggcgggggaagtgaggagatgacggctgcagcggtgtcagcccaggaccagcagctctataagagatggaggtacgatttgcaggttgcagcaattggcagcagtaatgcatgcgggtgaggctgtgcctacaccatgcctctattttttgtactctgagggagggataccttgggttcctaatgcttgttagaccagctaagcaggtctgcttagatactaggcattccgacacgtggatggctgcctaggagacaccacatgcccatttctgcccatcatctgaaccttccactcctactccacccccctcaagaaatgggaaaaacttgcagcatgggttaagatgccatcgctctgatgactcaggtacttgtggtggtagctatctgaagtagggctgagatcctgctcctaatgcccctggacgaggttggtgaactaattgtctcctgttcagtgctgtgaagactgaaatcagcatgcactcacgtccttcataccagcttgtttttcattcattgtcaaattatttcacttaccaattgtatgggataagttataataggatctcccattttacagctgaggaagctgagaaagccaaggctcagagaggtcacacatctagcaagtggcagagccagaatttgaataacatgacagtaactagcatctcagtgtctactgggcaccaggtactattctagatgctttacatgtatcaagtcattgagttctcaagcaatattattatcgtgattatactattatatagttggggaaactgagataaagagaagttgaatggcttgcctgaggccgcaagtgaaaggcaggtgtgcgatttgaatccatgctatcaagctccagaggccaagctcctgactgtgctacactgcctctccataagctgattgcaaagcccaggccctctctagtgtggccggatgccctctagcagtatcacttccactgggacagcaagttcccatcacaatctccatttgcagcaagcggtggggataactgcctctttgattcaaagggtgcaagcaatgtaccaggaacctatgtggcttagggaaaaaaaaagtagagtgatactgtggacctgggaaggtggttgggagttggtataggactttggtttggccactgctatttactgagcacgtccacagggctagacagggcatggacaggaaatcctggcccccactgtggttgaacaagtaatggtgtctttgcaggcaggaacgtctcacaagggcatcgaggcagagtctaaagtacaagtggttagagctgttctgacatgccagatataggcagggactgctgtggtcctttaaaagctgaagccaagaaataaacctcaacttttccattgctgctaacatccagagcctcttatgtgccaagcaatgtgctaggagttctctctgcatatcttatttattatcactactggtcacccagataggaaactgaggtgaggttcaaggaggtaatatgaataacctcaaataacaccactattaagtgtcttagccagtgagactgcgccaaggatctatgtttattctgcttcaccaggcgtcttacttccagtagggagacctactggggcaaaggtaataaaactttgaatgggactaatagtagtagcattggagaaagagggagtttggaagatcagtgaaatttaggaaaaactgtgcattcccattgaactaaactctgagtctctaggtgtggagtattggatacaaagagagaatctgaaaggctaatttgcattcagtttggagctaaaataggaaggcagggacagttttacaaacggcacatatggcttggcctagaaaaaaaaaagagttgcttggacatggcccttaaggaaaaaatgcccagggtagagagtctgctcctgtaatgtagggactgtggcaacctgcactcatattccccagagatgggcccacctcagcccctgccagcagatgtgggcagagaaggaggagccactgcagttggaggcatgctggcatacctgctgtccctctgcctcacctggggagagggttgctgcagccggagcttctgccctcaaagcccccctcaagggtcagggcttccaagtagatgctttctctgttggaagaggcaggaggaatgagcaggttcacccagcagaacaaacaaaaagacctccatctctctgtgcaggcaagagccagggcaaacagcaaacatactaaactggtttttaatgtggtttgggaggggagtggagaaagagggaaacagcattcctagaccatggtgtccaggtccctaagtgctcccttagtctctgcatgtctgcagcagtttagcaagcctgccgacagaaaggcagccctccaggtacaaatttctcagcctgcatagcagagtagaagaaacaagctggggggctgggccagacaccggctcctgacctcttcacatttttgaggccatctagatacctggctgctcaaagctttctaacttatcaggatttttctttacaggaatttcctggggacaaatggaatccaataacaggaaacaggaagaccagccagtcagggaggtaagtgagcgctcagggagttggggtgggttggtgcctctggagcttctgtagaaattgctaaggtctttggtttgcttagtttcctttgaggaaactggcctggtatctagactaagggcttgataccatagatataattcagcctgtccccctgccccccgcactcctagatagctgggtacagaccaaactgattgctaggacattttggaatatgcaagtttcctgtattagactgagatccttgagagaggacaccataccttggtcatagctttattctctgtacctagtacggtgcccgatacagagaagttgctcaagaggtacttgtcatttgcttgccaaatgaagaaatggaacctcctccaccattaatgggtgaaatgacacaaaataatgctagctaacatttcttgaacacagtgctctattctagaccccattcaaatcattttacaagtatgtatttatcactatgaccttatggagttggtaatattagtctctccatttgacagagagaagaaattgaggcacacagagatacattcatttgcctgaagtcccacagctaatcagttgactagacccaggcggtctagcttcagggacactatactacattacagtgtttctctgaaatggttcttttactgattagtcagtgaaataagaggactttattgaaaacctaatataggtcctgcctttttctgggcaaggtgagaaatacgagcaaaagaacagcaggaagcacagtgcctgcccacagcttgagcagggaagactaacccacacaaagctaaatggcaataataataaattaccacttgccaaacaacctatgtgctgcaagccgaattacacatattatcttatgctttatcttcccaacaactctgtcaggtaggtatgattataactggggcggtgggtctcaaaacttgattgcgcaattgaaacacagataaatagttggacctgaccctgcatcctgagagtgattcagtaagtggggagtggagctcaaaacctgcaattcgaacaggctcaaacagcatctgggtgatgctgatgcagctggtcctgggatccagtttgagaattgctaactcacataaagggtcacagtcagagagcctaaggaatctactcaaggtctcacagctagtaaagggataagctaggaattaagcccagcttttactttctcacacaagttgacagaagatgaaaccctgtcaaatacagggcttaagaagcacctggcacctggtaagggggcagcacgtggtaactattactgtacactatttaagttcattggaggataaaaataactgagggttggtagctgtaagaggaaaggcccatagaggagactaagcagggtgtgttggaggaataatccccactggttaagttctggccttggagtcagttctgcctgggtacaaagccagattcttctattcactagccatgtggccttggcaagtgcctacctgcctgcctcactccctctctctctttcccttccccccttatttataaaatgggataagagtacctatctcaaatgtttgttgttatgaggactaaatgaattaatatatgtaaagcatttagagcaaaacctgacaccgtaaactctcaggaaatgttatctgtaatgaggaggaagaagaacagcagcagcagagaagaaaggtgagtagtgaagcactggaccagcctaggcaggccttgaccagcctaggtagaccagcctaggtaaacctagataggatcacaaacatgggagcaatgaaaggttaccatcaggtaagtgatatgataaatgtggccctttaggcaactttgcagtgtttgcagcctaagtgggttgaagagagaccaattaggagaagtgatctggccatgacagaatgtggccctggattggggaggtagaggtgcgatagaaatggagcagaaggaatagataaataggtgtgatatttgggggaggggagtttgtttattgtaaaaacaatattacaggaaattaaaaatagaagaaaaaaaaaccttattgtcaccaccttaacaccttggttgttttcatttccctgtcagctttatctataggtatagagagttttctaagcatgattataataaccatgtagatgtaattttgtgtgtcctgcttctttttcctctctaagcattatgtggtaaacaacttttcatgttgctatgcaggcttcctcaagtcataatttttagtggctgtataatatttcaccagcttaatatgctctaatttgcttaatcattcccaaattgttgggtaaataggttgtttccaatttctggctattataaagtaatgcagcagaaatattttgagtcactatagctttttttctcattttgaattatctcattaaaaacaattatgtggagttgggattactagtgcaaacaatacaaacattcttatggttcttcatagatcttaccaaactgttttccccacgagatgttttacatgccattagcaatatatgagcataccagttttccaaaattatgtcaccattgaaaattttctttttctaatgccatacagtttgatgggacctattatagtattaatttgcttactttgataattctagtttgaatattttgtgtgtctaattaatatattaatatctttattgcttctcatgtgaattatctgttcagattatttgctcacaaatatgtgacaccttttgagggcaaggtagagaaaacttggtgactagaacttgaggagaaaaaaggaaatatatcttagccaagcatgagatagtacacacctgtagtcctaactgctcaggaggctgaggtgggaggatcacttaagcccaggtgttcgaggcggcagtgagctgtgatcacatgaccgcattccatcctgggtgacagagcgagaccctgtctcaaaaaaaaaaaaaaaaagataaaaagataaaaaacaactctgagccccagtgacttggagaatgttattggcatagatggggcacttgagaaggggacctggtttggtgaagatgctgctaagtttgaattgggatatgttgtatttgaagttagtggaagatacaagttgagtctttcaaggcttgtcaaacacccagccagggcacaggatgaggaagaagaatcaacaaaggaaactgaagggtcaagcagctgaagtagtagaaggagaaatctgccagtgtagaagataagcagatgactgttaatgcccttaacagtttggaattacaagtgaccttcaagaaagcaaattcagtaaagcggtaggcatagaaaatagatggcatggtggtctgtaaggggggagcacagagaagaaatgcaagcagcttttaagtgtacctgttttaagtgtacaatttaatgcaatttaaatgcaagtacctgttctaagtgtacaattcaatgatttttagtaaatttacagtgatgtacaatcaccacaatcaagttttagaacatttctatcaccctaaaaagacccctcatgcccattagccattgctctccattcccactctcaaccttaagcaaccactaatctactttgtctttatagatcttccttttctgtgcactgcatatgactctaatcgcacaatatgtggtcttttatgcctgactcctttcacttagcataatgtttagcagttcatccatgtatcagtacttcgttcctttttatttccaaataatattccattgtatggatgcatcacattttgtttactagtccttccactaatggattgttgggttgttttcactttttggctattgtgaatattactgctatgaacattcatgtacaagtttctgtgtagatttatgtttttaattatctttggtacatatttaagagtgaaattgctgggccaaatggtaattttattgtttaactttttgaggaactgcccgttttctaaagcgactgcaccattttacattcccaccagcaaaagagagttccagtttcttttggctaattttactacaaagattaattgttactgtgtggtttttaaaatgtttaaaaaggggcccggcgcggtggctcacacctgtaatctcaacactttggtaggccgaagccggcagatcccttgaggtcaggagttcgagaccagcttggccaacatggtgaaaccccgtctctactaaaaatataaaaattagccagccatggtggcaggcgcctgtaatcccagctactcaggaggctgaggcaggagaatcgcttgaatctgggacgcggatgttgcagtgagccaagattgtgatactgcactccagcctgggcaacagaacgagactctgtctcaaaagaaaaaaaaatgtttaaaaaggaagatgtttaaaaatagtaaattagctaggaaaaggaaagagagaaataggatgatagttagagggagcaattgggtttaatttagtggttctcaaaatgtggccccaggcccagcaacctcagtatcacctgagaacttgttagaaatgcacattctcaggccatactcagacctactgattcagaaagtgaggatgtggcccagcaatctctgttttaacaagccctccaggcaattctgacgcaagctaagtttcagaaccaccagttcaaatgaaacttcagtcagaatctagaaaactgaattaagtttaaaacagaaaggaaagctcaatagaaaaggaagtattgacactgaagatggaagaggcaggtcccaattaaaggtctcaggaaacatgagaaggactaggagatgtccagggcatagatgacatctgtgaggagaaatcctgatagagtttcccttcacaccttcccccaccaccacacacacaaattttaacatttactatgttatttctgtaaaaactggaatgatgagtgtaggtggaaaaatcaaatgtgtattcttaagccactctctttgcctggaagcctgcaatgaattgctaatttcaggtagttatactcttagttgtcttcctccactgttatttggttttccgtgaagagaatgtaaaaattgtaatattagcaggagggataaaaatggtgagtagatctactgggagaaaaagctacattactgtgatatatttaaaagccaaaataagttattttctggattatctctcttggttttctgtacctatgattgcctgctgtgaccctttccatttttttcactttgcacagaactttagaatgtgtagggtgtttttatatgcatgaccacagttaattctcacaacaacactgaggttaaaccttatttttcccgttttactgatgaggaagccaagactcagaaaaggtattataccattaacagcagccacaacaggtataatagctaacatttattgagtgtttattctgtgtcagacactgttgtaagcatttcatatgaagtattttattatttgtaataaccccgtgagagcattactgtttattgacccagttttgcagatgaagaaattgactcacaaagagattaaagtcatttgcccaaggtcaaacaggcatctgacttcagagcccattactactgggattatacagcaagtaagtgaccaaactagagctctacttaggattttccattctcagcctagggttctcttccttccctttgtcacaccacatcatgagcagagtgtgaaatacccggtacagagttcctatttactgattgagtgaaagaatatgggtaattcagagttgaatctgatttcattaggaagagtacacttttcaggaagcctttactacctaagaagaatgcagccttcagaggctcggaaggatttgtcacaagtataactaagtgaatttaaatacttaggaattaatttaacgccaggcacacgaaacttattcaaggaaaattataaaactctaatgggagaaataatatgaataaatgcatagtgtatactttgctttaatttaggaagactgaatatagtaatgattacaattctccctaaatttaatgtgtagacataatgtactccaattgtagtcaccatgggatactttatagaatttgtcaaatttatagtaaaatttatctggaagaataagtaagtgggcggaaataccaaagagtacatttattttaaaagttaatgatggtagacttaccctatcagattttaaagcgtatcataaaacaacaattatcaaaaccatatgatagtgggttaaaaaaagtcaaacagtgaaattaaaaaagagcttctagaaacagactcaagctattttaagtatataggacacactggaaacaaccctgaactggggaaagcaattactatttctttaaaaaatgttgggaattttagatatcaatatggagaataattaacttagattcatatcacatactgtatagaaagtggaccagtagaatcgcatatttattccaggtgtggatggaagataaatttgtgtctgttaaatggaggatatcatcagagacaagatcgatggattcaaatatataaaagttggtgggggggaagcctttgtacaacaaaatgtaataaaaagctaagcaacagaacgaggaaaatgtctgggatcagcatcactgacaacagttgcatgtccaaaaaatatatatataaaaatgggtagaaggtcagctttcagatttagcttcgtaagtgggcaaggaaaatgaacaggcaatttacacatgaggcaataaagggagtaaaatcattgcatggaaaagtaccacctctctagcaattaaagaagtacaaatagaagcaacttcaaggcatcataatctgcttattaaactatcagcaattaaaaaaatcaataaatagaaattgtaaaatgctaccttggcaaggctgtgaggaaacgtgcttctggaaacaatacaaattggtttagtcttcctagagggcaatctagaaaaatgtgacaagagtatgtgtttctgggtttagtcttcctagaggacaatctagaaatatgtgttcatattatttggcctaaaatacccccaaggaaataacctaagagggaaaaaattatttaaagatgttcatagtagtgcttattatactcatggaaagagtttaccaatctaatatatcatcatcttggaacaaaatagaatagccatcaacagtgacaggtatacaaatgttgggtctttcccagaaatgagtggttgtaatattaacaaaaaaataataaatatgaaaccacatgttgaatctaatctgatagtagccatacacaaagaaaattcagaaaggaatctggcaaaatgtaaatagttggatatgaatgtacatggtgttctttaggtacatgtcaagttgttggaatttataattaaaaagaaaatctgaataagaggtggcccacgttggtttgatatagacccgagaagttaaagatcaagggctttgtaaaaaatccccgtaccaatgacagacaatgttacttaccagacatgcttactctcactgctagctagaattgggtttgctagaattctccatccactagcacttttgcttgcttaaatccacaagaactttgacatcaccagacctctacgaatctccaaatttgtcaccaccactacaacatagtaccccctcacacacacccccaccaataaacattttattatctgcctcagaaccatccctttcttaaagcttttccatttcccttcatttctatcactagcactagtttgcatttcagtgctattattcacaaagaagcacattttctctctaccacagtgactgcatatgtatgtattacttgacaacaaatatagattggggtcattggagagaaggagctaagcttcacccaggacagccccagtaaagcaaggacttctctgatttcttcacaggacactttgcatcagcctcctgaggactagagaaggttcagggcaagcactgccacttgcatttgttgttgccaagctaattgttcattacttgaatttctgtgggcccgggggcaagcaggggtggcagcaacaggctctctgggtccttctcccctccctgtgtatcctccttgcgtctcacttcctggatcttgcaaatatttccttcggcaataacctgggagtgtctgtttctcttggagcagtcttacttggctgctgagggaagggaaaggcgagacgggttgggcttgtgtgctgttgctactgagattctagaatgccaagctattgtggtgagcttaaaaataaagtttccaaacaagaaacttcaaaagggccgaggaagaggtaggaggagatttttcagtctctgcaaatattggttttcattttcaattcctattaggccaaaaaaaaatattttaacaaaaagggaaaatccgttcttcagaagaaaaggcaacccatggaagcggaaaagagatgaacaaccctggttttggcaggcaatttacttttgtttttgagatgtagtctccttgctgatgtcaacaaagccctttctcatagtttgctttcatgcttcctctgctttcctcagtgaggcgctaaagccttcatggacgcccgaggatgaatgtagcacaagtaccttttgctgtaccccaggagtccctgcttccctgcgattatctctcagagacagacaaggcaggtctggacactgtgctttttactagctgggaaaatgatttatcctttttaagcctcaggagtctcatctgcaaactgacaataatggttgttgtgaagattaatggaaatacatacgtgaaagtgcctaacacggggcccaacacttggcaaccagagtagtcgactgggtgcggtggctcacgcctgtaatcccagaactttgggaggccaaggtggatagatcacttgaggtcaggagttcgagaccaacctggccaacatggcaaaaaccagtttctactaaaaatacaaaaattagctaggcatggtggcacacggggaggctgaggcatgagaatcacttgaacctgggaggcagaggttgcagtcggccaagattgcgccactgcactctagactgggcaagacactgtctcaaaaataagaaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggggaagagaagagaagaaaagaaagaaaccagagtagttccttttccttaatgaagctccttgccctccactccaaggaaagaatccttacttggtctcaaagcagagttgcaaatttctgtacatttaggaggcctgatccccttgaaaataggacttctagaggccaaccaatatccttggcttgaggctgacacccttcaatggaagcctccctttcaccatcaccattttgcttcaattgttaaagccaggaagacaggagcaacattggttttgctcccctttgatctggtcatcttgcacagtgtaatattcagcaaggatttgttgaaggaatgactagtacacacgttggcccagatgatcccattaagggtagcccttccccttctggagttggtcttcttctgcctgcttgatataagtgactctgcaagtctcaggctgccccaacacagggcaagtgagtgggagggcagtggttttaaaatgagggctgatgcagagaatagcaattcccaagttgccttgtgcccagtacctccagatagggtcacagttccatgacttggggcaccagatgtccctagaagggcatgttcttttcttccaactgtttctggagtttattaccgggatggggtggggggggggatttttttaaggctaacacacatagttagtacttaagacacctttgaatatccagaccttttgattgtcacactgctcttaaccctaaacttgccttttattatatctccctttttagtagataggaaaagtttgagtgaatgagtccaggcttaaactccttagtaaactagggcctcctggctagtcagctatgtggttgagctgggacttgaggtctcctggtttcttggctattgagcagggttgaacattaatcagggagtgcagtccaattctcttgatgggaacaaggagcaagcctgaagcatacaattgtgaaggcaattttccatgttcctagcatcatttctaggtcctttttacatagttcatccttatgactgcttatttgtaagataggtattttgttgaaaatgaggtaagtgaaataccttgctcaaggtcacacagcttttgagttatagagccagatttttaaattttattggaattcagacccaagtctttccaacactgtgttctttctgctttgctcaattgcctgtcctgtgccctggttagggaagaagaaaatgtggtaaatttgattgttatcatggagcagggttgttttcatcacagctgcaatacattggcccaattgttgcctttgaggatattgctgcatttcataaaatctacatcggaggtgaaggtcgggagagaggcagggacaggagatagaaatgggcaaccaggtgtgtgtggtgagggatgggggacagaatgtatagtttggaaaccaacctaattggaacaaataactgcccccaaaccatagcactcccaacccttttactctgaacctttgtttccatgatatggtccctgaaccacctgtgttagaatcctttaggtgaattgcttaaaatgctgattcctggatcccaccacagaggtatgaaacccaatttctagggttggggcctatgaatttgcattttaaacaacttcctgggtaattctaatgaggagccactttgattatgagctgttttcccagactagtggtttccaatgaaagttggatcatgtacccttctcagaaagaattttttaagcatgtaccctcaacatatgttggcaatatatttattaatttcttatatgtgctaatgtcctcatatttatgctttgaaatgcaagaaatagaaaaaaataaatataaaagaagttctgtgaacacaactaccctagactaaaaaataaatgaccagtcaaaaaaaaagggtaggtggttgaaatccagtttcagggagaaggaaaaaagaatggtaaaagcccagtagagtggagagttgaccttatttttctacaaacccagaactcctccagaatgaagaaaaagggaactgaccataaaggtttcaaggtaaatatcagtaacccattaatcgttaatctttggataccaaaaactgaaaaaatgattggacaaggctgaagggcgttggccaggcacccagttgaagtaggaagcagcattttatgagagcacctacatgagacaagcacctcatcttttgagatgtgtagctaaggacggcattgacaaggcaccagctttgatcaaagcagcaaagctccatgcagctcatgaactccggtgctctttgagcactgtagggtaaatcagcccagtaatagaattaggaagcttgataaggttgagcaaagcaaataatttccattagcttgcgctaccccaaataaatacgcaatttaggtaaaaacaacagacttgctatgcaaacacagcctcgagataaatcccaggccactccccctccccccaccacacacaaaccccaatcagattctggagcaattggacagctgctgactgctttacctgctactcattgttcccattgcctggcaacctgggctacgaggttacagtaaaaaagatctaacttttcttcttttccatagtcacacaaacctgcatttatttcacattgaagaaatatgtactgagcacccactgtgtgccgggcactgtgctggatactagtgatacagtggtgaacttgacatgtgccttcaccctcaatatggttatgtggaaggggcagacaactaagcagtagtgtgctaggaaaattaatgggtgctgttagaggacagtctgggcacctatcccatgctttgggggaatcagggaaggcttcctcaaggaaatgatatctcagtggaattctaaaagtaagtcagataaagaggcggaaagagaagataaagagcaaacagcatgtaaaggcaaaaagaagtgtgggaggataggaaaggcagaattttaagaaacctaacaaatcctagtaagggtctgtattttatgaataatgtaggcttcaagcagaaaaatgtataacaaaatcagatttatgctttatttttctgtttactaatttttaattgaaaaaagtaataaatgcatttagtgtatacacacacacacacacacacacacacacacacaataagagaatctcaccccaaaccatcagtacaactctttacaagagacattactggcaatttgttgtgtatccttccagaaaagtaacgtgtgtgcatgtatatacattcttttttacaaaaatgggaacatattgcatatcttttctattgtacatcctgcttttttattttagtgattattctatgttacacatagctctattgcatcacctttaacgctacatagtgttccatatatagatattccctattttatttagtccctattgaaggacatttagatggtttccagtcttttgtgattacatacaaatctacagtgaatatccttatggatatctctttgtgttcatgttggaatgtgtctgtaggataaatccctagaagttgaactactgggtcaaaggatatgcacattttaccttctttgccttccaaattgccctccctaggagttatgctaatttcaactcccaccaacagtgtgtaagatcacctgtttccttataccctcattaattctttaactttttttatttaaaaagtgtcattattgtttggatttgcattttttaaattttaagtgaggtcgaacaccttttggtaaattgataagtcattttctgtgaactatacctttttctccctatggagttgttggtcccttttattgattggtaagcatacttcacatattaaggatatttactcttagttgtatatgttacaaatatttttcccagtatatcttcacctttagactttatggtgttttttctggacataattttttaagttttaagaagtcaaatttataaactttcccttattacttttatgttttgtgtcttacttaaaaagaacttatcctgccaagattattttatatttttaaaaatgttttcttctagtacctttatggtatttttttgacaattgagtcttgatacatctaaactttatttcgttgtaaaaagtgataggatgattcagctttatttttgtctcaatggctatccagttctaaaactacgtattgaatgattcatccttcccccactatttgaaatgcttcatcacaaactaacttcccctatgcatttgagttgacttcagtgttctagtgttctctgttttattccatggatctacctttctatttgtgagactgccttatttactgctaactttagaaattatttcaataattggtagggctggtcttccctctttcatctctctttttccataccgttcataataattcttacgattttaattttcccatatgaaatttacaataatgttccaaaatgcagtctgttgacacttttattgagtttctattaagtttatagattcacttggagttgacatcttaacaatgttgagtcatcgttgctaggaaattgtgagtcctttcatttatgtgcatctagttttatgtttctcaatagagttttaaagtttttgcgtatagatcctgcatatatcttgttaggtttatttctaggcatcttacctttataattgctgcagtaaatgtgatctttccctccattatatattctaactaattgttgcatctatgtagaaaagatgatttccatatatgaattttataccctgacaccttactgaattttcctgttgttggtattatttttaaattgtttatgatgaggctgcgcacagtggcacatgcctgtaatcttagcactttgcgaggccgaagtgggtggattgcttaaggccaggagtttgagaccagcctgggcaacatggcaaaaccctgtctctactaaaaatacaaaaattagccgggtatggtggtgcatgcctatagtcctagctacttgggaggctgaggcacgagtgtcgcttgaacctgggaggcagaggttgcagtgagcggagatcatgcactccagcctaggtgacagagctggactctgtctcaaaaaaaaagtttctgatgaattttccagataaataatcgtatcatctatacataatgagaagatatccccttcttccaatgtttacatctttattttgttaaattgcactattgctttcagaacaatattaaatattagtggggaaagtgggcacctttgccttgttcttgtttttaatgggtatacctctagtgttttgccattaagcacaatattggcttttgactttaaaacaaaagtctgatgataatgatggtattatggaaatagacatctttttctgttaggttttttttttatctggaagtgatgttgaattgttatcaaatacattttagcattagggaaattgttatgtgccttttatcctttgatttattaatgttgtcaattatatcagtagattttctattactgaaccagtcttacatttctaggatgaaccccacttgatcatggtgtatcatatttcttaacatcctcttagattctgtttgctaatattttatttaagatttttgcatctgtattctcagatgagatgggtctctagtttgctttttctgttctgtttgctgggttttagtatcaatgtaatgcaggaatcttttcttctctctctattctctagatttccagattctagaaaatgtaaataacattggtttgattttttttccttgaaggttggtagaattaacacaagactatgtgattgtgctatttttggtcaaatttatacttttttttcctatggtaactggtgggtttatatattctcattcttctgaaatcagttttggtaatatttgttttcacagaaaaatactttaagttttcaaatttgttttatggggtagagcaaagtattctcttattcttttcatttactctgtaactgtggttatttctcaatttctaattttgtgcatttgggtgttttttttttaattagattagcaagtggttaatctgtttcattgttttttattttcttttcaggaattggttttgcctttaattattctatcacttgttctctagtatattaatttctgccgttagttttattgtctttctgctttgttttaggtttatttttatgattcttttcttcttttgttgaatgcttaattcatttattttaattcattcttacatactaatataagtatttaaggctacaagtttttctttttctttttcttgagacagagtctcaccctgtcaacctggctggagctctggagtgcattggcgcgatctcagttcactgcagcctccgcctcctaggttcaagcaattcccctgcctcagcctcccgagtagctgggattacaagcgcacgccactacatctggctaatttttctattcttagtagagacagggttttaccatgttggacagcctcgtctggaactcctggcctcaagtgatccgcccgcctcggcctcccaaagtgctgtgattacaggagtgagctgccacgcccagcctacaagtttttctttaactactgctttagtcaaccatatcctctagcttctgatattttcattgtttgttgtcattttctagatattcaacaatttcaaattagattttctcttcgactaaagtggaagaatttttttcccgtttattttctacatgctaaagatttttattttcattttgttattaatttctagtgttaccgtattgtcattagaaaatatggtctggggaggccgaggcgggcggatcacgaggtcaggagatcgagaccatcctggctaacacggtgaaaccccgtctctactaaaaatacaaaaaaaattagccgggcgcggtagcgggcgcctgtagtcccagctactggggaggctgaggcaggagaatggcgtgaacccgggaggcggagcttgcagtgagctaagaaagcgccactgcagtccggcctgggcgaaagagcgagactccgtctcaaaaaaaaaaaaaaaaaaaaaagaaaaaaagaaaatatggtctgtactactagtgttaccgtattgtcatgagaaaatatggtctgtactacttccattttctggctcagtatatagccaattaaaaatatactcaatgggcccttgattaaaaaaatacagtctgtttcagtatatgaagaaatttagattttctcattatcttagtttttgactgtcatgatctgtcatcagctgaaacagtctcatattttgtttctactttttttctacctttgcatttgctatagattttgctttaagaatttttatgctatgttttttggtgcataaaagatcagaggaggtagaccatcatgtgttctagttgttaacattatagtgcccttctttgtcttatttattgcattttgcctttaattcaacttatgtatgaaatgagtatcataatttattttttctttaattttgaccttaattcctttgttaaacatatttattgaacacttactgtgtgccaggcactagaaacctatgaatgagacagacaagatcctgccctcatggagcttacattttagttagagattggagcagaaaataatcaagtaaaaatagatatgtgatatgatatcaggtggggatgaagatgaatactcaaagaatgaagtagaataaggataattaaatgtaagttgtctctatttttgataaagtagtcaggaaaggcttctctgcctggtacacgtttgtcatttttttactttccacttgtccatcactgtgtgtgtgtgtgtgtgtgtgtgtgtgtgtgagagagagagagagagagaatatgccaggtggaacagtttgcacaaaagggattgttataatcttaatgatctataagtgtgcaaaggcccaaatgagaagatagtgggtatgtctggatatgaatttctgatccacatgagtggtgagctgaccagaatgggggagggataagaggagaattaaggacattttgtcttccattctgtctgaatttggctattattatgtgtattattattttttaaagaactatttccaatcttcatcatgattattgaatggatattctgtatgatgatttaattgaacccctggaatttcctgtcactgggcaggacttagcatgatgctgattgctcacaggctacagcaggaaaccagatcttgtggtttagagggcttaactctttatactctgaggctaaagagatgtcttttaactttagtcagtgtttattatacagaagtttgaatttttatgtaaattcaaataaacctggacttatttggaggttttcttctattgcttatgagaatcttatttcacctcacaatgatagtctttttaattttctgataggtttttcttatgttatatatgtgcataatatatacacatatatatacacatataacatatataatatattaaaattatacacacacacacacacacacacacacatatccatgactcttgatctggaatttattttggtatataatatatgatgtagctccaaaaagcactgctttgcagttatctcaaaaagatttattaaataatatttctttatctcctttttgggggaagattatgtatatgatgtttttataggtagtctgctttgtttctgaactttctattctgttttgttgatcaataacacagtttcaattacaattattttataatatactttatcccttacttacccccttccccatttcttctgtagcagaatactctttaatattatatcctgcttttattacaagttaattttctaaaaattctgtagttaaatgtagtttaaaaattcctattgagaattctgattggaattgcattaggatatttttttttttgagacaaggtcttactctgtcaccccagctggagtacagtggtgcaatgatggctcactgtagcctcgacctcccagtctcaagctgtcttcccatctcagcctcccatgtagctgggactaaaggcacgcaccatcatgcacagctaattaaaaaaaaaatttagagacagggtcttgctatgttgcctaggctagtcttgaactcctggacacaagtgatctacacacctcagcctctcaaagtgctgggattacaggcataagccactgtgtctggccagaaggagatattttaaatccaaaatagcagataactatgaatgacctgtgtggtgttttttgttacaagtataaaaacacagaaagtatatatatctaattcataatacaggttgcatctagagaggcaataggggaatggaagtggagagttatgtgaagggtattatttcttaagaaacagtcataaaacataaatggcaaagtattcaaacttactaagtctgggtgataggtaggaacatgggtattatggcaatcaatctctgtacatttctaaatattcaacatttttataatgaaaaacaaacaaaaacaacagatgaggcaggataaccaggcttgtaagccccagaaaacagcacatgcaatctgactcctataaacagactggggtagtatgtgtatatccagactttggagctaaactgttcaagttcaaatcctagctctaccacatactagctttatgaccccaggcaagttacttaaatgctctatgcctcagtttccccaactgtaaaatcagtgcaatagtaatagctacctcctggggttattgtgaggattagataagtgaagacatggaaaccacttaaacagtgcctagtatttagtgtgtgctcagtaagtgttagctatcattattataatattattattactattattacatttactacacatactacattgttttgtggacattttaaattttatataaatgttgtcatccaaaatatgggcctatctgcaacttgcttgtttttctcagtactcatctgatgttttgcagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggaagaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaagtaagtacatatgaaagatactaggtctctgaagaggcaggcagcacaagtttgaattttacctccactatttactaactggatgacctcaggctggccagttaaactgctcccagcctcagttttcttacctggaaaatgggtataatgatacttgcttcacatgattgttatgaatattaagataatctacataaaggatatagctccatgcttagcacatagtacatgctcagtaaatatcatgttcttatccctaaatatctttattaaagtactatacttttccttagtgtgtcttcatggtatccatcaatttctggcccctgatcccaaaggcattgaacacttgttgcctatactaggtctttcccagaaacctggctcaggcacttttcctgccttctcttctgcttgccctccagaataagaggccagctcacaacctgacctgcctctgctctaggacaagtagcctgggcttctaaactcgtccccccacaaccaccagcatcaaaggtattcctggggctgggtgcttcatgccttgataattccttacaatagataaggacattctttttctcttccactttctccccctccttgtttacctgcctctttgcattcatgtgggtgtgtaataggtggtagttgacagggtgagctgcctgggcagggaggccaaagcaagagtgtgttctggcagcaggactgccagtgtttgttcactccactgagccagttgtcatctgcatgccctatagtgcatggttgggtttttttttttaatttcttttgctccaaagcaaaagccccaggaccatcattgctattattgctcagtgctctggctgtcagcagctccacctgctctcctgtggagagctcagcccactctctgctggggctgaggttcgggaggcaggtggcttataagtgctttccttaactctctttatagcaggaatttgcctgagacttgttgcggttagaagtaccttgttatcatgtcttttattgtcagacaaatctgtgacttgtctatgtggagctagttgatcagttttccagcccaagatgccataagcacagcatttacagggcctggctcccaggcactgttaagaatccttcatgagggggggaggggggagggatagcattgggagacatacctaatgctagatgatgagttagtgggtgcagcgcaccagcatggcacatgtatacatatgtaactaacctgcacaatgtgcacatgtaccctaaaatttaaagtataattaaaaaaaaaaaaaagaatccttcattagatcccatgtggctgcttctcaagctgttcttctacctggggagcattctcattgtaattagaaaacattttgtgaaaaatacctgtgattgttatctatcatagcagggaaaagggaaaatgacctcccaatagtaggcacttaacaaatatttaagaagaaagaacaaataaatgaatggatgaacatttattaagtatttcttatataccagacactgccagacattatgtatctatttcatttaatcctcccaatagccctattagccattattatccccatttgacagatgaggaaactaactaattccaagttacacagcaaacattcaaagccagagctgtctgactccaaagcccatgcttattttgccttcctaggcagcctctcccagagagatcttgttctttccataggccaggagtcacagggtcctcttctctcctgtagggcaaggtgtaccagaggcagcagttacaagccctggttcttccttctttgtgtagctccctttgccttggcaccttggccagacagaaagaaatcactattactagagatcttgtaacttgctccagagatttatttttaatgactctaggatgtaagggaaaacatttgtttgcacacagctctgcttgtgactacaaaatcaattagatgctcctttgagtgatggagatttaaggaacagcatcattcccaaaatagctaatttttttgattgcttactatgtgccctgcattgttctaagcactttgggtaatgattgatttaatcatgaaaataaacctatgaaatagttaccattcatcttctccatttcttagatgaaaaaagcaaggcccagggagataaagtaactttatcacaagatctcaggtagctcactatgcttgctatatcatcccacgatctctgggctcttgaagaagattctattccagaccctaggagaggacagtgtcctagccagaaggaagcagctttaagattttgtaagggacatatagatgcataatattttgaatctaaaatgcaaacaaagatatcctaatttcagccaagttaaactctagtacctttataacctacatactgttctgttaaaaaatgctgggatacacacagaagccagctagtggaataattaagtattatttaagtctaataactgattcaggtataggtatagcttgctttatggactctatgcatttcctctcagtgctctgtgaaaggaatctgctttttgctttgatgtttactacatagaccacctataatcacttccctattaatggaggtgataaggaaaggatccctagaatatagtgcctaatgtgatatactataatatgatgcagggatgtgtatgctggggaactgagtctccaattagcacatcctttttttcctttataacaccttctgacacagaactttcacacataccctaaatatttttcttgtagataggaattccctaagttcagaccttcatattccctccagaatattctccattatctgctaacatagatatactccagccagaaaattccttacatgtaggcttttatatgatctcaagttgtccctttggcagtatagcatagcggcttgaagcacagattctagagtcaggttgtccaggtgcaaattgcaggtctgtcatttaatgtctggtgaccttgaggaagtcactgtacctcatgttgcctcatgttccttatctgtataatggttttcatgagcattcaattatatatgtatatacctatgtgtgcatgtatctatcttaggatggtttctggggcatggtaagtatggtgtgcatgttagctagtattgttcttttatcagtgttacaagcttgaaacttacatataaatgaatttacctaggataaaaaatattggcgggcccaactttcttttgtgtgatgaattaggagacagcatagcatgaatcagtaaatagctgtggagccttttaaccattatttttgacctttaagaactgcaaatagctgcaaaaatgactaatgagtttctcctattttccctttcaaacagctagaggttagcgaaggggtagtgacacagacaggtggaggatgggagtggctagcaggcaatgagaatatagtgagggcgggccaccccctagcataaaccacgggcaaaattatttgcccctccatcgctgagacctaacattgtagcatttctctctacttccttcctcacaccagactggaagctttgatggcagaagaggccaaacccaagccagcatggaaccagaactactttttttcctgagaagttctatttcatgggctggggctctgagaagcaatgcctcagccccacaggctttggtgaacccaagacaacagggtctgttgctatacttgtcaagcccctgggtgccactggttccatttttttccccatttcattctacaaccatggaggaggcaggagccattgggaatatgccagaagtggagagatgctatcccttttcaggctgaagtcctgccctacagcaggcaatgtctgaagagttcatgagagatgtggtgggcggtgacaagtccctggcagggtgctaactgcagcctccaacatggtgaccactgttgaggtcatgggtgacctctttgctgtgggagatctgcagcagagggtccatttcaagtaggagtggcattggaaaagaaaaaaatgatgagagtgtccaggaaagccacagggtgcctttgtaagcaagaagactagatagagccaggatgggttgagatccaggggtaggtctgagggaggccaacaggcttggagaaccaatagataaggtctcagatacttctctaccacctagcccctactttgggatccacatactggggtcatgcaccaaagggatgatgatcagaaggcctgccaggttttctggattttaattgagtgttaatgaccaaaccaaattatctcgaaagaagtctccctagccgatgaagtcaggggcatggaaatagccttctaagttcttaaaacttacctttacttaactccagtttgccttcatgtggcctgtttacatttgaacagtgccttctccatttttttcaactccttggtgaagcagggttccatttttcagatggagaaattaagaagcagaaatgtcagcagcctctcaacagaggtgctcaaatggtcattctttgtttccacagacaagagtttcagcacttttcgcctccttcaggggccccaggaatccctacctcttactcagcttattacaatatttctgtggccaaggcagagctgctgaacaaactgaaagaccaacctgagatggcagagattggcctaggagaggaggaagttgaccatgaactggctcaaaaaaaggtaaagttttttgatgtgtcctagagattttcagaatttagcttgaatgtatctggaggatgaccagccttctacactctctagaacatctcgcattcccatattttcagtatggaaaccatacagcctctctggatttctcacagatccaagtcctgtctatttttgatccagtcaataataataataacaatcataatcatcattattgtctctgtgatccttagaacaacccaacaagggctgggcacggtggctcccgcctgtaatcccagcactttgggaggccaaggtgggtggatcacctgaggtcaggagtttgagaacagcctggccaacatggtgaaaccccgtctctactaaaaatacaaaaattagccaggcgtggtggtgggcacctgtaatctcagctgctcgggaggctgagacaggagaattgcttgaacccgggaggcggaggttgcagtgagccgagatcgcgccactgcactccagcctgggcaaccaagagtgaaactcagtctcaaaaaaaaaaaaaagaagaaaagaaaagaacagcccaacaaggcagatattactatcccttttttactagttgaagggacgaatttgcccagggattacagactaaatggtagatccagcacttgaagtcaagactgtctgaatttctactgtacagtacatgctgtctctctgaattaagccagccttgtaagtaactcactacccagggcacatcagagtttctgccagtgggctcctctaaccaatggcagtgccattgatttttattctttgtgcaactttgtgggagacagaagagactaagtaaaataaggacaacttataggctggcaaactttagtatttatttgcaaggatagtcaattatgtcttaaaagtacaaaatagttaagtggagatgatgatgttgttgtcgttccaaagctttcctttctttgtctaagtaccactagtctggttttctaatccaattcttggaatcactttcccctccctgcacttacctattgtatttcataagcaaatagggttgtcatggcaacctcaaaggctcaatttaccttctttgtggacatctaaactcaatgtaaattgttctgcccatatttctttcaggatatgacccgtaggaagttacagggccatttgcaagagtccttcctccaatttcctatctgaagcaaaatgtcaggggaagaattggaagcatggtggtgttgaagttttactgatgcagatgtctgcttccttggattccatgttccccgagcaggggtactcctagcttactcagggcctggcctctgcaggggcaaacctagaagtctgaccaggaaaagagagagatgatcagaaatggcagagcacagaacgacagaaagtgaactaaagtgattgtgggtgggctatgacagtttttgtctctgaggaagaaaggtgaggaatgtcaccaatttgcgatgtcccagaaaaagcaactcagctctggctggatctgtgatgactccacaactctatccatcacacttccccaggactgaggttcaggttgtagagcccaagttccaagaagtaaagggctctctccacttttatccttccatctatccctggagcttgggaactggggtaagaaggtgattttccaagtgggtcattttctagatggcccctagccatcctttgtccccagcattgacttttatttgggagagcagatggtgggaatataactgacagcctcttcatctaattgtgttgccttattcatatcactgatccccagttctcagtgggttttggaactttccccaaatgcaaacctattatacttcagactgagatcatggtgatctcctgacttttgaagagttctaaaatatgacaacaggtcttggaacctggaggaggctttcttagtcttggtcactttggacatctctaattaaattactagaggggaatacattccagaaaactacaaacctatgggcccagtgcttgggctagaataagattaaaacatacactgaagcatactcctatgaacaagatactattctaaacatgtaacatgtgttaacttatttaattctcataacaactctatgaggtaggtcctattgttatcttattttttagatgtggaaattgacgtgcagagaggttgagtaatttgctcaaggtcgtatataataccactactttccagcagagcaggagttcaaactctggtagtctggcactggagtctctgtgctcttaaccacaaagcagtactgtctacagaggctatgggcagcctgggacagggccattcttgtcataaccttgcagctagacaagtatctattagtttggagtatgttgtagaactaatttaataataataataacattagtaagcatgcattgagcatttaagtgccagtcataatactaagtcttttacttatgtggtttcatttacccatcagaaaatctctggagttggggaggtgtccactttacagatgaggaaacagaagtgggattaggtatctatcctaaggccatagagtttggaggtggaattggaatccagatgtctccgactctaaaactttgctgtacttccctgtgactgtactcacctataggggagacaaatcagaagacacagacagcacttcccttaagaaacttacaatcattagcaggtgagagatcagacacacacaaggaatagaaagtgaggaacttcaagttacactatagggttctaattctaaaatacttaaaagctcggacaaaaaaagatcactgagagaagacttacagaggagggcttcctgtgagggaggggaggggcagagctgtcccctgaagaaatttaggaataatcaaaatgaagaaagagataaagagtaggtggaactgcataagctactcaggaacacaagaatgagtgttgtgaacacagaggagaatgaggagctaattctgaaaggctctgaggagggacattagaatggcaaggtggggccagactgagtaacaaataatagcagcctagcttttacgcagcacttactatgggccaaacactttgcatgcataatctcattgactccttattatgactcaatgcagtgggtaaagcaattatccccattctacagataaagaaagtgaagctcaataatgtcaagtcacccaaggtcccacagctacgaagtggcaaagctataaatcaaacccagtcgttataactccagaactcacagtcttatccaaaaggcctcaaaagccaagctaaggaagcaaagatctagcatagtgtcatgaacttgagaggtacttaaatggattgaaggagaatgaatgaagtgataggcaaataccttagtgcaaatgcttttccaacctaggctctcaaaaggactgtagctcctatttattaaatcgtcccaggaagggactgggtgcagaggctcacacctgtgatcccagcattttggaaggctgaggggggctgatcacttgaggtcagcctggccaacatcatgaaaccccatctctactaaaagtacacacacacacacacacacacacacaaacacacacacaaaattagcctggcatccatgacatgcacctgtaacctcagctacttaggaggccgagacgcaagactcgcttgaacctgagaggcggaggttgcagtgagctgagatcgtgccactgcactccagcctgggcaacagagtgagactccatctcaaaaaaaaaacaaagtgccagcaagtatttattaagttgcatctggtaaatgaagtttagtgcatggataccacttacccaatgccaaaaagtttggtggtgacatggagatccctaccagacggatagaaggtgcttgcccaaaagactggagttgctcatgacttgcccaagtttcctttgtttccagtgactaggatagagcccaccatctgttccttggattccaaaacagaggttacaggcacaaatcagtttctgttgatccccattctcatcctttgtcttctcctgtttaattcccctagatacagcttatcgaaagcatcagcagaaaactttctgtcttgcgggaggcccagcgagggctgctagaggacatcaatgccaattctgcccttggggaggaggtggaggccaacttaaaagccgtctgcaaatccaatgaatttgaaaagtaccacttgtttgttggggacctggacaaagtggtcaacctgttgctgtcactctctggacgactggcccgggtggagaatgctctgaacagcatcgattcagaggccaaccaggagaaggtagagttggggtctgtggggtgtgggtagagggaaataccatttgtttcttctcagggctccctctttcaagttgggctactataggaaacagtagagcatgggattaaaagcatgtgagcactgaggatgggcacggtggctcatgtctgtaatcccagtactttgggaggccaaagcgggcagattgcttcagtccaggagtttgagaccaacctgggcaacttagtgaatccccatctctactaaaaatacaaaaattagtctggcagggtggcgcatgcctataatcccagctactccggaggctgaggtggaaggtttgcttgagcttgggaggcggagactgccgtgagcaaagattgtgccactgcactccagcctgggtgacagagcaagaccctgtctcaaaaaaaataataataataaaataaaaaaataagagtgtgaacactggcttttaagtgccctgaaattcttgccctaccatttattagctgtgtgactgtggacaacttacataacgtcactctgcctcaatctcttcacctgtaaaatgaggtgagcatactacctgccttatgggattattgtgagaattaaattagtttatgttaattacataaaacagggcctgggacagggtaaacactgaatcaatgctagctcccagtagtagtagtagcagcagcagttttgcctcactctagagttggagggggaggtctcatcaagtatttgagattggaaagctgtcagtttcacaggttgggtcactatgcatatactcctgaaccaaaattgcatcacctttccctatacaggtggctttggatatacctttgaatccacaacaagaggcacatatctacatacatatacatacatacacagacacatacactcacacatatccactcacacagacacacacatcatacagaaagcacctccacagtgacagttgttcaccaggtgaaagggacacaggctggctttgtcagagccttcctccaccccaagcccagtggtggtccctacattgaagacagcgttaaagagatggaaagaggtaatttcacatcccctatccagaattgttgtcatgtttaccctcctgctacaggaaacaaaggcttttgcatggaggtagacttcagggcagaaaatctaggactgactaattagcagaatgtatagctgctttgtggcagcatctctggtggagtactgctaggcagcactgttggacagatgcctggtaattgagagagcccttacttggtcctctgcttccccagttggtactgatagagaagaagcagcagctgacggggcagttggcagatgccaaggagctgaaggagcacgtggaccgccgggagaagttggtgtttggcatggtctcccgctacctgcctcaggaccagctccaagattaccagcactttgtcaagatgaaatctgctctcatcattgaacagcgagagctggaggagaagatcaagctcggggaagagcaactcaaatgtctcagggagagtctactcctggggcccagcaatttctaattctaccagcactctgccacagcatccctgcccagccatgtgggaagtgctttcaatcttctttgttagcagtttctcagcaagtagatagcaattagcagtttgttccagccctctaccctggatgtctctcactaccccttccctagcagtggtcctaaccagctaggagaccctggggaagccacaagcttctacccaagggagctgcagcaaggtgtgatcttagaaccacactctccttcccacagttgccaagggcaagtacttgctgcacagagaaccaaggaagtgccttcattctgctttgtactaggacaccaaagacatcaagtactcatcacccacccatatcatcaacagcctctaaaggctcagagggaatctgccttgcagctctactctgccccagggcttgtggccagccatttctcacagagagctggctgccttgagggcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggtaagcaagtgccaaggcgttgaattgttcccaccatagctaccgatgtctaggaaggagttttccccttgaactcagagcctccctactgtggcctggccttgtgcttcccttaaagtctaagtgacttgagtttagcattccccagcagggtttaagtttttcttactgatttctttttgaaaccaaagaaatctcctgaaatggagaaaggttcagtcatttctctaccatctccaagctatgggatcagtagaggtgagctcagaaggaactcctctaaccattgctttctcagcctgtggcctggctcaagggaaccaaaactcaaggtagctgggagctccagccagagccagctccccagagcaattgaagacccagccaggatcttaggcatacaaacaactaaaactgctgctgttgccaaggccctgacaccagtagctagtttctatgctggaaaagcagccctcaggtggacgatggcaagaagggggttatggccaaatgctgccctgttatccagcttagctccctgttcctcactaactggggccaatccttggtatcacacaacccagccaaggcctggcatctcttctagttactgctgagttcctcagggtccttgaaggtcaactgtagcagcagggatgtctcattcaaccaaagaatttgccaaggaacttttgctgctgttacaaatacttgtcactagcttccatttcctcttcattgtatttgaaaacaatgggagaatcttggccagcagggtgtcctggggtagggggtggggtaagcctttctgtggagctctgggtttgctcttagtactgctgccagaaacactgttagaatggcaaccctgccattctcccctccagtggaagattctactttattcaggaaggctggtggcttgcaggggctaggcttacacaagccagccaagattgagaaggtaggggagtgctttcaatggaggccatagttgtcatcttttcttctgagcaggctctaggacaaacaatgagcaaattgagatgtcctgtattgggaggatgaggctgatatgtttcatcattctcagaatttgtgggctagagcacctttttgggaatatgggcctagggaaaagaacggtcacttacctggacactatggccatagtcttgagtttttctagtcagcatgtgattggttgtaccttaagtttatgacaccaaaaatactattaactctgttatttttgttcttaatcccatctcaaattagtttctagagttagaatcagaacacaaggatgctcattttcacatggagggaaagttgccaaagcatttaaaaaataaccccaaaagtatatctagcagtgaagcttggtagataaaggtgaactgctaaacagacactggcgtgccacactcctgccagggcagtctcattgtgtgtgacggtgctgcaacactgccagtattacttgagatgcagtctctctcccctgttctcagttcctgggctcagccctcctccaaggcctgccagtgagtagcagtttggaaggcaggccaagggagatccccaaagacagttatcagtcttaacttctgctgtctcccgtcaaatacttatacaggcccccatgggtaataggcaagcatgatggctgatagagaagtcagtgcatgagttactatcacatgtccccccaacccctcctgccacctcccagggctctggataattgaatcttcctgagtcccacagctggagactcaaccaggatatagctgtaaatgcccaagtagaatctgacagaataagacagagacactgaaaataaagccctagaaaggaagaaattggaagcaaagaaaaggagaggtgaaaagataaaaagcctccttcaaggttaggttcaggttctgttttccatttaacctcatgtgccataaagctgcccaggcacaccagagccacatcctgaacccgaccctccctgacagtgctgctctgccagtagcaagccccagatggaggaagctgggcccatttctggccacttccacccatttggagctttgccagaggagtcgtctatgccaataatatttctgcaacagcatattatattatttgaagattagtagatctttttgggggggtggggcaggggacagtttctatagatgaagaaccagtgttggttgtacagctgttgggggtcatctatcccatgtgaagctattctttttccaaatcttgttgtttctgcatttgtgtcctccaccactcccttcttggctgacatagatatgcctgccagattgtcatcaagggtcatatttcaataaaaggtgctaaggacaaaaaaaaatctcatgtgttttaactcaggtgatggaagtctaaagattctgctgaaaagtactggaaaggaatttggtcacctatccatagtccttcacagataaacatatgaccagacccttacccacatccctaaacccttaccctggcctctgagggatggtattgatgctataccattcatcatccccagttaaatagcaggatctgccatagcctttttaggggaacagcttttagacatctatttcaagaccatcctgagtagggggtacagagtttaagccattggttatttctgttgttatcacagtattgaagcatggtatttttctactcagaaggatctcaggatcacagccctgccctttagctcactgatatatttcttcctctctggttactcagtggcaacatcacatccagtctaaccccatgtttagaatgcagaaaaagtcaacaataggtgtaatctcaggtatagacctaagcagtatacagagtctagttctggagtctagcctgatcgaaggtaagccattctttctagacttcttccaatcttgaattctgtctagtattttcatcttacttctagctgatagtccaatctcacaccttcatgctcagctccctggaaagcaagggccttggtgatctgctctccaaggcaacctcaaagattagactcaaatgtattccaggaagcaactctgacattgaaaagctttcttttttcgtgatccatattctgttcacattccaactatcctccttctactcaagatatccattgtggtagagtagaaagagtccagctttggcattagaatgaactgtgttcaaatcctggttctgccacttattcaatgaacctgggctactagctcaacttctgaggtcattttcttatctgtaaaatgggaacagtattatcttgcttgcagttattgtaacttgaaaataataaataaaagccactaacaatccaagaagttattaggcagaatcccaggcccaccccaaacccagtgatagcagtctgaattttaactagatttccaggagattcatgaacatattacagcatgggaagtactgacttgttgaaaacatattcagtacatggtaaccattattatagtcctgatctactcaattcattttttccttatcccaggcatattcttgctcttctcgtgttgctcacaactacctgcctggatgaatttaggaaagttgcaggatacaaggttaaaacacaagatcaaatgaacaatccgaaaatgttattaagaaaacagttccggccgggcatggtggctcacgcctgaaatcccagcactttgggaggccgaggcaggtggatcacgaggtcaggagatcaagaccatcctggctaacacggtgaaaccctatctctactaaaaatacaaaaaattagccaggtgtggtggcacgcaccagtagtcccagctactcgggaggctgaggcaggagaattgcttgaacctggaaggcagagattgcagtgagctgagaccacaccactgcactccatcctgggcaacagagtgagactttgtctcaaaaagaaagaaagaaagaaagaaagaaagaaagaaagaaaagaaagaaagaaagaaagaaagaaaacagttccatttacaatagcat

SEQ ID NO: 4520 - DNA, 222397 bp, human
ccggcggcgcctgagcccagccgaggatggagaaccggcctgggtccttccagtacgtccctgtgcagctgcaagggggggcaccctggggcttcacccttaaggggggtctggaacactgtgagccgctcacagtgtctaaggtaagaactggcggctgatgtcctaacggcgcctaactttgaatggacaagcgggtgcgaaggctgccgctggacggggccctcaggccaactttgaaacttagggctgggagcgaaagaccctctgagcggcacggaggggtcttgccaccagtccaggtgcagacatcccctaagggtggctggaacacgagctgggagcacaactggcccccggctagaaccttgcgcgcagacacactcgcgagggcgctggggcagcccttgctgccccacgtcggggcggctacttccctcagtttgggccgaaggaagtggaggctgttggggatttctccttggaggcctctgcgtccctgcgggacagtgaaggactgaagggacagtcatcgcggcttggcagctctcttggcagcgttgtcccctctatcgaccggcgggccgtccctcccaggcaggttgcagggctaggggctggtgtgggaacggagatgaggccattggtggcttttgccagccacacttcccacggccggacgcgcacacatccattcagctcttggggcgttgttgccgccggttcggctcggcctctccctccctccagagtcctgccccagcgccggcgagatttcctgcacgttgagaagtgtggaggaaacttgcgccatggagcgcagctgtgctggagctactgctgttgctgctgccgctgccgccgccgccgccgccgccgccgccactgccgccgccgccgccgccgccagggtttgtttgttttaggagtctgtgatctgctggaagccaagttgcagctgaggacaggagagaggagctctcctgagtgctccagaacccccaaagcgagcctcccccgtaggggtgagggcgaggggtaggggcagctggagctgttaccaggaagagtgacttgtgggacgactcaccttgaggtgccagattgccaagtgaacggactttacgaactttattccacttttttgttgtttctcttaaatcctcaaatccgaaaagccctcccgcttccaacccgcttaaatggcagttgaagttgtagatgtgggttcaggctggagatagaaagatgtgtcttttcagcagggagcaaatatcactttttttttgcgggggggtggggttcaacattggtcacatctcagcagagggttcagcaaacgtccaccgcaacacacacccacaataacctgtgcggcattcgccttgcattggagcctgtggttgacttccagtgtatgggatccttcaggccttggggcccacactcttagcaaccctggagtgttgccatgggtgtaccaatcagattgaggagtctgaggtatgctgaggcaacattttgaggggctggcagggacccctctgatcattagcctccccaaactagcccagatcttcatccagcaccctttcccccatacttgtcatgtactttaaccagcctgagatgcgtttgtcatccactgtcacaacccctcctgaggcagtctccctccagtgttctctggagaaagttatatgctttttttttttttttttttttttaacaaaaacactcaactcctttggtgaggggaatcctggccttcaggaatttcttctaatcaagctcctcctctccccactctttccaccaaggtcacaatgggatatgcagccctccatgatctggcagttcctccctttctttttctcctcacaccgcccacagaatttccacagtctgcctagacaacctgccttggagaggtcatttttcagctctgcccagagctgacccatcttgagaagcaccccagagagtgcttgctgctgtggtcccggattattttgtgagccagtgagagcatggcagggggtgttactaagtatggggcagccagcaatttgtggtctggctgggggattatttgagagggtagatgagggtttccttggccaagctgtagaggaagtgcttcgtgtgttgagaggcagggtgccttttaatgattccctttccactgaatgtacagttgacccctattatatgaaggctcattatgacatgcatttagatatgcaagggataaaattatttctcccattcctcccaaatagcctagttcttaacagtaaaagtcagttataactgggttggcttcaacggtatataaagggaccatagtatttttttaagcacaatgattgcctgtattgtgtttttcttgacaagacactgttttggcatatttcattaattccctcttcatttttcaaccttgattttatttccttttatgattcagaacaatacagctttctccttgaaaacagccttcttagtctgtacacactggttgggatgggtggaaggtaatagaaagataattgggttggcagattaaaaacttgggttctaatcctttttctgccactctctagttctggaatcctaggtatatcacttgccctacctgggtctaggcatccccatatctaaaatgacattcaagtgggtggtctttaaatgatactatgacaatctagtagccatgtttttgtttgtttgtttttgagacagggtctcactctgttgctcaggctggagtacagtggtgccagctcggctcactgcatcctgtgcctcccaggctcaagcaaccctcccacctcagcctcccaagtagctgggactacaggcacacgctaccatgcttggctgattttttgtatttttgtatttttgtatttcaccatgttgcccaaactggtctccaactccttcaaacaatctgcctgcctcagcctcccaaagtgctgggattacaggcgtgagccaccactcctggccaaatagctaatcttttatgctagctctggctctcttctcagaagtgttgctgcagagtgaggaaaatgaagctttgcttcatttgcatacagtgttactatttacaatgtgcttcctcatcctttatttcattactctcttgcagctacactgtgaggcagtcaggaaagattgtggagaaactgatggaaaacccgagactgatgtattcagtggcttacctatgtctatcatactgagagtcaatggcagtcctactaagagagtttctgattcttctgttagtactgtggtttgtgaaggagcacagggcaataactttcagggatgtatctagtcttattagcctcctaatgcagtgtccctttccatgccagcctgtaattccatacttggtgacggactgggttgtaggtacactctgatggagtctgggctcagagtaggaaaggactattttgatgaccccaaatcacttgtgatgatctcaggtcagggagagacagaggtaaggtgcaggaagcatggtggaaaatggcagagaacctcctttgtggaaaaaaaaccagaagcggtttgcatcagggatggtgtggcatacatgctcagagatatcttgtggcacaagtggagatatctggggagtgggggaatttgaaaaagtagtgattagtgggggaagagggtatgcagtgtgaaagtctagttcatagttgtcatgggagaccctttggaccaggaaatgatcaagttggggaaatcatcaattcctgctggttcctatgatttccctgaatatggggaattcaactgcctgatttatggacacttgtatagtaccccccgacagtcaagtggcaaagaaagagaaaattttttaatactattgctggatgcggtgtcttgcacctgtagtcccagctactcaggaggcttaggtaagaggaatccctagagcccaggaattccaggctgcagtgtaccatgattgggcaacatagtgtgaccccacctccaaaaaataaaatacgattgattatcctaaataataagggatagtttatgatgtttccctatattgtggtgtttcgagtgagatcatggtaacaagtaaaagatacatgacccataaaggaatagggcccatgacattggcattattgattcctttggttaacatgttacgctacctcattgactcagaagtactgtctggatggaatggggattctcttctaatcagatgtgtctgatgatatgtaggctcatgctaacatattttcccttttcttggctcgtttatggtagatgtttctatctggcatagtgaagcaagtggggctagttactgccctggaacaaaacagagtggggtaggggagtaacctggaggagaaagaagctttactcccatccacttgatgtgctctgatattgctatataattttacactctccagacccaagtctctatttgcagagtggggcctaggcataactgccccatctctattatcacagatgatgagacaatgaattaggcaaactctaatagtgtttgccatccttagcctaggacagtggcagggcatgctcatcaagttgttttagtctgtattccattcctagtctgaccttatttctagaagcacacagagaggcagttgagacttcaagaggatctggataaactcagatagaggttgtcttgtggctggaagtaaatttggctgtgattttgaattcttattgggtgcagaggtggtattatgtgaacaatgagagttcctgtgaaatcttttgagctgtgttacagaccagtgcctggcactcacaaagggaccttcgtggggtgtgcatctttggagcttagtccagcctggttacctacatgaatcccctcctcatttctgcctctagaatcaccaaagatgtccactacctcagtttcccacctgctgccctatcccagaaagtagagggcattttgaggcatggattagaaatccatcagagagatacaaagaaggttggagggaggtggagcaagaagggtgggtggtatggctggtaacccttggctgagctttgagtcgatactacttttggccctgctgggttttcataatacacctggtaccccattgagagccacatgtatgcttgctgaagttaaaaaaggtcaagcctattagaggattttccctctccaaaacttcacacaaagaaaataattcaactccattgtcccttaaaaaaattaaaatgatttccccccttgccttccccaaccccctccccaggaatttctttaaagaaaaaagagagactcagacttgagattggaggttatggatgattatctggagggaacatcatggcttttatagttagacttctttagaactaagggaaaaaagatgctgacccatctgagaaaagttaatgaagaacagcagggattatgggaagggctgctctcactgcctgcccctctacccctcaagcaccaaggggcagacttaactcagtgctcccagagtaattctgttcttggtagagacctagaatcaaagaatctcagagtaaagagagccttttagaagtcacctagtctaatcttaaccatttcatgagcctcctgtgcagtgtccctgagcttgttctacagtagtcacaggggagctcattcccttctaagcctatccattctgttgctggaaagttttgactgtggacagcttttcctttgttaagctgcaatcgttttccttttagcgatcatccatgggtcctagctgtatcctctggatagcatcacacagaacaagggtgcttcctctgtcttgggacagcccttgggatatctgaaggcaaatattatatcatcttgtttcacttttctagcagagccctagctctttcagctgttccttatgggatgtagattccagcctctcctcctgtttcctcctcccactcatgatgcacttcagcttgtccatgttcctcttaagttatggatcccacagctgaatactgtaactgaggagaatctgaccacagttgagtatgaacattctttaaaaaaatacagctgaagatcactttggctctttctggcggccatgtcataccaaggccctgtgtcaaaatcttttaatggaagtagctgtgctgctattaagccatacctgcctaaggcctctatgaaggcatctgggacagccacataatagatttgggagggacacatttcatctcctactatttatttagaattgcctctgcccctagccctggccagccttggtaaatgcatcgtaggggagatgagagagaagatataagccctgacttcaaggaacatgtatgtttaaacaaagagattattaagttacagagaaggaatttgtataatagaagaaggaaatggcatttaatgaatagtgtcaaagtcagaattccagatcttttttatttcctttttacctctctgaacttaattttttccccttctggaaagaatagttgtctccaagattgaagatgctaaccatatgtgccatacactcttcaatttacagagcccctatgtaggaatatagagacagcagtctctgtccctatccactgtcagatatatatttccctgcatacctccactgacactgattggaaaagcccctgctgttgctgccatccttcagctctgggttcttctgtctgtacctggaatacacacaagagtgactcctgctggaggtcttgcatccacagcctctttctccccatctccccacatttaccagttgtcatctgagctggaaaaatatctttcgttactactaaagcctcgatcagggagtggattggagtggggcttaatctatattattactgaagggtaaggggtctgaggaagagagtgtagaggtctaggaaacgtgtcttcactgacacaatgttatttataatggttacattcagaacagttctggagaagcctatttaatccatagtgtatcattgattaaattacacaacctaaccatcatttataatgtcctatctacaggaaacagaattcaaagctccaagctgcttatttatagaagatattcttgggaaacaatgcattcataagttaggaacaaaaagtgctctagatagctctgttacacagttctgggggagtttgggattctgctaccattagtgcccaaggtgttcatacctttgatgctgggaccagatgtgtgtgcatggttacatttccctctgaaacggaattccaggtttccctgagagttatcttgtaatcagcaagtaacgtttttatattggttatgtcggtatcaagatcactttcactcagcttccatggagccaaaattttgtctcctggtgctccctgagatatactcccttcacacataattcaataaaatcattaatgaataagttgagttactattttttatggctaaagattgggttccaaggactgggaaggggtagaggtttgtctccttatacctctttgccctatccagtgtaaataggccaagtggaaaaattgtcttacgcattagtgttgcaacggatgatccattcttcctcacatcacactggcatgtttgcttggtcagatagccatcctggccacgcactgaagttgcaaaagtcaagatgacttgatctttcaaagtgagctctaacctctcccctttgacttcacatccacatcctcctctttcactgtgaatctatgactgtaccatatcgcaacacaagtactgcctagtagcaacagagacacattttccatgcatctaggctgtccttctttcatgtcaagtctttagttcccatcccccacccaagagcaccagttgcttgaggcctacattttggaccgtctcattcaagtgccattgcccctttgttcattcattgactgccctgccctctgtccaaaacccaacttttttttcttttttggtcacagtgagcccttctagtctgctgtaccagctttgtccctcttggctcagccatgcttccagtggtggcggggaggggtggtgggtagggaggagggagagagaagctcacagagttgaggttgataggtttgaaaacaatcagcaaatcataacagaatcagagggaaatttcctcacactgcatctctctctatcctgtttcagtgatggacagaatctctgttcttatattcttttatcaacttgctgaataatcatggcatgctactttggctctccacaccctcctgtttcttctcataccctccatgggacaagttcttgctttactgaagggttgctaaggacccttacttggtctaggctgtggaagtgtgaaggctgactgacagcaggcagctcttggagtgcattgcttttctccacactcctacttcctatctttctagaagtggctgtttcctggtatgttctcagggaggacatggtctgttaactttcactcaactcttttaatgttacatctgtgaggaatgcgggaggtgggactaatttgacaggatcaagggttaagcccagttacgaacagcccctttgtggtgtcttctgtcccccaccctaatgccactcaacagtttcctagctgtatgatcttctctcttttttcctgagcctctggcagggaagttttcaatggttctcctatactgcctttcacggtccataagaaactgatttttcgtttcggggagggggttggaggtgagatgaggtagagctagaagtaaagctggtttgactagttattctggaaaggagttagagtcttatggctgtagccccatctttacttatgagaggatgacaagctaaagccttgtctttgttgggctgccttgctgttttccatttctttttgtttgtgtttgatataagtaaaagccaccctgaaaaattctacaggtaggcagctttggatggcatcttactctgactgagagtgtgagtgatgacatcttgaagcttcagggggtaagtatcaggcttgactctcacattctgtagaggatttgacaagagtttggagctctgtattaacttaaattggcgatcaggaaggatcaagacaacaagcaaaagtagaccaggcaaggatttggatacttcagttgtgtggctgtgcctcattgagttcagtaacctcttgaacccaaaggtggtcaaagcctagacatggtgggatcggagaggtagtggaccgctgtatagcaaatactgctattttctaggtgttttacatgtattttcatttaacttttacagtaactctttgaggccagatattaatgtctccattgtgcagatgaagaaccgagactcaggagaagttaagtgaaagactctaagtcatatagtaagtgggacaactgacattcaaatttacttctgtccaacttcaaatcccatgctctttctaaaatagtgtgtttacacaggtgaaagacagagaaatagaagagaactagataagaatgagaggttgggggacagacggagggagggaaatgagggaaatgaaatttgatgcagaaactgataatattatgagtatctattcctcagaggtcagggtcaaaggaaggtctttgttttgttttaaatctcaaatcaaggtaaggggactgggtcggtattcagaaagcctaaagtttagtcccaactctgccactcttcatttgtgtgaccctgggaagtcattttcatctctctatctcaattgccctatttgcaaaatgagagtaatacaacctgcgctgttgtccagtagggagagagattcattttatcatttatttcatattattattagcagtatatgtgatgtaagaaagcaagcaagcgcattccacaggtgtcccttattaaacaggaattctcttaagaaaattttgagcctaaaaattgaagtgtatgaagttacctaatcattgggaattatgtgaaatggcagggcagctttcgtgtaatgtctgctactgcaaaaagttggaagaccagccatgatttctgctaatgtctgaacagccagcactttgaaaggctaacatcttaagagctctcagttaggcctccaatcaatcaatcaatcaatcaatcaactgatcaactaaccaaccaaccagtcaacacagatttgttgagcactttgtaaagtgcctaaccctaaactagagaatacaagagttagccaccatagaagacctggtttctggattctcaaaagagatgacagttttgttgaagagctgcattactataagcccaggaaacaaaaagctttaagtactgaaactgtggggtaggatctaagagcaacatttattcagtgggaagagatttcattgtgggctgatgtagctgggtgttttgtgaaaaaaggaagaattggagctaggccttgagggataatacaggatttaggtaggtaggcctgggaggaagaaggacgttgattccagttactacaagcactgcatgtcctaaagacacagacagaagactgagaccagtttgttcactccacagtgtgttgactaacagcataagggcagagcatgtagtgtttgttcatttatccacttattaattcattcattaaattttattgagtgcctgttctaggagctgagctattcttcctatggccaatgaaaccagcacagagctccatagatgtcacttttatttgttttctaacaaatactttatagtgcatattctgggcactagttttctaacttaacacatattagctcttttattttattttttgagacggagtctctctctgttgccaggctggagtgcagtggcgtgatctcggctcactgcaacctccgcctcccgggttcaagcgattctcctacctcagcctcccgagtagctgggactacaggcgtgtgccaccacacctggctaatttttgtatttttagtagagatggggtttcaccatgttagctaatttattaactccattttacacatgaggaaattgaagaaagattaggtgacttgcccaatgtcatattgcttgtgtggatggctacataagtgagtcagtggagatcttcttgattcttgcagactagtgggatataaaggtgaatggatttgagccaggtattctggataccccagaaaactgggctatagaatggatgcaagttggaagtaggtagccattttgtggtttggataatcagtgtattaagaataaggcacctagtctatggtcataccaccctgaacctgtccgatctcatctgatctcaagaataaagcacctagcacagtaccagtcacataattgcttccatgaggaaagacctgaactgaacaatagataggtaaggtcattttgaaggaatcagcccatcttggcaatttgctgacttgtcatacattagtgagttgccagaagttagtgataatgcataccattgaagaaatgaagaagaggtaggagtcagggattaatctaatatgtaaaatctagaaggctctgagagattatgggaattgggaagaccaaccaggtttagttcagttttggatcttctgagactgaagtgtctgtaggccaatcaaaaagtccctaggcagttggggagcatgtttatttaaagccactgatcagttaaaacaacaaagcattattttaggaacataatgatcaacacagacaatttactaatctactggttgttgtggaaacgagttaattgccagacaatcttatgccccaaagatagtagaacagacctgcattgttatttaatgggctttcctggccatagctttgtcttgctatctcctccaatctgtgggatgctttgtcaactgaggtgttactggctaaagttcattttgtataacttagaacttgaagtgataggaatcacttcttggaatgcctttccgttgccacttttgtgcaacatcacccgattttctacatggtgaagaactgaaaatccgaatgttgtaaagatgcttatgccatgcaacctggtctaaattaactccttccctaccttcttgtagactaaagtcacttcttgctaaaaggctaatgaccacatgggttcctttacctagctcctctctctaacaacatgaaatagcttgtaatttatatttgaaattgatttgaatctgtagctgctggggagatttttgtgtaaaagattgcccaagtgctctgatttttacaagcgcctgcttgctaacttccctctgttgcgtgagccctggtgggaggctgatactctccttttctggaggtaaggggctcaagatgtaatttgcgtgtttttcccatgcctttggctgaagaaaagtgcagtgttctgaaacctgcccagaccttgcacatactgtatctgcttaaagagggttttggctcttagcccttctcagctgcattagggttcaggttacatccctctccccatctagccactaataaaagccaaaataattaaggatcagggagagttaattcccactgctaagacccaggtggggcccttccatctcccatcccctagcttggagccctaatttaaggctgaactttagtctaagtctataagtgacagtgatctggaacaggccccagaaaagcacttgacaatcaggttttgccccatgctggcagtacgtgttctctctctctctctctctctctctctctcctctttctctctctctccttccctccctccttctccctctccccttccctcctttccctaccacgttggcatcttagaggagaccagtgaccccagggatcaagccaactgattctgttgcagcaatggaaataatgtatcatacttccctttcatctaaactgggagattcagatgaagcttctgttttttttcaagcccttgacccaacttcagtacaacattaggagcctcattcagaataagaaacatcattgatatatctctcaactcaaaagagttgcatagtaatgagctcttagtgagctcagatgggaaagggcagctttgaaggaggatcttgcaagagctgggacaggcaggaagaagcctcattctggaacaactacactactgtagtggcctcctcaatggtttctttccctttgatcatcccctcctccctcccttaaaattatttaatggttccctgctgcctgtagaatagagcccaaactacttttgcctggtattacagaccattctccatctggctccagtcttagcaatccttccaggccccaggttttcaggcagaacggttacctctctgttccccaaacccacctgggaaattctggcctccgattttctcaccatgatgttctttccagtggctagacttcacactgcatccttggaaggacttctcacttctctggccctctccataggacctaaccttcaagccctacctctaagcctctagggcatcatctttgattgctcctggtggaagcaatcagaacctcccctctgaaatgccggagttctgattttccagtagctgtctttgggtactttggctgtcttgtgtttggtttgctggatcaagatcttctagacgacaatggctgtatcttctatatattttccatagtcagcacagagtagactctccatcatggtttgctggtttagataatatgtaagaagagtcaagcaaaaattttttactccgtgattggtaatctttcccctttccacttccaagcctaaattagagaatatgactagatgatctggatatactggccaagtttcccaaactttgtgtgacaccccacctaagtggggtgagccttgaatgacacacacatgggaactagaggcagagggaacacttagaagaaaataatgttggggacagaagttgagaaggatcccagaggcaacccaggatgagaaggagcagtagaggatggggttggctacctgcttgtccccaggctgcctgaagtttggtttataacagttgaatttcatgctgctgctggagttcctgtgtgtaagctgtgttccgaggtttgcatgtgggagaggccggctggctgatgattgcagcatttcctatggtgttgggacgcgttgctgtgagactcttaaaacaacagccatcccacttgttgctatgtgtttaaggtgggtgtagtgtgtgtcttcagtgaaactcaagtgtttcactgctttagctgagaggcagtagctttgggtgaacacactctgtgtgtgtatgtgtgaatgtatatgcatgtgttttcactttttcttaagcaagctctgacatgttgtgtctgactggccttggatgtgagtcactgtctggtatttatacccagtgtcttaagtgtccttattatttgaccatgatattgctattctccctattttactcaaagctgagaatgctgagaagggccaaagggaactcactctgtcttccttccaaatggggtctaatctcattggtggttaactgtctctgtggcagtcaattaggttatgtaagggcactaaagggaacaggttgaaattcacagtagtagtactgtgacagtttaaaagacacactatagggcttctcttagtttgttcctgtccaggatactgttggagagttcacccactggaatgactttaggaacaggcctcgaaagggccttagcacaatcacaataagtatgaaaggagtacaaacaaactgagaaagccttagagaggagatgatccagcctttgcaggcattggtgagagaagcagagaatgttagcttcctccttactgttgtttgtattaagtccttccaagattgaaaattttgtcttagaagcaggctcatagagtgtgggaatggtaaaccccatcagaggcactgttgttatcaaagggacagagcctcagataggaaggacatggctgctagcatggtcatttggaggccaggcagccagtaaatcatttgagaatgagttaaaggttcaaagggcaggagggaattctttgggtgacctcataggtgcttgaaaaatcaaagggatagctcgtgtgcttttatgttttcaggcctggttcggagggtcaagggaatggaaatgcacagtagaaaattggcattgctgtttttatgtgcttgggaaccctaactccgggctggtgatcgtcagagttaccattaattagatgcatattttgttctgggaattttatatgcatactctctaatcttctcatctctacttactgtaaattaagtagtagtattcctattttacagatgaaaataatgaggttcagaggggcaaagtaatgttctccaagtaaccaagccagtaagtggtagagctgtgatttgaactcaactctacctgaccccaaatcctatgcttgtcctactataccttaaaattttacttcagccccaaagcccctttctgtgtttcatattgtctttttaataccactgttaactatgatgactatattctgtgtttcatagcattggaaaacgtgggtttcacagatcagtcagtttacaactttgctgggaagcttgttaaaaaacacagattagactctgaggatgaaataatataatgcacgaagaggtacttagtagtgtccctattccaagatgcagaaattgaggctaagagggaagtaactttccagaattcattggaccagtaactggcagggctggtattcaaaatccagtttatctgattttagagtgcctgttctttcccatgctcttgttgcctcccaaactagaaggggagtaagcaataaacaaaaaaccagacttgaccctctcggcccctacaaacctacccttcttactgccctctctgtcaataaattttttttaagtgaggggtggcctccctctctccctctcccctccttccttctcttctagcacaatttatttatttaaatgtttattttggggatagatgataaatgttcatggaacaaaatttttaaaactatataaatgggtacatctttcttcattcatgtccctaaaccacctaatttcccttcccagtggcaatcactgttaccaattccttgtgtactcttccaaagacacccttccaaagatacattatatgtaggcatgttgtatatgctcatatacgtgcatgctcagtgtctctgtttcctcactgcctgtcttcctgaatcctctccaatctggcttccaatgaggtcttcctgagggccaaatatactggccttctcactgttttcatcatccttgttttctctatacaattattgtttttcaataatttgttgaataggtaatgtagttatgtggtttaaaaggtagttagtatgaaaaggcggagaatagtttcccagtcatccttgtctctcatctgtccagtttcaccactacctcccactgtgcttagatatttctgtgtgtcttttcagagcctctctatacatacacaagcaaatgtcaatatagattctttattttgccttttatacaaaaggtagcatactaaaacaatcttttgcacttcgcttttttcacttacatatcctagagatctttccctatcaagcatacagaaggttatctctattttttaacagccacattgtatttaattatttaaacagttcttagtattgctagtcattggcattgtttccaaaccattcagactcgaccttctccaaactctgctgccagtatagctcctgtaatactgaactctcctgtttctgcatcttctcttgctgtttctccattctcctctgtaaatcgactgcctctcttatctctatcctgtggatattcctcaaggctcagcactcagtccctccccccgcactcttttctctgtttcttctttccctattctccctccccccatcctttccccctctcctcttttcctcaagaaagcaacgatgagatctcataactcctgaatctctagtcttaatcttttccactgtctgatagtattcactggaatatttcttttttacctcataccccagtatgtctaaaatggaacttatcttccccttgtaaaatgggctctttccttggcttccccactcagctagcattaaaatcatggagtcattgcttactcatcccatatcccacattctgtcagtcttgcttcctttacaatagccctcatatccacctgcttcttttcaattcctgctactcctaccctcttccaagctcttattactttatgtctggtttctggattcctggctggcttccctgcttctaagatcactcctgttaaatttatcttataagacacttcttctatccaagaattttagtttccctttctatacaatgaggaagctggactgactggttcatctcagaggtgggttaaaatcctagccctaccattccttccacctccgacattctagaccagaactccatcctttccacctctaacattctagaccagaaatcttcccagtgtctccccacctcccaccatttccactctctgtactgttctctttcacttgaattgttgctatggctccatgctcccagcagtgccttgaaaaaatctttcttccatattggtcctagagtctttatcctaaattaacttacagttgaaaggaatcttagaggcaggccatccaagctgaccaacactaacctgctgcctgagtgccattaataacacccttgaatttggttggtcagactgttcttttgaatgcttccattgatggagaacattatctcataagccagccctttgtattgtcagatagcaagagttgttctatatctcctaccacaaactgacaccaactgatctgcctttatgatactctattattaaaaacttgcttcatcttgatttaagttcaaacccctcaggtctggcatccgaagttctccagaaatatggctcctatcttcccctgtaggctgaaatcatggatacttcctttgcacttcatccacattttaaaaaatagctaatatttattcagcacttattggatgccactgttctaagtgattttacatgtattatttaatccacatggcaactatatatgtttctattattcttccccattttatagagaaagaaaatgaggcatatggaaatccaaatggtttacccagagtctcacagttagtaaatggtagagctaggattttaacccagaaaggctatctccagagcacatacccataatcactgccatacacagtcagcctcaaatgtgacaataattttctgaatatgcccagtgacttgttatcatggtttcttaaaatgcatttctagtcccagctacctgactaaatcttacctgttccttgaagcccatcagaaattacccttccttctggtcccattctaccccatcttccatctggtgctcaccatgttctttctaatgagctgggcatgcttgttttatatacttcatgggatatgctccttgagggcagggcccacagacataaactgctggattaggcttttaaccccaaatctgttccatagagcatttaacaagtagagctaggctttaggaacttctgaaagacttgagatttcttctttttgagtttgtatgaatctcctctttctaaatctggctctaaattctttctttcttaggctattaattcatttctgtttattgcccaatagttttgcacatttgttcccaggtactctcagggccagaaaacaagtgttgttatccatggttttatatatatatatatcatatatatatatatatatatcatatatatatatatatatcatatatatatatcatatatatatatcatatatatatatcatatatatatatcatatatatatatcatatatatatcatatatatatgagatatatatgatatatataaagatatatataaagatgttgttatccaacatatatcatgtatgagatatatatatatgcacacacctatatttatatatatttatagacacatacacatatatatatatatatatacacatttatacacatattcatacatatatatactgggagccaaatgaggaacaatattaaaaagaaatttcattacatcccttatctgtgatctgacttccttaatatttataacttctgatctcctctcttccttgtccttaacatgtattactatgctaggtagataaataggtaggtaggtacctcaccacacaatctagagattgtgaatctagagactgtgaattttagtgtgtgtgtgtgtgtgtgtgtatgtgtgtgtgtttgtgtgtgtcagagagagaatgatggagggtggttgggtagttggagggacagttttttgagtgcaaagcttccttgtcttctgtgctaagaaagtctctttaaaatgctgcgtcctgcagaacatccctcccccaacctcctccttctcttctatttcttctcttaatttcatagtgattgtagtttcccatgtgtattttgtaaatgagttctgtctaaaatttgccaagctctctgttcgagtgagatatgctcatctagcatgttagacaacaacatgatttactacccagacaggctaattcagcgggtaacacatcattctctgaaggatcacggtactgttaattcaatgtgtaccaatttaattatatttcagaagttaaaaaaagttaaatagctccagttgcagtgttctagttcactaagcattgactataaatcattagtggttactttacaaatttatgttgatgcactggctggtattttacataagtataagccacctacctcagggtgtctaacttggttttgtaaagtacaaaatgtgctcttgatttctctctctggccccataatatcttcatcaacccccaccccaacccatacaactttcacagggcccctttttttctcccttcacatatttcatcagactctttaaggaagtcatagactggttgtgattattactgaaccatatgggaaccacacatctttttttttccttctactttcttgtataatggttatgacttcttaaatgaattaaaaagccccaagattagtttttaactattgaaagacttaaggccaggtagccctgctttaatttcatcattcaaaaaagccaaagttagtaacccctcttttttcttttcttttagatatcacctgaaatctgttctccagaagggtgatactagttactgcaatatacattagcgtgcagcattcatgaccctttattgtttttactaaaatcttcaggattagaagggtctgggagtcattagatagtctcctcttccaaaatgggttgtgcctactagataaaatttgactaaaaagcaatgatactgatttttttctccagtctttacttttgtattttcgatgtcagaaagtatattcatatgtcttgttaaaattttacattcatctaacttactttttattgtagtgagaacatttaacatgagagctacaattttaacaggattttaagttcacaataccacactgttaaccataggcacaatgttgtacagcagatttgtagaacatcttcatcttgtattactgaaactttataccccttgaatagcaactccccatttccctctccccctggctcctggcaaccaacattctactctctgcttctgagtttggctattttaggtacgtcatataagcaaaattatgcaatatttgtccttctgtgaccagcttatttcatttagcataatgtcctccagacttatctatgttgttgcatattggaagatttcctctggaatgatatttcattgtgtcttatgccacattttctttattctttcatccatggacatttaggttgattctacatcttggttattataaacaatgctccaatgaacatggggttttaaatatgttttcaagatcctgatttcttttagatgaatacccagaaatgggaatgctggatctagtatgtagttctagtattaattttttgaggaacctccatactgttttccatagcagtggcaccattttacattcctacccatggtgtacaagtgttccagtttctccgtatccaacacttatcttttctcaaaaaaaatggccatcctaataggtgtcaggtgatatctcattgtggttttgacttgcatttccttaatgattagtgatgttgagcatcttttcatggtcctgttggctgtttatgtgtcttatttggagaaatgtttactcaagtcctttgcccatttttaactggattttgttattatgctgttgagttgtataagttccttatatgttttggatattaaccctttatcagataaatgctttgcaaatattttcttccattccataggctgccttttcttttttttttttcctgagagagagtcttgctctgtcacccagactggagtgcagtggcatgatctcagctcactgtaacctctgctgcccgggttcaagcgattctcctgcctcagcctcccaaatagctgggattacaggtgttcaccaccacacttggctaattttctttttttgtatttttagtagagatggggtttcaccatgttggccagactggtctcgaactcctgacctcgggtgatccaccagcctcggcctcccaaagtgctggaattacaggcgtgagccaccatgcccagcctaccttttcactgtgttaaaagattcgttagttgtgcagaagccttttagtttgatgttgtcccacttgtttatttttgcttttgttgcctgtgcttttagtatcatattcaagaacccatggccaagactaatgtcaagagccttttccctcacattttcttctacaagttttgcagtttcaggtcttatgtgtatgcatatggtgtaagaaagtggtttgatatccagttttcccataccattcattgaagagactatactttccccattttgtagtcttgatacccttctcaaagatcacttggtcgtatatgggtgggtttattttggggctgtctcttctgtgcccttgctctatatgtacatactgttgattactataactttgcaatatcaattgaaatcagggaatccagctttttcttttataagattgttttggctatttgaagttctttgcaattccctctgaattgtagagatttttttttcctatttctgtaaaaaatgccactagggtcccagcacttttggagattgaggcaagaggattgcttgaacctaggattccaagaccagcctggacaacatagtgagaccttgtttctacaaaaaaaaaaaaaaaaaaaaaaaaaaagtcaggcatggtagcacatgcctgtagtcccagctactcaggaggctgaggtgggaggattacttgagcctgggcaatcaaggctgcagtgagccttgatcatgctactgtactccagtctgggtaaaagagtgagaccctgtctcaaaaaaaaaatgccattaagattttgatagggattacattgattctagatcactttgggtagtatggacattttaacaataagtcttgcattcattagcatgaatgtcttatttatttgtgtctttgatttctttcatcaatgttttatagttttcagtatacaagtcttttgccttcttagttacatttattcctaagtattttattattttaggtgctatagtaaatgggattgttttcttatttttttgaggtagtacattgttagtgtatagaaacactgttgatttttgcatgttgattttgtatcctgtaactttactggatttattagttctaacagtttttttatggagtgtctaggattttctccgtataagatcatgttatctgacaacatacaagatcatgttacctggtaagtaaaaaataattttacttgtttctttcttattttgatgcctttacttattttttcttgcctaattatgctgggtaagaattccagcactatgttgaacagaagtggcaagagtgggcatttttgccttgttcctgatcttagaggaaaaactcagcttttcaccattgagtatgacattagctgtggggttttcttatatggcctttattttgttgaggtaatttcattctatttctagtttgttgagagctttttatgaaaggctgttgaatttgtcaaatgctttttttgtatctcaaaatgatcatgtgctttttatcccttattctgctaatatgttgtatcacatttattgatctgcatatgttaaaccatctttgcataccagacataaatcccacttggtcacagagtatcatccttttcctgtgccattgaattcagttttctggtattttgttgaggattttcgcatcagttttcattggggatattggcctttagttttctttttttgtagtgtccttatctgtatcaggtataatgctggcctcataaaatgagtttggaaatgttcccttctcttcaatttttgggagcgtttgagaaggattggcattaattctttttcaaatatttgataaaattcaccagtaaagtaatctgttcctgggtttttctttattgggagatttttaatttactaattcagtctccttactagttacaggtctgttcagatttttttctatttctttgtgacagtcttggtcagtcatatgtttctaaaaatttatccatttcttctaagttttccagtttgttggcatatacagtcatgcatctcataatgatgtttcaatcaatgacagaccacttatgtgacagtggtcccataagattgtaataccatatttttactatactttttctatgtttagctatatttagattcacaaatgcttaccattgtggtataattgcataaaatattcaatacagtaagatactgtataggtttgtagactaggagcaataggctctatcatatagcctaggtgtaataggctataccatctaggtttgtgtaagtacactctgtgatgtcacacagtgatgaaatcaccttatgacacatttttcagaacataatcctgtcgttaggtgatgcatgattgtaattgtggtatcagttgtaatgtcttctctttcattgatgatttaatttatttgtatctttctctttttccttggcctagccaaaggtttgtcaattttgttgatcttttcaaaaaattaacacttcattttgttgatcttttctattatttttctattctgtattgtttatttatgttctaatctttattatttctttccttcaagtaactttgggattagctttttttccttatttttctagtttcttgaggtgtaaagttgggttatttgagatttttcttttttaatgtaggcatttgtcactataattttcctcttggtactgattttgctgcattccatcggttttgtacattctattttgtttttcatttatctcaaaatattttctaatttcccttttgatttttttgtttcacccattggttatttaggagtgtattgtttaatttccacatatttttgaatttgccagttttttttctgatattgatttctagtttcattccattgtggtcagaaaatatacatggtatgatttcaatcttcttcagtttgttttgtgacctagcatgtgatctattctggagaatgttctgtgtgtacttgaaaagaatgtatattttgttgctttgggtggaatgttctatgtttctgttaggtccatttgatctatagtgttgttcaagttcactgtttccttttgatcatctgtctggatgttccatccactattgaaagtagaatattgaagtctcctactattatagtattgctatctatttctccctttagttctgtcaatgtttgctttatatatttcggtggtttaatgttgtgtacatatatattcacaattcttatatcatcctgtgaattggccttttttcattgcacattgtcctttgtctcttgtgacagtttttggcctattttgtctgatataagtgtagccaccttgctgttttttggttagcatttgtatggaatgtctttgtccattcctttactttcagcctgtgtgtccttaaaacttaagtgaatctcttatagacagcatatagttggatcttgttttttgatccattcactcactctatatctctcaatttgggagtcaacccatttatatttaaagtagttattaatagagaagaacttagtattgccaattttgcttattattttctgtcttataattttttttttttttttttgagacggagtctcgctttgtcacccaagctggagtgcagtggctcgacctcggctcactgcaagctccgcctcccgggttcatgccattctcctgcctcagcctctccgagtagctggggctacaggcgcccgccaccacgcccggctaattttttgtattttttagtagagacggggtttcaccgtggtctcgtctgtcttataattcttttttcttgttttgtaatgtcttcttttgtgttttgatttctgtattgagtgatttctctttttcttttgtgtatattttcaataggtatgttctttgtagttagaagagtttacattaaaatatcttatagttattgtaggctattttaagctgattaacaacctaacttcgatcacatacaaaaactacagtttccccttcacacactttatgctattaatgtcacaatttacctatcgttttatttttatcattaacattaacatattttatatttacagtctaacacttttgccttttaaattttatactagaattaaaaatgttttacctaccactatcacagcattacatcattctgtatttgtttatatatttaactttgccagtgaatttcacacttgtctgtattttttgtattattattttatgttctttcatttcaacacaaagaactccctttaactctttatcatttcttgtaaggcaagtctggtggtgatgaactctctcgggtttttttgtttgtctgtttggtctggcaaaagcttaatctcttcatctttttgaaggatagttttgacaggtatagtattcttagttgctggtgggttttttttttttcttttagcgctttgaatatatcatcttctggtctgcaaggtttcagctgagaaatccactgatagtcttttggaggtttcttttatatgacaggttatttttcttttgctactttcaaacttctcttttcatctttgcctatggacaatttgattataatgtgtcttagtatggatttctttgagtttatcttatttgccatctattgagcctgatggatctggatgttcatttcctttcctagatttgcaaagtattttgcaactatttatttgaataagctttttggaactctttctctttttactctccttctggaacttccataatgcatatattggtctacttgatcatggcctttaagtccctttagctttcttcactctctgtaattcttttcctcctctgactgtataattaccaacgacttgtcttcaactttgctgatcctttcttttgcttgagtctcatgttgaacccctctagtgaattttttggttcagttattatattcttcagctccaagatttctgtttttttttttttcttttttgagacatggtcttgctctgttgcccaaactggtgtgcagtggcaaaatcatagctcactgttgactcaaaatcctgggctcacgtgatctcccatctcagcctcccatgtagctgggactacaggcgagtgccaccacgcaaggctaactttttaaattttttctgtagagacaaggtcttactatgttgccgaggctggtctcaaactcctagcctcaagcaatcctcctgcctcagcctcccaaagtgctgggattacaggcatgagccaccatgcccagcctgaatttttaatatatatattttatatctcttttttgaaatttttactttgttcatgtgttgttcttctgacctccttgaacatctttatgttagttttggctgtcaggtaaatcatatatctccaatttatgataccaggacatttattttgtccctttgtttgggatatatttccctgtttcttcatgtcccttggctctttgtgtgagtatctgttcattaaataaatggctacctatcccagtcttcatggcctagccttatacaggagaagaccctcatcagtcaggccagctagagatttagggggccttttaaagctttatgctattccaccctactttctttgttcttagcagggtaactgcaaggccaaaccgccatctctgatcacactggtcctgaaacagagtgtgctgggtcctgtcagtacttcaatacaaacaagacataaaccagtcctttgtgcatcccccacaaaaaaggttggagcacgggacacgtggtccaactcctttcctcaccagagagaagataggagctagggattttcatctgctggctctgtgctaagctgggaagaggggttatagcaactgctagcctaacatactgtctctcatctctggttccaaggtggctaggtgctaggtcccatcatcactctgagacaggcaaaactgaagccaatcttctggacagctcctggaaaagttggggcactggacatgtggtctaactccttcccttcctagggagaatttggaatctggtgagggggtcttcccaattgtatggctctgtacagggggaagttattatgctgacagggtctctcagatttccctgctggctttaatgtggtagtctcatcgtacaggagtctcttatgtagtttctggatttttcaaaaagggaatttgtctatattttgttgttgaatttgtttgttcatgtggttaggagagttgagggttttctattccatcttgctgatgtcactcaggatactgatttttatttgtttggaaaattagtcttattttattaatatattcactatgatattcaggcaaattgacttaattttacattttattgagatatatttgatgtacaataagatatacatggatatacatgtataaatacgtatataaattgatgagttttgaaatgtgtgtgaaactattaccataattaagataataagcatgttcatcacacccaaaagtttccttgtgcccctttgtaatccagctccacaacccccaggcaaccattgatgtgctttctatcactacagtagcttgcattttctagaattttatgccaatcgaattatacagtgtgtatttttctttgccttcttttactcagcataattatacttatatctgtctatgttgttgcatatatcagcagtttgttctttaatattgctgagtaatattcaattgcatagatatatcatagtttgtttattcattcacctggtgaacatttgcattatttctggctattatgaatagtttttcatagctattatgaatagttattcatagctattatgaataaagctgctatgaacagtcacatataagtctgtgtgaacatatactttcatttttctttgttaaatctatgaatagaatggctcatcatggttaaatctatgagtagaatggctgggtcatatggtaggtatatcattatcattttttaaagctgtcaaatcattttctcaagtgattgtaaacatcttaagtcaatactgtaggagggttccattcctccacattctcaccaacacttattatggtaagttttatttttttaatttagccagtctaatagatatgtattggaatttctttgtagttttaatgtatatttttctaatggctaatgatgttgagcatcttttcatctgtgtatttgccatatgtatatcatctttagtgaagtgtctatttaaatcttttgtacatttttattgcttgtaatactaatattgagttgtaagagttattttttattcaagatataagtcctttgttggatatgagatttgccaatattttctcccagtctgtggcttgcctttccatttcttaatagtgacttttgaaaagtaaaatgttttaattttgaattttcataaagtccagtttaatgattttttcttttataatttctgcatttgtgtcctatttaagaaatttttgccttaaccgatgtaactatgatttttcttttatattttcttctagaagttatataactttagctcttgcacttgggtttaggatccattttgggttaatgtatgttttgtgaagtaagagctaagggatttttgggttttgtttgtttttgcatatggacgtctagttattccaacactatttgttgcatatgaacatccaattgttccagcactatttgattaaaagattatccttttccaggccaggtgcattgactgacacctgtattcccagcactttgggaggctgaggcaggaggattgcttgaggccaggagtttgagactagcctatgcaacatagcaagaccccatctctacaaaaaaacaaaaacaaaaacaaaataaaaccactttttaaaaattagctgggtgtagtagtgcctacctgtagtcctgctatgcaggaggctgagatgagaggatagcttgagcttaggactttaaggctgcagtgagctagaatcacaccactacacctcagtctgggcaacagagagagaccccatctctaaacaaaacaaaacacaaagattatcctttttctacttaattgctttggtacctttgtcaaaaatcaattgaccttttacatatggatctatttttggcgacgccgttgtgtaacattaacccatatgtttatctttatgccaaaaccacactgtcttgattactgtagctttataatatgttttgaaatcaagtcgtataagtcctccaactttgttctttttaaaggtgttttggctattccttgtttgaatttttatataaagtttagaatctggccgggcacggtgtctcacacctgtaatcccagcactttgggtggctgaggcgggtggatcacctgaggtcaggagttcaagaccagactggccaacatggcaaaaccccatctctactaaaaatacaaaaattggctgtgcatggtggtacatgcctgtagtcccagctacttgggaggctgaggcaggagaatcacttgaacctgggaggtggaggttgcagtgagctgagatcacgccactgcactccaggctgggtgacagagcaagactctgtcttaaaaaaaaaaaaaaattagaatcgacttgtcaatttctatttaaaatggctgctggcattatgattgggtttgtgctgtatttatagatcagtttggaggagaattaatgcctgagcagtactgatttttctaatctaggaacaatgtatatctctccatttatttaaatcttatttggtttatctcagccatgttttgtagtttcactctaggtcatgtacatcttttgccaaatttatctctaagtactttcatatttttgatgttattagaaatggtttatattttaaaatttcaccttctgatggttgactgctactatgtagaaatatgtttgatttatatacattagttttatgtcctgcaaccttaccaatctcacttattagttctagtaaactttttctagattccttaaaattttctgcctgcctgatcatatcatctacaaataaagatgatttcacttcctttgcaatctgtatccaaacctcattttaaccagctgtacgtgacttggatgttatataacttctcattttattttattattttattagtccttattgtggtaagaacatttaatgtgagatctattcacttaacagatttttaaatgtacaatatagtattgttatttatgggcacaatgttgaacagcagaactctagaactcattcatcttgcataactgaaattttattcctgttgattagcaactccccatttccccttcttcccagcccctgacagtcaccattctattctttgcttccatgagtttgactattttagatattccatataagtagaatcatgtagtatttgtccttctgtgactgacttatttcacttagcataatttacttaagattcatccacattgttgcatattgcaagatttccttcctttttaagggtgaatactatcccattgtgtgtatcgattgtatgtatacatcactttttgttttccactcattcatctattgtaggatatttacattgttttcactatgtaacttctcttaaacctgagtttccttatcaataatatggagattgtaacagtacatactcagagggttattgtgaggattaaatgagataatgtggataatgtttctagtacaggacctggcagaattatagcccctatatgtttctcttttgggccctcctcctatttcacaaagtcaacatccataagtaatggttgtcctcctgacattaatttcctttttagtgtctctcatcagctaatttatccaaaccttaaaaaaaatggtttatatagtcaagctgttttaaaccatgggagtgatgtgctttctgtttactaattgtatacagttggacttaattttattagattttttttttttgagatgtattctcactctgtcacccaggctggagtgcagtggcgtgatctcagctcactacaacctctgcctccaagttcaagctattctcccaacttagccttccaagtagctaggattacaggcaagtgccaccacaccaggctaatttttgtatttttagtaaagatggggtttcaccatgttggccaggctggtctcgaactcctgacctcaagtgatctgcccgccttggcctcccaaagtgctgggattacaggtatgagccgctacgctcggcccattttatttgttttaaattgaccatttttaagcctttcatatgaagatctccagcttgatgctattgtccctgagatgtggtaaccagacctgtacacaatatcccaggtgagagcaaaccatgaagagggaatttaggggcaggatgaggtgagggagtgagggaagagagtattttctgtctttatttttttttctttctgtttctgatctaactagaccgataattgttttggctgaaatagcaatttgggctggtgtgttcaggaaacagtctacagtgactttcatatctctttccttgttcggagctgatagcttggagcccatattcctagagacagaatctgcatcccccccactccccatccttaaaaaaaatggcattaattatcttataattgtccctgctaagcctctgagtctgtatctggaatagctgggaggcctcttggtctcagcatatatgcgtaagtagtcagggtcagacaaaagcctccctggaagtgtcctgtggaccctttcagccttaaaacttctggttccaacatttgttttcccttcgtgagtgtaatatggagcttaacaaattatgttggatggtggttatgatgtttaattttgtgtcaacttgactgggctaagggatgcccagatagctggtaagacattatttctgggtgtgtctgtgagggtgtttctggaagagactagcatttgaatcagtagactgaataaagaagatcaccctcaccaatatgggcaatcatcatgggatctgtaggggtcccatccaaataggaaaaaaataaggcagaggaagggcaaattctctctctctcttctttagctgggcatccatcttctcctgcccttggaccattggtgcttttacttctcaggccttcagactcagactgggacttacacctttggctgtcctagttctcagtcctttggcttggactggaaccacaacactggctttccccccagcttacagagggcatatgatggaactttttagcctctataatcagtgagccaatccctcataatatctcccttcctatatttatctttatatccttttagttctgtttctctggaaaactctgattaaccaaagaccataactctgttgggagttttggattttaggttatcaagtgaaactcttatatccagctataaatacttgaaaagagatcgagtgagttagaaatgaaagatgaaatatctggatctatttggggccaaaagtttaatgtttgtctctacagtcctagtttttatcaatatgaaatcccctgaagacatagactacagggttgctactaacccatatagtgcttttgtgccaattacagaaagactgtcttttctgcaggtggattcagccctgttttgaggcatgagacttggcaggtggagcttaggttctcatttactccctcagcctcgggactttatgcactgtttacatgccatgtgatttcattaatagcacttttcatgatttccttttcagatagaactcacctttgtttctccaactccttaaatttgaattttccaattgtatcttatcactgccatcactgactcattttcagctgcagcatcctttgaggttgcaatgcaattttcctttttccctactttcttaccctttgcttggtataccatattgttgattctagatgccatgaactctgcctactacttagttggcttttaaaaattatcttattaatttaggtggctaaaatatctcatctgtatgcatagataattcagtgtctatttctcttcctttcttgtaataaatgggactgactgactcaagactcttttgcatacttttttacccaagggatttattacctaacagccacacaaagaggttctcactgatacgccaaacaccatgctgggagcttcagctgtgcctctggcccctgggcctattctctccactagatgctgccaccgcttgctatgaatttggaagaatcccaaaggccaccactccccacattccccttccaggaatgtccttccaggaagaggactattttcctagctctggccctaatcccaagcattatccccctctgacttctcttaacagcagtgtgtgttttgcagatggtgactgggtgaattcccagggcaggaaggaagaaccagagatagcaatgtccaggagaggagtgttggaggcacattgcgagactctcttcttcttcctgcatgttccagattccctgattctagcttaggaatatctgtacatacttcctgtacaggggcagtctatgtagctggggatgtagacaggtttccattaaccatttattggcctgaaatcctgatggagaaaatcccagagacccagatgattatccttggcttgctctttacaaactgttcacttcatgtttaagtcactgaatgcaatatccacagtactattttaattatttgtatcactaagcttgtgagttcttacaatgctaatccttcttttctgaaatctgggcacccaaaatagtcaaaccatcaacttttacctcattctatattacatcttcgaatcaactgtttcttttctctgttgtctataaagccctcttcttataaggaacatggactctgaaatccctcagacctgaagtcaagtcaagctgtgtaaactttgccttctgtaaaataagattaccattaatcttgctgaggagttgtgagaattcaataagagtatgcagacaccagagacttaaatttcaggcacgcagtctgtcatggaacaattctatatttatgattattagtggcctaagttttgaaatacttattataattaccttctaaaaacatttaatacctaaaacttatacagtggtaactcggccagatgctgttctaagagtttcccatctctctactcatttaactcttacaacaaccttgatgtggatattattagtatcttcatttcacggatgaggcaattgaggcacatataggccaagtaatgtgcctaaggtcatgtagctgggaagtgtcggaaagtgattcttgatctcaggctggcaagctccagattccctttattaaaaccactatgctataataaataagttttatggttacttttaaatatggtctttaaaactatttttacttgatgagcacttattgagggcatggatggtagaagttgagacaaaggaagaggaagatttaagttaatactttttaatgatcttacatctaagaaaggggatgaataaacatatgtgaaagacacaaggacagtttggaatgagtcaataaatctgtgaaaaagctgtgaacactttgctccatctgccaactttagggccttctagactagtgtttctcaaatattactgtgtatacaaatcacctagggaacactctttgattcagtaggtctgggtggagtcagagataatgtctgtctaagaaactcccaggtgagtctgatgatactggtccagagatcacacttcgagtaggaaggtgccacattgccacttaccaatagataacttgcaatgagggtctactacgtaatgcagtgctttctagttaagcaaaacatgttgaacacttttagctgattatatgggaacttgggtgataattgaagaatgtcatagaataattggctaaaaaattagtgtgatatgtgaagggtactcaagagtctgcagtagtctgagcaaaggattaacatggtcagaaagctgattcttgatacattgtggagggtggatagaggagaccagaagactggggtatgtccagctggaagactggtatggaagttcaggcaatgggagggtaaaggcctgaagtgtgatgatggcagtagaaatgggcaggaagccctggctttaagaaagattgattactacagaacaccaaaaaaatcagcacatgtaggatttcctcagcaatatagctcagaagtgactagcactctaatgtttgaaaaagaaatcacttccacatccatcatcttatttcatcaacacagaaactgtgggagattagtaattactttcacacccattttacaaatgaaagcagcaacttcaaccatttatgagaaaaagcgaacctaattgtaagagcaaaaacactgtggaaagggtcagaattattaatcttggtttttataaaattgactttttttcattaacagagtaatatattttgattataaaagtaatatatatttgagatcacactcctggtcatattgtctgtatccttccctccagttcttccacttaatttattatggttcttttcccttgtcattatgattgttttgaaaatttaattttaaattactgcataataataacccatgatatgaatgcattatagtttaatttattagctccatgtaattgcccatttaggttttcattttttgctattataaataacattgtagaaaacatctttgtatatacatcctcatttaaacatctgataatttacttaaaaacttaccaactctttaaaaagtcttcttatctatttacagccatctgatttaatgcttgataaaggatcatgtcagtctccagcttgaggtgattacctaagcatctcattgtcccagattatacagtgaactcccactgggctcccgggctcaggaagtaatgtcttggaaaattctcctgcattctagtgtcatcactgatcttgggtctcctcattctggtccatcagcaacaggtgtgactacccattggggtaaaacagtgaggggaaactaaataaatgcctagttcttgccttatcagctctttggggaaagagctgtgggattatgaaggaacaggtcaaatcaaaacactagtttatgtagcttgaaagtctatagagaggccggtgcggtggctcacacctgtaatcctagcactttgggaggccgaggcaggaggatcaattgagcccaggagtttgagacagcctgggcaatatagtaaaccccgtcactacgaaaaaattcaaaaattagccaggtgtggtggtgtgcacctgtagtctcagctgcttgggagcttggggtgggaggatggcttgagcccaggaggttgaggctgcagtgagccatgatcatgccactgcactccagtctgggtgacagagccagaccctgtctcaaaaaaaaataaaaaaaaagaaaaaaagtctttagagaatagcagatatgtaaatgatattgtggatgcttttgttttcttctttctgctaatttatatttttgtggtatctatatcaaagaggtaggaaggcagtgtagcatggatctggaggcagacagagttaaatggaaattctgtcatttattttccatgcgaccctgtgcaagttattcaccctcattcttcatctgtgaattgcagatagtgttatttatatgtagattttctgatgtgaatagatgatctaagccactaagcatttggtgctgtgtctggcacacagtaatgctcaatactaccttgtattattattattagatattgtctaaataaaaggttaaaatatacgtatatatatgtataaaatgtgtatatatgttatatttagaaataacacaataggtaggattttaacaaagcctagaaagccaattttgattggccctacttcaggaaagcagcttttctctggtactaggctgccaggggaaaggtgctgctgcccctcgccccagtgttgggggcctggtttcttagttacatagggctggctctgtttagcagccattgaattggaagactacaagatttggagccacagacatctggctcaaaggctggaagtgctctttcctagtcagttgcccctcagcaatttcagggaagcaactccctgtatctcagtttcctcacatgtcataacggcaatcatacttaagtcccaggattgttgtaaggagaattaaatgaaatgatgccagtatttggcttacggttgagtgcaaattcttttcttactggaatttcctcctggcttttgccataccacaccttccactgcttctctagctttggttaagcaccagttccctcatatgtcacacctgggtgagactttggctcttaacagtatccccttttacttgtcacccaagtcagatgttgggctcataacatgagtatgtaaaaatgtccttttcatcaggctattcagaattttacttcccagactctgtttcttcaacatcccccttacctgcccttgtgagcatgccatttctttctctttgcttgcctcagagtgccccacctcttggtcacttgggtgggcgttaagggctttccatatcgaagccaaacattctttccagcctgtaattcttaccccagtactcttcctggaagctggactgtctactggttaacccttcccccagacctccctctttgtattcatgcctaggattcttcgctcctgagtatgatctttgatccaaactgagcctgactctgacctcgcttgctgggtgctgattatttttgtacctctgatccattaggcatatgagctgtagtggaaagagccctttagataccattgactgtcctacccagagcccaatatcagccatttctaagaagctaggctgctagttaaggtagttgacactaacatggccctaaaaatattctgggcccaaactggtatctgctgtctaaactcagcattttggaggtcccaaccaagtatccagaaacttggaacagatccaaagcagcagcatcaggagggtgttggcaccacttgctcacaggcccttcatcaggagtactgggaagcaagtgaggaaaaacaaaaggattgttcacatggggagggtaattcaagacatgagtgtcaatttaaggaatgattatatgacaaaagtatattctggcaaaataatgtcagaaatatcagtttttgtgtttttaaagtttttttccttttatagtttgcatgtagaatccagtgctcataaatagtttgcctcctgataaattagcttgtttccttttatcagattaaggttctgaaacctatagtgtttgcctttgtgtcttggctgctgggaagctcagatcaaatttgaacattcgatgaacatatatgtaaacaaaaggtttcctttttaaataaaataacctcattttctgttttttttttttttctaaatctttcttttaattttatgaccctgtgacatcagaatttttttgtaaggtgcttcaaatctttttggatataaatggccacctggtgggtgaggattataatccttaatttttggccatcctgagaagtaagcaaaagtatttgagaaactccccagtctcccttgaacaggacaacatgccctttggggagaagtacctctgcaagcttagtttaagtgggatagagggaactgttcgtggtccttggcattttgcttttcaagagatgtattctcaagtcccaaggtgtttttttctgagattagatgtaggtggtttaagtgaaaaatagcacattttggacatgtcaacaagagtgttgttgttgcctaataccatactgagaccctagaaaggctggagtgtcttcttcagtgtgaactctgtaaccaatacatttgtacatctgatgaaagggaaccaggccctagcttcctttatcaactccaaaaatgtagccctaaagtcctcagtttgggaattcaaggggacaagtgatgttcatgtggatgccttagcaccttggagacctccaccgcaaaagtggcttattttgtaggctagcccttcttgcctgtattcaacctcaaaagagagatgacattgcctcagggaaaaggtgtcaccatcatcaggttaatttttccaaagcccatgtttgataatgtcatttttctgttcatcactcttctttggatctgccttcatgttcatctcctctgatctatctcaccgatggtaccctggtcattgcttttagctcaaacataattcatttgccaaaaagaaagtgcctttcataaagctgtgcaagaagcataggctttagtgtcagtcagacatagtttaaaccttggctttttcacactgaagcaatgggggacaaacctctgtgaacttgtttccttacctgtacaatgggtatttctctgatatgattattgttgagattagtatattaaggcatcatttataatttactggtcatatgctatttatagcatcattattatctcatgtattctctaagtcatgtactaaaattagcacataagacaaaaatcatgaatcgttgaaactcttcctggaaatcttttgtattgcagtacagtactgtatctgttgtgcatagaagtctatacagtaattctctaagtttgttaacctgtgagctgaactagagaaatgaacaaatgggaagtatttatgtaggtgtctgaatattcaaaccattctagctctaagatgacctcatggtgaataagggaacagtggagaattctagatgctttgtttgttgatttgtttcattttgatttcatattaggtaggcctcaaccttaagccatgttaataggtttgtggtcgtgaaaacttacattgtatgtaaagcacttagcctggtttctgtcactaccagtgaggatttaataaaatgttagttgttatttttcgtaatggtagtatgaatagtagtaatagtagtactcataagatatgtgacagcacctaacacagagcctggtacatagtcattgctcaataatgtttgctagatttggttaattggatctatatgtttactttccatattctttgtaagtgtagtaaagaagaatttggcaacctgttttctgtcttcccaagtttcctgctgtggccccttggtcattggtcacatttcaacttggagtttgttctcaagtaagcctctcaggtgaatgggcctgtgatgcactaaggatcagattgcacattatctgaaggcagggagtctgccttattcatctttgtatgcccacagttcctagcatatgataggtattcaatgaaggaatggatggatggatggaggaagaaaacgtttgaatcaaacaaagactgtctttgcatttgtgagatttaagggatgaaggttcaatttgagctattgctgattttggtcacctgggttttggcatcaggctctaatagtgctgcttccttgaaaccttgctctgagctagaaacagttatgctcttaatggggtctttctggcgtaagtaatcaaaagtataataactggctttgatacattgttttgagcacttcaagggagaaagggccctagaagaggaaggtggtagagcatcaaataagagaatgagatttggagtcaacagaaacctcagtttacatcctagttttgtcactttctagctgtgtgtccttgggaagtcccttaaactctctaagcttcagtgttttctcatctctaatatggggacagtattacatacctcataagtactgttatgagatcaaaatataagtgtacttaaaaccaaggtacatagtaactgctcagtaaatgttagctactattattgttgttaccacatgttttctctcctttccaaaatgaccgtagctttattgttttccacatcatcaaaagcaataatgtttgttgatttaatattaacttagaaaatacacagaagtttaaagaagaaaattaaaattagccacattcctacctcctagaggtaacaggcattgatatttaggtgtatgcatatctcacacttcattcttccatgtttatacacacacacacacacacacacacacacacataaaaaacaaggtcatattatatgtaatgttttctagcctatgtttttacaactaacaatacgttgcagaaatcttttcagatctacagaatcactttaatggtatcactgtattacactttatgactatataaatactacaggtattttcaccagtaccatattaattgacatttaatttgctcctaacattttgctaatataaacagtgcaacagtggccatttgtgtacgtacacctttgcacacttatctgattattttactaagagatatttatagaaaaagcagaattgttaggtcaaagggaattagtcacaccacataatggattaatctttattaaatggcataatgaatgggaggatgctgtgtaaactgtcaagtgctatgtaagtatgagttattgcattgcaactgttattgcaggaggcgtggcagaccaatgaccttatgggctagaagaaggcagaaggcttaatttctcccagatttccatgaatacacctagatgaacagatacacacaaatggatggttactgtttattctaatggatctacatttccactccctctcccaaactgccaaaatgaagaaaggttcttgcaatcttgaaattaaacaattgtttttaaacatggctgcttccagccaaatgttcagatctgttttttgccaaccacacagtttaggaaagcactcgaatagagaagcacaaggtctcccaagctgcttctgcctgagttgttctgctgcgctctagagaaccaagactgaaggcctggctactttctttgtgtgtgaagggagggtggggaaggcagatttggggagaaatacctttttactaagacaggggtggttggtcagttccagcttaaagataccttggtcacaccttcagtggaggcattcagctttctagtgagcctgacattccacagagttcaggccagtctagagagcctaactgacctacccactcctctggcttcctgtttttctagcagccagagtgcctcttgagcgtaactttattgtaagcattgttgagtagggggaagtgtgtgttgagaagtcttgaatctggatctcctcatctaacagcctgcattctctctgacttcaaaggctgggcattcatccaagaatgatgctcttggcctctgctagaaggtggggccaggtgtgggaatgcaaacagactgggggcctgtatgagggtggaaggcagcaggagactatgtgaccatggagaggagcagacgcctggtacttggccaggctccaccttacaaagggtgctccttgcaggaatgttttcaatgatgtctgtcagggagctagggctatttgaacctctaagtctgaattgggtgatgtttgccataagcagtaataagcatggaaataatttactctgggaccttgactgcattagtatgaaatcactggcatactgatggggcctattgatcctcaaactgtttcctgaattctctctgcaaatccattctttcctgtcccagcaaaccagttgtcactgctgactgtgtatgtatgctgctgccttgaaacacagtatgttggacttattcattcacctttctatccaggtcttcagctcactgagctgtgaaatttccccctcccaatctgtttacttttcttctgactttgtttgtaagcaaacctgtgtacataccttttcatgtgtttacatgtatttcttggaatgcatgctggctccccgaggctatttgtaagtctgtggctcttttatataaagggatgtatctcctctgagtgtacctagtcaggcacttcaattgagtgcagtgggggtagtccttggggcaggggagttgctgtgctggaagagtgattgacccttctcttggacaggaaggctttggtaagaccttaattgaattatgactctggagaacagggaagcttatccaccatcattgggaaaaagatggaagcttacactgactctggaagtaaacatcttctttttattccccccgagaacatgtggaatgaactcagatgactaatgcagtgtctagattcaaaagggcccttctgttcaggaaagtccagggcttgagatatgcaagtgggcttaagcagaggttttgaatggttcttatgttccccaccctaaccctagactctaagcccttcaagagtacgttgttatttttgcatttcctcactgggccttgtacaacacagacacttaataattggtgagtggattattaaggcagaagggtagactggttggcctactgagactattgatggccctacagactcccacagaactccacaggaaggaaggcttaagcccaggaggtcttgtttccagagcaggccttagacaaaggtcccgcccaaccctactcatgaagtaattggcagaatggctagaacaagtgaatgattgtgccataattagtttatgacctgagggcatgccagtttgtagccctgccagtctgctagctgccaccagcacagatatgcctcataaaagctcaagcaacaaagctgtggtcctattgggcctgcgacgcctaatgattcaggcctatgaactgagagaaactgagccagtgtgttaacatttcctgaactgaccttttctattttcattttatgcaaaagtaacctttatatttattacagctgttaattcttgctttaattgtaatgcttttctttttccctttctttcctttttttccttctttccttcctccctccctccttcccctttcttccctccctccctttcttcactccttcattcccttcctcctctccccttcctttcctctttttttcccctccttcctttcctctttgttttggagctgggagaatagttagaatagggcaagagggagcatctggcccattgtgtgacaataattgaaatcatttccttcggatctgctcaggaaatggctcagccaacatctccttcaagtctcaccctcctggcctgctgctggcatgattgttttccaaatattctcttctagtttcctgagagttcaagaaacccaaccttggtaatgagaaatctatcaacctgccaacctaattcctataaatgtatacaagactgttgatgccagacctcagcagatctggattctgaaactaggttttgcttctgaggttccatgagttcctctttcctttcctgcctatcaacctgcattatatttttactttagatgctcagcatatgtaatctttggacccattaaagttgaattaataatgtatacactatttgttgctgacaaaagcactaagcagctcacgttcataggtgggggaaaagatttacagattcctgaatacaggttttacatataagaaataaagcaatttacagaatgaccaaactcgaaggatggctcccatttagtgatttctttcagaactataaggattattgtttccaacatcatacaagcagacttaacgcccttagccccatccagggaatagacctaaggtgggaaattcttcactttttatatcttcttctcatcacagccaagttttcaaagcttaaatttcttctgagtgttttgttttgttggttgtgtggctcaaaatgaaggtatccttctcttttaacattgccagcaatcgctttacccacccagaatgttcttatttctatttattttgaaatgcttttaatgtgtccactgacttctttggtaggaatggtatccaagtctttcacaaaaaggctctaatatgtttatattagcctctatatctggggactactttgatttcatttttgaaggctaatcatgtatggccttaagtaaaacctccaacttagaaccaacattttgtttttaaaaagtaagtttgagattgagtccttgatgagaattatgactgtgtaattttcacatatttgtgagattcaagcacattattattatgaagcagtaataagctgtaatgaaccaaaaagacctcagttttaagaaatgtattttagttgacagtaggcatattaccatgactctaatagatgtatttgttattacttgtccccagatttctttttaatcacaacatggccaattctattcacagaacttataatttataaagtttaaggctatctttcttgatcaaaggtgtttccatgtttccatatgaaaatatttctattatggactagaggagttttgctcaatacatagcgttcatgaaaggcaaacagttttactaagagcctgtaattaaagcaaaaccattttttttagcaataccccacttatcctgaagctcagagaacagcctggactctggtaataagtttaaaaagaaaaaagaagcctttgagatttttcaaacagctgccagaaagcccatggtgcaggagaagaggccctcatgtcttgacctcagagagacccactggtccttaatttaatgggagcctgatatttcctcagttacagcagcaaattagaatttggggcggcaggatgggtgggtttgaggaggtagtttactctagaaatagacacagtgacagctaagtaacagacacccaggatggagaaatcataaaagcaaagacctggcaatgtggaataggcagatacccttacacatgaaaatataagattgtgtggtattgacatgccagattttgcttagccattctattattggagatttaagttattttaaaatttttactcttataaaaagtgatgctgtgaatggttctgcacaaattgcatttcttctgtttagagttattgctttctggtatcttaccaaatgtgtaataacgaggccaaaaggtatgagctgttttatagctgctgttacatgttgccagattgtactcccaaaagattaaactgcataagtgtgcctgttttcacagatccctgcagcactgaatgttatcatttttaacctttttgctagtttagtaggtatataagtatactatccatttgttttaattttatttaatgaggcttttcattttttagtgtcataatttgctgtttcctcgttcatcttctttcaccacttctcaagtaaaatctgggtaatgaccttatatatttttatccattctctatattttggatagtcagcttcatcatttatatttgtcacatatttttccaattttattgctttcatttttatgtatgctttatcatatttcactatgcaaaactattcctttttacatttatatattcaaatccatccatcctgtctctaatgtttctttcatttttcaatattcagaaatttaccactcctcaacagctgggacaaatatgtgattctgtcttccccactcccccagggtgtttttttcttttttgtgtttaatttttgggcccatctggaatttattcaagtgtatggtatgaggtatggatctaaagtaaaatctccatactgatatccaaatgtttcagcaattcaatttggcaaatatttcttgaactcctcctatgtctcctatgtgataagcattgtgttaagttccacaagaaagttttttttttaaatgaggcaaagttcatgctctttaagactgtgatcctgtgtgtgtgtgtgtctttctgtctcttgttcgccctctttctctgaagagggaaaaagtagtggtggcaggaataatgtaggtatttaaataattataacaaagcacaagggaaactatgataggtatcattaaaaaggttagaagcaagaagctgtgggaatttcaacaggtgagagacttgacccatttgagaccaggaaaagcgccaaggtggaggtgacatttaagggttcagatggttcagatggcagaaattcattcattaaaaaaatgtactgaatattctgacaggccttgtggtgggtcctaggggcagagatggacaaaacacaatcccttccgttaaggaactttcagactagcaagacagggtgatgacggtgaaggaaacataccaggtgaaggtagtagaaagggaaataaatgtggttggagaaagttacaaattggggaacagtggagattgagtctggaaagaaaggttagggctagtttaaagtagactttaaatgttaggaggcattggttctttcattgtttgggcctgcagaaagtttaagggtataacagtgccatgatcagcatagatttctcggccagttcatgtcatttggaaggctgttgtttatctgtttgccagacagtttacggaaatgtgaatgaggtagatgtgtgcaccatttgatatttgggatccttggcagtatcaattatactctttacagtgtctatcaatgtgtctgactgatctctataattggcaaagtttgtgatgtctttcatatattgtacctgcttcctttttagcaatccttcattctccctttcaagtagttagaatcacctgcctttgtgtaagttactaaggagatattttagagtgagtccaccaacatgactaaaatgaaatgtctggtacttgatggaataaagtttgggtatcttggatattcagttatgggaaaacaactcatttttactttctgctggaaaatgaggaggctatatgcatgagaccgaaaattaacttgaatgtagtcactcatatgagcatacacctaatgaatttgtgaaatattttctttcttgttgtgggcattgtgtttgttggtctatatacataaagcctacactacagaaattaaaccattggtaagcagaaccaactcatctgcaaatctaaaaatggattgtgatatggtctggctgtgtccccacccaaatctcatcttaaattgtagctcccataattgccatgtgtcatgggagggacctagtgggaggtagttgaatcatgggagctgatttttcctgtgctgttctcgtgacagtgaataagtctcatgaggatctgatggttttataaagggaagttcccttgcacatgctctattgcctgctgccatgtaagtcatgcctttgcttctccttcgccttctgccatgatcgtggggcctccccagccatgtggaattgtgagtccattaaacctttttttcttataaattacccagtctcatgtatttcttcatagcagtatgaaaatggactaatacaagttggtttccaaaagccaagaaaagcataataaaaggcttaaaaatcagtggtttaggagcaggacttccagaatggctgtgtgaggagctaaacatattctctccccattgaagcaaccacttaactggtgaaaattattgaaaacaactatttaaagtctctggaaattgacctcagggaattcagtatattgagatgaattaattcaagaaaatctactaggtctcaataagaataaaggaagtccagctagctgtcatcacctctccccaacccagctctttgtcgtggaagctatactttgggcaggtatagccaagaagatggggcatcctttatgccaagctcctagtcataagactacagtttcacctgaagagagacaggctgctctttttccccccactcgcagtgtctttttccccccactctcagcttcatgttttagaagctctattttgggttggcgtagtcaagaagactgaggttccttccccaccccagatcccacttgtagggtagaagttccataccaggaggtacagatcaaaaagatggggctaccatccccatcctccagctcctgcttatagggtgatatcacttaggtagaatcagactactaccatatcttcattccagtaaggaacgacaaaaattctgctcagggtgttaggaaagactggaagactggcaggtcagcagcgctgttgagggctgactttatttggaacagagaatggaaaaactcactcctaaaaggtgttttcaaaaacggtagagatctttatgttgaacaactagtaggaagctaatagttcatgtaactagaagcaacgaattaaatggcagaccagccagaagtttaacagacagaatcaaggggagagacagctaaaaagagtcctgttaagatcactgggggtcaggatggcatgcacatgtgctacactgcattgactcaaaagcaaccagaaagtgtacttgagagctactagtcactgcttgaacatggagccaatttataagtattccccaagccacacagaaatccatcatcaaagttctatatcattaaggcttaaggggcataagcacaattctgaccaatcactaggtaaatattaagttatactgacccaggagctactctgaggtaacaaagaaacaaaccaaggagaaaaaactgagcagtaacattggagatttcacagtgcagggaaattagacttcacaagattagtccaggcaaaccaccaaacagcaagccccatggtagtggtgggaaagctaatcagaatctagatttgttacagtatatcatctaaaatgcccagttctcaaacaattatgaaacatgcaaagaaacagaatagtgtgaccattgtacaaaaaaaagcaggcaatataaacaacgtgtgaggttgtaggggtagataatatatcagacagacacaaacacttcaaaataactattataagtatgttcaaagaactaaaggaaccagcctaaaatgagaaaataacaagtcaaagagataataaagagagaaattatagaagaaaaatcaaatgaaaattctggagttgtaaattacaacaatggaaaggaacaatttactggaggggctctgcagtaaataaggctggaagaagaaagaatgaatttgaagatagataattagagattatacactctgaagaacagaagaaaagaataaaggaaatgaacagagctccagaaatctgagacaccattaagtgcttcaacatacacatgataaaagtactgcaaggagaagagtataaatggggcaggaaaaaaatgaatgcataatagctgaaaatttccaaaacatgatgaaaaatgttaatctacatatggaaaatcctcaagaaattccaagaaggataaaggcataaagatatacacctaagtatattacagttaaaatgtcagaagccaaagacaaaaggaaaagtcataagagcagcaagaaaataaatgactcataatgtacaagtgaactccaaaaagatgaatagctgacttctcatcagaaagaaaatggagaccagaaggcaaagggatgacataatcaaagtgcttgaaggataaagatatcaaccaagaatcctgtatctggcaaaactacctttcagaactataggcaaaataaagacattctcagataaacaaagacggagataatttgtcgatgtcagacttcccttacaagaaatatcgaaggaagttattcaggctgaaaggaagtgatgtcacacagtaattcatatccacatgaaaaaaaactaagagtgctgataaatgtaattatgtagtaactataaaagacagcataattacatattcttatcttcccttaattgatttaaaaacaatagcacaaaacaatagcagtataattgaattgggggcctgtaacatatagagagatacttaacaatgacagcacagagtaggctgaagggaaggaagttgcagtggagcaagacaatgacatcaggtagtctctcaaatgcacaggaagaaataaagagtaccagaaatcataaataagaagctcaacataaaactttataagtatagttttatttcttttttgttccttcaaacagcataagattatttaaagcaacaattataacactgcactgttgagtttgtactgtatatagacaaaatatatatgaaaataaaaacacaaaggaagaaggaggaaatggagctatagtagagcaaatttgtaaatatcttactgtaattaagttagtataaaactgaagtagaatataagatgtatattgtaattcctagagcaataaataagaatataactttaaaaatagagtttaaacaactccattaaaaaggaggcaaaggacatgagcagatacttttgaaaagaagacatacatgtgggccaggcgcagtggctcacgcttgtaatcccagcactttgggaggccaaggcaggtggattatctgaggtcaggagttcgagactagcctggccaacatggtgaaaccccgtctctactaaaaatacaaaaaagccaggcgtggtggtgcaggcctgtagtcctagctactcgggaggttgaggcaggagaatcgcttgaacccaggaggtgaaggttgcagtaagccgaggtcatgccactgcactccagcttgggtgacagagcgagactccgtctcaaaaaaaaagaagatatacatgtggccaacaagcaagcagatgaatgaaaagctcaatatcactgagcattagaaaaatgcaaatcaaaaccacaatgagataccatcttaaccagtcagaatggctattattaaaaagtaaaaaaataacagatactggaaaggttgtagagaaaaggggacacctatacactgttggtgggagtgtgaattagtatcatagcttttgaggaaacatagatggagctggaggctattatccttaggaaactaacgcaggaacagaaaaccaaatactgcatgttctcacttgtaagtgggaggtgaatgatgggaactcatgaacacaagggaacaacagatactggggtctgcttgaggatggagggtgagaggagggaaagaaaaagaaaaaataactattgggtactaggcttaatacctgagtaatgaaataatctgtataacaaacccccatggcatgagtttacctatataacaaaccttcacatgtatccctgaacctaaaataaaagttaaaaaaatagggtttaaaatttaataaagaaattaaaatgctacattggaaaatacctatttcatacaaaacaaggcggtaaagaagggacagaaaatattttgtaaaatacgacatatggaaaactaatagcaaatggcagatattaattcaactgtattaataataatgtgaatgtgaatggagtaaataacctgataaaaagaaagaaattctcagactggataaaaaaactgaggtctaactgtatgctgtcaaaaagagatgtaccttcaattcaaagatacaaataggttaaaactaaaataacagagaaagatataccatgtaaactgcaaccatcggacagctggagtagctgttagtgttatcacacaaaatacgtattaaaacaaaaaaaaatgttgtcaggtgtgcttgttcatgtctgtaatcccagctacttggaaggctgaggcaggaggattgcttgaggccaggagttcaagaccggtctgagcaatatagtaagatcccatccctaaagaaagatagaaaattagctagacatggtgatgggtacctgtagtcccagctacttgtgaggctgatgtaggaggattgcttgggcccaggagtttgaggctgcagtgagctatgattgtaccactacactccatgcactctagcctgggtgacagagacctgtctcttaaaaaaaaaaaaaaaaagttactagagataaaaaataaatattttataatgataaaagggtcaattaatcaggaaaatataacaaacatattaaatatttatatacttaacaacaggtcccaaaaatacatgaagcaaaaattaacagaattgaagataaaatagacaattcaacaataatagttggagatttcaatactcattttcaataatggataaaatgattagaagatcaacaagaaaatagaggacttgaacaacacaataatttaaatagacctaacagatatttgcagaccactccacccaaccacagaagaatatacattcttctcaagtgtatgtggaacaatctccaggatagacccatatgctaggccataaaacaagtctcaacaaacttaaaagaatagaaatcatatgcagtaaatttgcagatcacaatataattaaattagaagtcaacaacagatggaaatttgggaaattcacaaatatgtgggaattaaacaatatactcctaaataaccagtgggtcaaagaataaatcactgaagaaataagaaaataagattaatgaaaatgaaaacacaacacatcaaaacttacagactgcaggaaaaatagtagtcacagggaaatttgaagctgtaaatgcctatattaaaaagaagaaaaaatgtaaaaccaatgacctaatctgccttaagaaactaggagattcagaaggaattttgcaatgtaaatgcaaaaccagtggaaggaaaccaataatatgataattactagagttgaaataaatgaaatagcagaaaaacagcatagaaaatcgatgagaccaaaagttggttgtctgaaaatatcaacaaaattgatcgtttgctagcactgccataacaaattaccacagacttggtggcttaaataacagaaatcaattttctcacatttctggagactgaaagtataagatcaaggtgtcagtaagtttggtttctcctgaggcctctctttttggattgcaggtggctcaccttttcaatatgttttcacctggtctttcctttctgcatgtgcatgtgtctagtgtctcaatatgtgtcgtaattttctgttcttataaagatacctttcaaattggagtagagcccactttaacagcctcattttaacgtaactatctctttaaaggatttatctccaaattcattcatgttctgagatactgttgagttagggcttcaacctacgaagtttggatggacagttcatcccataacaatcaacaaaatatattgacaaagagaagactcaaattacagatttcaagaattgaggagggaacatcacttcagaacttacagaaaaattaattaaaaagtataaaggagcactccaaacaactgtatgcaaacaaattagataacttagataaaatggatacattcctggaaaatgcaaattatgaaaactgctcaagaaataatagaaaacctgaacagacaagtatgaagattgaattagtagtttaaaaatcttcccataaagaaaagcccaggtccaaagagttttactaataaattctaccaaacattaaaagaagagttaataccaatacttcacaaactctcccagaaaatagaggaaataagcgtcaactcattctacaagaaaagaaaactatagaccagtattccttatgaaaatagatgcaaaaatctagaacaaaatacttgcaaactgaatctaacaatatgtaaaaataattatacgccatgaccaagtggaatttaccttaggaatgcaaggctgttttaacatgcaaaaaatcaatgaatgtaaacattgcattagtagaataaagtacaaaaacaacatgataaactgcatacatgcagaagaataatttgacacaatccatcaccttttcatgacaaaaaccctcaacaagttaggaatagaagggaatttccttaagctgataaagggcatatacaaaaaccttacaggtagcatcatacttaatagagaaagactgaattcttttgctttaagatgggaacaagacaaatatgtctacacttaccagttttattcaacattgcattacagattctatccaaggcaattagacaaaaaaagctaatttgtctttattcatagataatattatattttatacagtaaaacataatttttcatcatgtctgtaggatatgacatcaacataaaaaatcaattctatgtctttatagtaataatctgaaaatgaaattaagaaaacattttcattcacaatagcatcaaaaaatggaataattaagaatacatttgacaaaaaagtattttgtacactgaaaactataagacaccagtgaaagaaaagaaagacttaaataagtagaaagatatcccatgtttgtgaattagaagatataatattattaaaatggctgtacttcccagatggatctacaaattcaatacaatccctagaaaaatctcagatgactttttttttttttttgagatggagtcttgctctgtcacccaggctggagtgcagtggcgtgaccttggctcactgcaacctccacctcccgggttcaagcgattctcttgcctcagcctcccgagtagctgggactgcaggactgtgccaccacgcctggctaatttttgtatttttagtagagactgggtttcaccatgttggccaggctgatctcgatatcctgacctcaagtgatccacccaccttggcctcccaaagtgctgggattacaggcatgagccactgcacctggcctcagatgagatgacttttttgtttcagaaaattacaagctgattctaaaatacacagagaaatgcaagaaacccagagtagccaaaacagtctttaaaaagatcaaacttggaggacctacagtggccaatttcaaaatttatgacaaggccacaatagtcaagtcagtgtgctactggcttaaggaaagacatatagataatggcaatcagttgagatcccagaaataagcctttacatgtgtgatcaactgattttgggcaaacttgccaagaaaattcaaagggaaagaaatagttttttcaacaattggtgttcaggcggtagaatattcacatgcaaaataatgaatttgatctttgacttcacaccatacacaccaattaactcaaaagtgtaccatatacctaagtataagagcttaaactataaaactcttagaagaaaacataggagtaaatctctgtgatcttgagttacacaaagatttctaagatacaacaacaaaaccacaagtcataaaaacatgataagctggatgtaagctggacttaaaatttaaaaccttcacactttaaagataccatccagaaagtgaaataacacctcaaagactgagagactatacctataaatcatatatcatacaaagtctttagattcagaaaatataaagcctcttacaactcagtaataagacagattatacattaaaaagcaggataagaatttgaatagacatttatccaaagaatatatataaatggcaaataaacatgtgaacagatactcaacatcattagtcattaggaaaatgaaaatcaaaaccatgatgagattacatttctcatccactggaatggctatctattagacaaaaataagtgttgtcaaggatgtggcatatcagaacactctcatacattgctgatacgaatgcaaaatggtgtagttctttggaaaacagtttagcagtttctaaaaatgttaaacatagagctatcgtatgactcagaactttcactcataggtgtatacacaagataaatgaaaacatatgtctgcacaaaaagttgtacctgaatgttcatatcatagcatcatgactcacacaagccaaaaggcagaaacaccccaaacatcctcaacttctgagtggataaataatatgtggtataatcatacaatagaatattgttcggcagtgaaaagaaatgaagcagtattatatgctactatatgaatgaacctcaaaaacatgctcagtggaagaagacacataaggccacatattgtatgattccatttattgtatatgaaatgttcaaaaaagacaaatctttggaggcagaaagtgattagtggttgcttggggctgggtgttaggaatggggactgaatataaattgcacaaggtttctgtttaggataatggacatattctaaaattagattgtggtgatggttgcacagctctgtaaatgctaaaattcattatattttatgctttagatgggtgaattttatcatatgtaaattatatatttaagttgttaaagtgcagtggtttaagaagataaaaattttgataattttataaagaacatctccaccaaaacattataaaattccttcccagataaagtatagctcatgaatttctatttctatttcaggaccttgttccatttgtcagtttcccccatgtacctctcctgtaccctactaccatggacctatttctctggattctgtgttccaactttcccttgccttgagcctgttcacccttccagaactttctcattcagcattctggcttgtgcgttcacctctatcctaaagttcttttctcctgagtctcatttcattttttcaaaccactgcttctatttcattgatgaaaagtggcaaataatttatcctgggcttgtttatgtatttgacagatgtttactgagcacctactgtgaacttggccctgtgatgatacttgtcgtgtcttatgttgctggtttttatattcagggggcaataagtatgtttaatgtgccacatgaaagattctgtagagaaggaccgagtagctatatttcatggcaatttttgcccagtctgtagaagggtctctgtttcaaaatgacaagtgtgtaattgccttatctttgtccctgagttgtccatgtgtcttgcggtttaagctagtggagtgctggcaaaccagctctccagaaaaacagtaaataagtaaaacctaatttgtagcacttgtggtttctatagcggatatactcccaccatggccagtttcaagttgctaaaatgatattactgaatacttcactggaaagctagccagtgtgagccctccactaagaggcaattgcttagtcctaatccatacaagaatagctttcatgctgtttctaaaataccacccaacttggaaggaatgtgggaagaaaactaatgcttctggaatactaactgtgccaggcactgtgcctgttagatattcattcccataatcctgtgaggaagatagccttttcacaggacagcagatgaaggaatggagagttaaaatgatctgcctgaagtcacagtgcactgcagagctaggatttgaatcctggtcattttggtgccaaagcccatgctactttcattgcaccatgatacctcctgggacaaaactggtagtggagacagtgagataatgtacttttctggtggtagtgctgtggatattgtttgcttcctgagggtttggcacgtcacttgtagcccatttgacatactagaggatagtgggttaatctctttgtggcaggtaagagatcagtgaagactgatgcatggtatgtggagggagcctacaaaccttttgattgatttgagcctaaggaggggactgcattgattggctagtaattcttgactattctggggagtggcagagatgctggaacaacacataccttacaggctttaggtgagacctagaatgaccatttgagaggtcagtgctgtctatggagaaagtggtttctgaatcaagttccgaatataaatgattggagcgagcttttgaaaacaaatctatgacttatttttaccagaaagaaaagtctataagggcaggaatctttgcctgttttgtttattgttatattcccattgtctatagaacagtgcttgagactcaataaattaagtgttgaatgattggatagatgaataaatgggagaatgaattctttgcctccagttctgtagctccttcctaagcctggctactgcttaaaaccaagcatcatctcagagatccatgaggaaccaacactgaggcttctcacatttttctcagctaaggatctcattagcagttatgtaaagaaaaatgatgttacctggatggtaagatgtataacatttctttgggaagcgcttttcactatctttgggcagaatacctgtcaattgttgagtttttactaagtgccaggtacagagtacagagataagcgttatgtatgcattagcccattaaatccttatgaaattaataacgttatgaaatagacaattagccccatttggcctggagagcttaagtaggtttcccaaagctgcacagctagcttttcttgggagcatctcaaataccgaaagcaaaaggaaaaactttaggagttaggtatgacaaaattcataaacataaaacaatataacaatacgtatatgcccttttaaattttcaagtaatcacattaaaaaggtaaaaagaaacaagggagacaaatgttaataacatattttagttaactactcaatatatctaaaatattaacatttcaacatggaatcagtataaaagttactaatgagatattttgtgttcttttttaatattaagtctttgaaatctggtgtgatattaaacttgacaagtgtgtgtcaatttacaccagtcacatttaagtgctcattagtcacacgtggctagtggatggctactgtactggacagctcagtgctaggccttgctcccaggtatactgaaatgtattagaaacctttctgtgaagtgatgaggaaaggcacataaactgcagtgagcccaataacaatttgttttgcagaaagctgttctttaaattattacccatataggttacaaattatgagattaaaacccgatgtaacattaacagtccttcaagctccttcagagtctcctccactggatttgggagagtaactctcttaaagcaggacatcattttgattctgcaaatattctccaaggcaaggaggttacatatctctgcagagtgtctgtgaactgaggcctgaagcaatttaaggtagggacttcagggtcatcaaagaagaagcacatgccactcaagtcctttacgtaatctagaggaaagaccaacaaagaactagctaatagtctgggaattatttctcgtttccctgttctctgcccttcttcaccatgcagtctattctcccaagacactccatctctcagaggttcccaatctctctctatagtctaggggatgtataactatataagtgagggtatgtgaccctatgtgagattaggtgtgtgctgtcatgggtcagctatgtaaagtatggagagtgagttggcagccccaaaagcatagctatgaataatcaagtaaaaagattctccccatttcatgtcctctcagaagaaggagacataaattaatggggcctgtaggcactgagctgacctgacaatttccatcacagagtttccctgtagttgcaggggctgtctggcataaatgaggattccaacctggaatttgatttttctcctttagagcacaatatttgaaatccatttactcacataaagggcttttaaagttgtcttaggctttaggtagacttccttgattagagacttagaaatatgtttcaaagagggtccttgtagaaggtaagtttctttttttaaccttttagggtggaaaggaaaagagagatggtagagtagtatttttcatgaagaacccctcagcccttaagctgtatcaggcataccctcagtctgactgtaatggcaatctgactaatggaattaatcatctgaaaagtaaggcaggtggccatctcaaattgtgttgtctgctttccccagagatatgtgactctaagctagtgtatcaaaaaagaagaaaataggcacattccttaagattaagatgtgggtgaaacttaacctgtcttctctgtcagaataggaagtgcttatggaccaaatttgccagaggacttagtcttctgttgaagaaccatgtgcagtcaggaatgactaaacctggctttaaagctggagggagatcaggacagggaatccctataatattgggcacaaaaagcatggactaaaatgttttttctctgtgtttagtcaagatttggtgaacacctgatcagaaaatcctgtattgtattatcagatgcagatatggtacagaggaaaggggaaagtaactttcatttacagaaatgtgccaggcacgttacatattcttagggccatcctgtaggtcaagatagcatcttacccactttatagatgaggggactaaaactcacagaacttatgtgacttacatagctagctcgggagtggggttcaaacttggaaatgtcttactccaaagtgtattcttcccactgccctatactactgtcttagatcttactgtttagctagaaacacatgacttgtactctcaagtaacaaagaaataactgtattaattataattaaacactgctaatatgaagtcaggacagaatgtattttgcatgatcaggaacagttctaaggtcagagcagatcttgtatttccctgatggtgttggtcagtgtcatgatggatagtaagaaatgtagacaaggagctgtcaacaacacagccccatgttgcaaaataccattattatagaaaccttccccacaaaggacgaaatatctgacagtgagccccagatcttcctgacgtacagaatgtcattagctccttagctaatatttttttgccctagtgatagagaaacaccattttgacaaggctatgtctgagttctactggtaggtgaagaaatactagttctctgttgttcccccaggagctatagctgaggattcaatgccttgatagttctggaagataaagcttccattgttttgttgttttattgtcacatcaccctaggagcaataatttcacagttgaccaaagtggtagtatcacatgggttcatctacattgtggactctctttggcatagactccatgagttcgattagagtggtaggattctatcattgtttcatagctcttgacaaaactaactgtcctaacaaaaaagaataaagataggtgtaagttaatactgcttttaaaaatgcattttctatatgtatgtctttatgaaaccttgagttaaagatggtgaaggcaagccttgtaatttcatcccatttttactgagcaagacaaactcctattgttgaatatggagtgacatattaagtgatacgttaatgttttgtcaaatcttaatggccagcatcttctagtggcccattttaggacaaccttaatcaagctatggttagagaacttttattaaatgcccagcactgtactactttctagcatttcccactctgatcgtttgcttgaggatgatgaaggatgataaatattataaataagattgcttcccatataggtcttaaaatcagctgaggtcaatgcagatctactgctagaaatgatttggaattttggctgcttcaggagaagcatagcagcagaaacaggagatcattgaacattttaagaaggaggctacccgcaaattcagaagttcatccctttaggaagggtctgtcataatagtaggaagggaccaggcacagtggctcacgcctgtaatcccagcactttgggaggccgaggcgagtggatcacctgaggtcaggagttcgagagcagcccggccaacatggtgaaaccccatctctactaaaaatacaaaaattagccaggtgtggtggcagtcgcctgtaatcccagctactcgggggaggctgaggcatgagaatcacttgaacccaggcggcgaaggttgcagtgagctgagattgcgccacagcactccagcctgggcaacagagtgagactccgtatcaaaaaaataataggagtaaggattcctgactgaagccctttggacacttcctgctggaaacgcatgggcctttagtaactgatgttggccaggtgagctggcacatatggcattcttttgtggtctcaggatttcatggtaagaagatctgggcatagcttatagcaaagacctctatatcaatcattccattcctagaagtgccacctggaagaggccaagataatgagatgtctgtcctcttgtgttggtggctatggtcaagttgaggtcctcaagaagcttccctgttgtccaattccagttcactgtggctttggtaaccctcaagagagagatagtagatggaggtcttctaaaaaccagatttctagtggcaagcgcacagcccagtctgcggtcatcagtggaagccagttcagggtatcagcagttggtaagcttgctgaacatgccattttagagagaatctctccatagcaagaatatgaagaaattgattcaccactttctcatacatcttatgccctagccaacccatacctgacaaactatctttcttaaatatcccaagatcttccctacctctttttctttgcacatgttgtaccctttgctagaatgtacccttcctctttctacatggtgaactctcatctattttttaaggtctagctcaaatgatatattctctgtataacctttccttcattccatccctactacttctgtggttctacagcctgttgtatagatctctatcctcccattgctctatacagggagtaaattatctatgaagatatctctctactactaaactgtgacccttttaaaggtggtaattgtttctaacttctctctgttatctccattagtcagaacaaagcccggcatataataagatgaaccagggaaatgctgatgagtgagtgactgacttatttattctgatatggctagggttagattctttagattccatcatcattaggctttatttggtatcatattttataagtgtgtatttcagtggcctcttctctttttatttgtattgttttttgacacaggatctcactgtggcacccacgctgaagtgcaatggtgtgatcacggctcactgcagcctccatctcctgggctcaagcaatcctcccacctcagcctccccagtagttgggactacaggtgtgcaccaccatactcagctatttttttggattttttgtagaggtggggtttcaccatgttgcccgggctggtcttgaactgcagagctcaagcaatccaccagccttggcctcccaaagtgctgggattacaggtgtgagccactgggcccagcatctttaatgaaatggctaaactttttgactatgtttatttgtttctttgaataaaaggtacatttgtagtctttaattggtccaatatacagattccagtggaacagcaatggctccctcttgtgaggcagtctcagaatttctcctataatttctttggagatgtgtggataaggtcctcttaggagagttaattctaatggtctgaatactttggctcctaagtatgggggaccaactagttctttcttggaaagttttaagaacatcacttgacaagagtaaagaagccatcccgggagtcttaatcagcacaaaatctgaacttcctggagttggaagggttcctggaggtcatctttacaactgaatctcacacagcaactcatgtcagttttgagttgctctctctctcttagagttttatgttttttagtagattattccttttaagaaactaaaatctccctccagctgatctaggtcctagcctttggaaccacacaaaacagtatgtaccttcttgataactaattgccctttaggtagttaaaagacaatgttaggtttctcatgatattttctacattcagtttttccaacatgtatgaacacctccctagtgccaggcatcctggtctaatcttctccaagtctctcaactgttccccatatgtcagttttccaatcctctgaaccacttcttgtagatcatttccaccttgtcactggctctgaagtttataatttttacatgttatctttgttaaatgttttccattgttccagccagcctcgatctttcaggatactatcatatatgggacctactctatcctaggagagtctcctctttcagttcatcagtataagcttccagttttgacactttagaataaagcagtacttttcaggcaacagcatggaatagttgaactagatggcaccagatctgcgttcaattcatttaacctctttgaggctaaaatggtgctaataatccttcctttatagggtaatacccatgattcatgagatactgtctgtaaagcattaagcactgtatctgagcacttagtgggtacaccacagaaattaatgttccccccttctcctcctgccagtcttgccctgcccaccactgccctctactgaggagagtcagtaactgctttaaacttgaattctttcttgtttgagccaagtagccctattccatttaatctctttgtagccttttaatgaatgacaaacctgcatgagatgcagcacaaactggaagatggcatactggcctcaattttgtaagatagcccttgtaaaaatattgcagtaagcatcttcgccaatttctgacacagcataactgagttagagttctacattccatggatagctatttgtcagaacttttttttaatattacaagattccaaggtgctaaacacagatgcttggaatgtaatccagcatttgtggttcgctgtcatgtaaacagtcaaagtcacagcctgattctgaattcattcatgggttttctggatatttcccatgctctttttgaagaggggcatttatgtgaattagcacttttaattcgtctgacagagtgatataggcttgtataaaagcaataaaaatacagggtcccaggtggcatttattgccacacagatgaaaagccatatagttggaattctcctcttatgagaggcttttgggatgtggagggaaatccctaagcttagcaatctgacattatagtacagtggatagagggtaacctaagtgtcagatctgagtttcagtttctcctgtgctagtcactatgaatatgatctgggacaagtcctttcacctccttttacctcagctttcccttgtgtacaatgggaaaaaattgtaccaactttgtggattggttgtattataaatgagattaacaattctataccacctagcccagtgcttgatatatggtaggcaagcaataaatcattgctcttaggatcagttctagttgataacagctaagcctgctggagttgccatatcattttcctcttgaagagtgaaagaagtaatagcatgtgtatagtttggggattcaattcctgggtctctgtagaaactggaccaccctgagtccctcagactgtgctgggagtttataatcattcatgtgaaggacaatgggaaaacattgggttgcttaatagcccttgctggtacctaagcaaagacagtgagaagaaccctggtgacttctcaacccttctccactgtaagggaagaatcctaaggcttttcttacactgtagcctataactccttaaatgcaaggacttgaatttaccaactcaaacaggagtgaaatgctgttgccttttttggaggtctggaaacatatacttgggaatctggtgagctggttactaaaactccctttgcagagatggcggtggctggattctttgttttctcttgagtaattttgacctagaggcaaaaagaaaatctctaaaaatgttctgctcataagaaaagagcaattgggctgagggtggtcccctggtaaaagagaaacttcaccaccaatcagctttgtaaattaaaaacaggtgcaaaaactaatctatagtgacagaagctaattaatggttaccagagggagggggacagagaaaactgggtggcaatacaaagggcacaagaaatcttttgggattaatgggtaagttcaccatcttgattatagtaatagaaggtacatatgtcaaagataatcaaattgtatactttaaatatgtgcagtttaatgtatatcaactatacattaataaatctgttaattcaaacaaatccagtgtatataacacctagtacatagtaggtgtgtgctaaacatgtgttgaattaacaattgtgacagaccaacttctagtgtgaagagctcaacaaaccctctcaccagtaaaacaaccattaaaatggtagaagatgatgtaaaacaaccattcaaagtatctggaaactggctcaaggtcatgcaacaaattgagaatcacttatttaagaaaaatctatggaaccttggtaagaacaattggcatttgagcaaggaactgcttccattcctcctcccaactttatgttgcagaagatttattccaggtgagtacaaccgagaaaacagggggtctctttcttaccagctgttgattatagagctatagtttcattccagaatgatcaggctgctagtgactctcattcttccatctccagttctctgttgtacaagatttattcttggccacaaaaaacaagaagattgggggttcccattccgtgctcagttcccactcttaagatgaaggcactaccctagacagttgcagcaaactgtgaatggcagttggagaagaccagggctcctatttccccactcccaagtcgagggcccagttttttttttgtttttttgtttttgtcagacaaggacttcagggggctcatagagcagagatgtcactgtagaagaagcaggctgccatatcattctctcctcatccagctccaaatagtaacatagcctatggggactgactgactttagaacagagcatgaaggaattcatgcctaaagttattgttgaaaacagcagagattatagtagtgaatattagagaattacatattagtagcagctagaagaaaaaagaccagccagacatttcagagagagacctgtggaaagagtttaaaaatgccctgctaagatcacatttgtctattggtctggaaggctgtacacacacactaggctaaacctgtgtgggagctaccagagatatgatatttatgagctgctaaaccctatttgaatgcaggataaaattaaagacttcctgaagtatgaaagcattccccaatccatacaaagatacattggcaaaagatagaagctttactggatctaggaacttaagaaaaacctgtgaccttttgatataagatgactcctagaaagccagacttaaaagtaaaacaagaagagaaatgaacatgacatcagagactgtacactacagatgaaatagacttcagagagaattagtccaggcaagacactgaagagaaatagagaaaaagcagaaacaaaaacaaagcccaggttatgggggtgggataggtaaacagaattcagagttactacaatacattatttaaaatgtcaaattttcaacaaaaattatgagcattgccaaaaaataagttaagtgtgaccatggacaggaaataggcaatataaatcacctttgagggagctcagatgttgtacgtgacagacaaggactttaaagcagctattataaatatatccaaaaaactaaagaaaactgtgttttatgaactaaaggaaagtgtgatgataacaactcatcaaataaagaatatcaatgaagtgatagaacttattttttaaaaagaaccacatgcaaattctggacttgaaaataaaataagcaaaacaaaaattcttaaggccaacaatattttatatcatggcagaagaggcagaagagagattactgaagcagaagacagattaatagagaaagaaaaacagaaggaagaaaaatgaacagagcttcatatatgtgtgggaaacaaacatatcaacatatatgtaatgagagtaccagaaggggagaagagaaaaaggcagaaatgtagtcacagaaattatggcttaaaatccccaaatatgatgaaagacattaatctaaacatcaaagaagatcagtgagctccaagtaagataaactcaaacagatccatacctagacatatcatagtcaaaatgctgaaattcaaagccaaagggaaaatcctgaaagcagccagaggaaaatgacttatcacatacaaaggaatcacagtaatttcaacagctgacttctcatcagaaaaagtgggtaacaggagacaaggggaggacatactcgaagtcgtaaagaaaaaaaatcaaccaatatgtctgtatctggaaaaactaatcgtcaaaaatgtaggcgaaataaagatgtttccagataaacaaagattaggagaatgtgttgctagcacctgccttatgagaaaaacggaaagaaatatttcaggcagtctgggggcagtaactcgtgcctgtaatcccagcactttgggaggccaaggcaagaagatcgcttgagcccaggagttccagaccagcctgggcaacatagtgggccccatctctacaaaaaattttaaaattagcggggtgtagtggcacgtgcctatagtctgagctactcaggaagctgaggtggggtgtgggggtcgcttgagcccgggttaaggctgcagtgagccatgatcacaccactgcactctagcctgggtgatagagtgaggccctgtctcaaaaacataaataaataaaaagaaatccttcaagctgaaagaaagtgacaacagacaataatttgaatccataaagagccctggtaaaggtaattgtgtagtgattaagacagtgtaattacatattccttctccctcttctcttagttgatttgaaaaacaaaaccatactgaagcagcagtgaacacaactagtgcccagaacttggattctaataccatttttcaatgaaaggaaccagggatccttgaaaaaatggctggttctaggactggatcaggaactacatgagtctggagaatctcgtagtgccaggaagtaaggaagtactaaagtgcacacacacacacacacacacacacacactactgaatgggttatgtcaaaaggacactggagtcaattgaaagaggtcccaatggccaaagctggaacaacttgagaaaaaaagtaaatcaataaagtactaatagattataatccaagatatttattttatgtccatgagtccatatgggttaaataaataaatggggagaaccatacaaacattttatgcagaagaattccaaatgatttatgttactactctgtcctcaaggacatagagcataacttctcactgtttaagtggggcctgtgcatagtgacttccttgaaagaatacagtatggaaaggaaaaaattgtaatttaagtgaagaaagctggcaaacactaccttagccagaaaaccaaggttaacatcaatgagataagtcatgttggtagtgtgttccttgatatgctgtgatgaaaatggtatttcacttctgtgattgcccccccccccgaaaaattcataaccccactccaattatgaagaaaccagcagagaaatactaatcgaggattattctacaaaatacctgaccagtactactggaaactgacatggtcatcaaaaacaaggaaagtcaaaaactgtcactgcaaagaagagcctaaagagatatgccaactaaatgtaatgtcatatgctggttgggatcctggaaccaaagaaaaagaacatgaggaaaaaactaaggaaaattgaatgaagtatggagtttggttaatgatataagtgtatcggtattagttaattattacaaatgtaccatactaatataagttgttaataacatatagggcattgtgtgtgaggtggatggtaaatctctatagtatcttagaaatttgtcttaaatctaaaactatttgaaaatataagcatatatttaaaaagcaacagcataaaacagtataatattgacaataatagcacaaagcaggggggaagtgaaaggaggtataatagagtaaggaaatgaaaccagagagtaatttcatacacaaaaagaatattagaagtggcaaataagattgtttataattacatacatttttcttaaaaattataatatgtatttttctcccatcttttagctttttctaaagacactagattagaaagcaaccattataaaactatattagcatataaaatatgtttataacatataaataggattgaaagtttggtttaacacttaaaaattaataaatgtaacacattaatggaataaaaggcaaaaacatgatcatttcactagatgaagtaatataaaaaacctgggaaacactcaggtaacaacctacaacaaattagggagataagaaaatttctttgacgtgataaagagcatctattaaaatcccacagctagcatcctaccaaaaatgttatacaaatgaccaaaagcacatgaaaaggtgctcaatatcattagtcattagggaaatgcaagtcgaaaccacagtgagatactatttcacactctaagaatgcccttaatttttatttatttttaaattaatatttttaatgacaaatcataattgtatacacttatgggatataatgtgatgttttcatatatgtggaatgattaaataaaacaaattaacatatatatcacctcatttacctattatttttatcatgagatatttgaaatttactcttagttattttgaaatatataatatgattattgactctagtcaccctgctgtgcatagctctcaaaacttacttctatcttaaactttgtattatttgttggacaacaccccattgcccctttccccgctcttcccttccccttctcagcctctagtaaccaccattctactctctatttctatgaattcaagtttttagattccacatataagtgagagccggtattataaagtgattataatcaaaacagcatggtactggcataaaaacagacacatggaccaactgtagggacataaagcccagaaatacacccatacatttacaatcaattgattttcaacaaaggcatcaaggacatacaatgaagaaaggacagtttcttcaataaatgatgttgggaaaactggttgtccacatacagaagaatgaaattggatacttatgtcccaccatctacagaaatcaactcaaaatagattaaagacttaaatataagacctgaaaccataaaatatagggggaaagctgtacaacactggtctgggtaacacttttttggatatgaccccaaaagagcagacaatagaagtaaaaagtgtatttaattttgtatatttgcatgttttcaaatggctttgttattttctcatttaatttcattgttgatatcacacatttctataatttcaattgttttacattttttgagactattttataccctaacatatggcctatcttagtgatgttccatgtgtgctttggaggaatgtattctacagttctaggctaaggtgctctatacatgtctgtcaggtctgattggtataagtcaagactgttgttcaagtaacctacatctttgttagttttctgcctggttattctgtcttttattgaaagtggagcattagagtcccctgctatcattgttgagttgcctatacttccttttaattttgtcagtttttgcttcatatcttttgtggctttttgtttggatgttcatgtaattgttttatcttcccaattgattgacccttttatcattataaaatatgcttatttatctctcataacagtttttttaaattatactttaagttctagggtacatgtgcacaacgtgcaggtttgttacatatgtacacatgtgccatgttggtgtgctgcacccattaactcatttagcattaggtatatctcctaatgctatccctcccctctcccccgaccccacaacagtccccagtgtgtgatgttccccttcctgtgtccatgtgttctcattgttcaattcccacctatgagtgagaacatgcggtgtttggttttttgtccttgcgatagtttgctgagaatgaaggtttccagcttcatccatgtccctacaaaggacatgaactcatcattttttatggctgcatagtattccatggtgtatatgtgccacattttcttaatccagtctatcattgttggacatttggcttggttccaagtctttgctattgtgaatagtgctgcaataaacatacatgtgcatgtgtctttatagcagcatgatttctaatcctttgggtatatacccagtaatgggatggctgggtcaaatggtatttctagttctagatccctgaggaatcgccacactgacttccacaatggttgaacgagtttccagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatgttttcatgtgttttttggctgcataaatgtcttcttttcagaaatgtctgttcatatccttcacccactttttgatggggttgtttgcttttttcttgtaaatttgtttgagttcattgtagattctggatattagccctttgtcagatgagtagattgcaaaaattttctcccattctgtaggctgcctgttcactctgatggtagtttcttttgctgtgcagaagctctttagtttaattagatcccatttgtcaattttagcttttgttgccattgcttttggtgttttagacatggagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcatttccccatttcttgtttttgtcagctttgtcaaagatcagatagttgtagatgtgtggtattatttctgagggctctgttctgttccattggtctatatctctgttttggtagcagtaccacgctgttttggttactgtagccttgcagtatggtttgaagtcaggtagcgtgatgcctccagctttgttcttttggcttaggattgacttggcaatgtgggctcttttttggttccatatgaactttaaagtagtttttttccaattctgtgaaaaaagtcaatggtagcttgatggggatggcattgaatctataaattaccttgggcagtacggccattttcacgatattgattcttcctatccatgagcatggaatgttcttccatttgtttgtgtcctcttttatttcattgagcagtggtttgtagttctccttgaagaggtccttcacatcccttgtgagttggattcctaggtattttattctctttgaagcaattgtgaatgggagttcactcatgatttggctctctgtttgtctgttattgttgtataagaatgcttgtgatttttgcacattgattttgtatcctgagactttgctgaagttgcttatcagtttaaggagatttggggctgagacgatggggttttctaaatatagaatcatgtcatctgtaaacaaggacaatttgacttcctgttttcctaattgaataccctttatttctttctcctgcgtgattgcccgggccagaacttccaacactatgttgaataggagtgatgagagagggcatccctgtcttgtgccagttttcaaagggaatgcttctagtttttgcccattcagtatgatattggctgtgggtttgtcataaatagctcttattattttgagatacgtcccatcaatatttaatttattgagaatttttagcatgaagggctgttgaattttgtcaaaggccttttctgcatctattaagataatcatgtggtttttgtctttggttctgtttatatgctggattacgtttattgatttgtgtatactgaaccagccttgcatcccagggatgatgcccacttgatcatggtggataagctttttgatgtgctgctggattcggtttgccagtattttattgaggatttttgcattgatgttcatcagggatattggtctaaaattctctttttttgttgtgtttcagtaaggctttggtatcaggacgatcctggcctcataaaatgagttagggaggattccctctttttctattgattggaatagtttcagaaggaatggtaccagctcctccttgtacctctggtagaattcggctgtgaatccgtctggtcctggactttttttggttggtaagctattaattattgcctcaatttcagagcctgttattggtctattcagggattcaacttcttcctggtttagtcttgggagggtgtactctcataacagtttttgtcataaagtccattttgtctaatattagtatagccacttcaactctcttatggttactctgcgtggtacatctttctccattttttaaacttccaatctgtttgtatttaaatatataaatatgtgtcttgtagatagcatgcagttatatcttgttttcttatccaatctgacagtctatgccttttgactgggttatttaatccacttaaatttaatgtcattgatttggtggaatttattttgttggtttttttctgtatgtgtcatgactactttgttcctttgtacctcctttactatccccttttgtatttaatgaatattttctagtgtaccgttttaatttttcaatgattttcaactattttcaagttattctcattgtggttgttttggcacttatgatatacatcataagttatcagaatatacttcatatttatagtaagttaattcttataatatattttacatttacttttatatagttccattcatttccctgttgtctattattttatacgtattatgtttacatatggtgcaaacacaacaaaatattcttttgaaaatccaagatgcaactttagtacatatttcattctacagaatacttatacacttaatcattttccaaagtacattttgcaagacatactggtcttcaccagtaactactgttacttcctctttttaaaacagatttattgcttttatactgttggcgggaatgtaaactaattcaaccattgtggaagacagtgtggcaattcctcaaagacctaaaagcagaagtaccatttgacccagcaatcccactactgggtatatacccaaaggaatgtaaatcattctactatagagacatgcaaatgaatgtttattgcagcactattcataatagcgaagacatagaatcaacctaaatgcccatcagcgatagactggataaagaaaatgtggtaggaatactgtgcagccataaaaagaaatgatatcatgtcctttgcagggacatggatggagctgaaagccattatcctcagcaaactaatgcaggaacagaaatccaaacactgcatgttttcacttataagtgggagctgaacaatgagaacacatggacacagggaggagaacaacacatattggggcttgttggggggtatgctggggagatggagagcgttaggaaaaacagctaatgcacgctgggcttaatacctaggtgatgggttgataggtgcagcaaaccaccatggcacacgtttacctatgtaagaaacctgcatatcctgcacatgaaccccagaacttaaaataaaaataaaaattagactgctttccacagtggctggattattttacattcctagcacctagcatgtatgaagatatggagaaataaaaaccctgtgtgtgagggtttttatttatccatatcttcactaatgcttgttgttacctgattctttgattctagccatgaagtggtatctcattgtggttttgataagcattttcccccgatggctaattatgtcaaccatcttttctctcttccttttttttttttttgaaacagtctcgttctgtcacccaggctggagtgcagtggcgcggtctcggctcactgcaccctccatctcctgggttcaagctattctcctgcctcagcctcccaagtatccgggactgtaggcgcacaccaccacgcccagctaatttttgtattttttagtggagacagggtttcactatattggccaggctggtctcaaactcctgacctcgtgatccgcccacctcagcctcccaaagtgttgggattacaggcgtgagccactgcgcccagccacgttaatcatcttttcatgtgtttgttggccatttatatatattgtttggataaatgtctactcatatcctttgtctgtttttttttcattgacttgtttttctctttatcattgagttctaattttctttacatatccagatactatcccttatcagatatatggttttaaaataaattctcctgttctgtgggttgccttttcactttatagtgtcttttgaagctcaaaacttttacattttatgcagtccaattgatctattttttcttttgctactcatgcttttggtatcatacctaagaatcctgtaccaaatcaaaagtcattaaggtttacctgctttttcttctagtagttttattgttcacatttaagtctttgataattttgagtgaatttttgtatacagtgtgacatagggatccagtttaagtctttttgcatatgggtatcctattgtccctgcaacatttgtttaaaagatgattcattttctattgaattgtcttggcacccttgtcaaacatcagttaaacataggtttatcggtctatttctgaactctcaatgccattccattgctctgtgtgtctatccttgtgccattacaagactgtcttgctttctgttgtttttaaataagttttaaattgggaagtgtactagtctgttctcagctgctaataaaaacatactcgagactgggtaacttataaaggaaggaggtttaattgactcagtttcacatagctggggaggcctcacaatcatggcagaagatgaaggaagagcaaagggactccttacctggcggcgggggtgggcaagagagaatgagagccaagcaaaacaggaaacctcctataaaaccattagatttcatgagacttattcactaccacgagaacagtatgggggaaactgcccccatgattcagttatctcccatggggtccctcccacaacacatgggaattatgggagctacaattcaagatgagactggggccgggcacagcagctcatgcctgtaatcccagcactttgggaggctgaggcaggcagatcacttgaggtcaggagttccagaccagcctggccaatatggtgaaaccccgtttgtactaaaaattacaaaaattagccaggcgtggtggtgggtacctgtagtcccagctactcgggaggctgaggcaagagaatcacttgaacccaggaggcagaggttgcagtgagccgagattgcaccactgcactccagcctgggtgacagagcaagactccatctcaaaataaataaataagaaaaaagaaaaagaaagatgagactgggtggggacacagccaaaccatatcaagaagtgtgagccctcgtactttattcttctttttctggattgttttcagtattctgggtcccttgtaattctgggtcccatatgaatttttgaatcagcttgtcaatttgtacaaacaagtcagctgagattctagtaggaattgcttcaaatgtatagctcagtttgggaagtactgccatcttaaaaatgttaggtctttgaatttatgaatgtagtgtagtttttcatttatttagacctttaatttctttcaacaatatttagtagttttcagagtgtaagttttgtacttcgtttttaaaaatttattccaaagtatgttattctttttatggtattggaaatagaattgttatgctcaatgtcattttcagattgtttattgcaagcagataaaaatacaactcatttcagtatattgatcttataccttgcaaactttttgaccttatttattattttagtagatttttagtggattccttaggattttctatatataagatcatgccattcttgaaaagagaaagttttatttcttcctttccaatttggatgtcttaaatttccttttcttggctaatttctctggctagaatatctagtacaatgttgagtggatttgacgaaagtggacattcttatcatttttctaatcttaaaaggaaagcttgtagtctttcattatatgtatcatagccagttttgtgtgagtataacagaatagcagagactagctaatttataataaacagaaatttattggctcacagtttttgaggctgggaagttcaagattgaggggcagcatctggtgagggctttcttgctgtatcattccatggtggaagggcaaagagagggcatgcatgagagacagcaagagttggatgaactcatttttttataaggaactcaatctagtgataacagcattaatttattcataagggcaatgccctcatgacctaatcacttccttttaggccccacatctgaacaccttgcattgggattaagtttccaaaatgtaatgctctgggggtacacatttaaatgatggcagtgtggatttgtcatagaagcccttatcaaattgaggaagttctcttctattccatgttattcagggttttatcatgaagaagtattggattttgtcaaatgctctttctgtgttgattaaggtggtcattgattgtttggtttttattctattgatatgatgtattacattaattgattttcagatgttcagccaactctgcatctctcagataaataccacttgccatgttttataattctttgtatatgttgctacattcagtttgctagaattttcttgaaggtttttgcatccatataaataagacattgttgtataggtttcttgtgatatctttgtctagctttggagtcagggtaatattggcctcatgaaatgatttggaaagtatttcttcctcatctgctttttctcttgaagagttttttaagaatttatattaattcctctttgaatgtttagtagaattcagcagtgaagatatctgggcctaggcttatctttgtggatagtctttttattacttattcagtctcttcacttgttaaggttatctgttacttcttgggtctgtgttggtagtttctgtcttcctagaaatttgtccatttcatctaagttatctaatctgttggcatataattgtccttagtattcctttataagctttttagttctgtaaagtcagtagtaattctcccttcaatttttgattctagtaattgagtcttgctttttttctggtcaaactagccaaagagttgtcagttttctgatcttttcaaagaactaccttttggttttattgattttttctattgtttttccattctctgttttattaatttctgttctgatttttattatttccttccttctacttgatttgagtttagtgtactcttgttttctggtaccaactctggatactagcccttcccttctggagcttgttattgttatttgcttatctgtttagtaattggctggattattttagtgaagtttacccctccagcacacacgcagtcttaaatctttgatgttgcccctcatttaggcacaactttgggtgtgcccacaatcaccctggaatgactgtggtggtactggcagggctgttatcctctttccttggccacacccagctgttaagttctaccaattgaaggccaattattctgttgtttacaacaactccctaggacaagaattcttctacaaatttatctaatctgagtgtggctcttttcaggaaatagtttctgaggtcagtgtttgatacttttttcggaccacaggaaggctcctaccagctgtcttattctccaattctctcctgcaaactagccagcctatagtcttggctgtatcttcattagattcatgagtctactcccaattttctttatcataacctccaattttttttagagtgtttttaggtttacacttatccatgctctcttgcaaatgaagtcagcctctctgaaaagagattagtagctatccatttttataggctgcttctccccttaggtaaaatctctgggctctggtagggacaatggcaattgtaggagctgacttgactttgtgcatgactttcacaactgtaggagctgagtgctaggtggagaggtgtcactagcctgaggtcctcttggtttgccttttctggtgtggaactacaatctcagaactgagagaagggctattggagctctggtgttcataacacaccatgaccatggtagatcctctcttccatgagtggggattggatggaagacaggatccccatctcttgacctcagtcacctggaacttattctcagccacagacagcttagggacaaatgagaaatgctgaagtcctgttcccttcagaagaaagcctgctggctgggagctgaggggagaaggagttctgtgttcttagctgcagcagtgtggagtggagtccccagatcactaggctgggtggaagaaggagagagggaaagaggggatagagggggcagtttttgttcagataccacagacttgcttttttttttttaaaccaaatttctatggattttcttcaataaatatttcttcattttctgttttgcccttaggaccatttccagaggctttaaatggttcacctgttttaatgcgacagagtcaacagagcacctcatattgtaatgccagaactcaatctcccaataatatattttataattatcattttatataaccttatatcttttaaagaagagaggaaaagagaacataaatatctttatggcttttaaaaaataaccttctcatttaccattttttattctcaccatttctttctgtgtacttgagttaccattgggtatcgttttcttactccaatacagcttcattctgacgcccctcctatgtggtgttattgtcatatgtattaaatttctatatgttataggcccaacaataaattttgtagttaatgttattttttttttttttctttttctgagacggagtcttgctttatcacccaggctggagtgcagtggtgcgatctcggctcactgcaacctctgcctcctgggttcaagcaattctcctgcctcagcctccagagtggctgggactacaggtgtgcaccaccaagcctggctaatttttgtatttttgtagagatggagttttgccatgttggccaggctgttcttgaactcctgacctcaggtgatctgcccaccttggcctcccaaaatgctgggattacaggcttgagccactgtgccaggcctgtagttaatgttctgtgcaattgctttttatttttttatttgatttattttattattatttttttgagatggagttttgctcttgttgcccaggctggagtgtaatggggcgatctcagctcactgcaacttccacctcctgggttcaagcaattctcctgcctcagcctcccgagtagctgggattacaggcatgtgacatcactcccggctaactttgtatttttagtagagatggggtttctccatgttggtcatgctggtctcgaactcccaacctcaggtgatccgcccgcctcggcctcccaaagtgctgagattataggtgtgaaccactgcacccagcctgcaattgctttttaaatcagttaagagataaaaggtaaagaaatatattccttgtcactacctacacaattaacctttaacacaatgctttgtttttcatgaaaattcaaattactctctggtgtcactttgatttagcctgaagaatttcctttagattttcttgtaagtcaggtctattagcaatgaattctttcaggtttttattatatgggaacatcattattttgccttcatttttgaaagatagttactgagtatatgatacttggttgatgtatttttttttcattcagcactttaaatttgttatcccactaattttgttctccatatttttctattgagaagttcactgttagtcttattggggtttcctttagatatgattagtagtgttttgcttgatgctctcaagattttttctttatctttagttttaatattttaaatatgatgcatctgggtgtggatcattgagtttcttctactggagtttgttgaaccttttggatttgtaagttagccttgtccatcaaatatgagaaggttattgtcattatttttctaatttttctgagtctctttatttcctctccttatggtacttgtaatatatgtatgtttgtgtgcttaatggtgtaccatatttctctgacgctctgtttctctttatttttttctgttcattttgtataatctctattcatctgtattcaagtttattgattctttcttctgccaacttaaatctctagtgaatatttcatttggattattctattttcaactccagaatgctatcttgtttataatttctgtctctttttctattctctatttgatgaatttttatcatacttttctttcattcttcaagcatgctttctttcagttgtttaaacatatttataatagctgctttatagtcttgggtaagtccaacatttggactctgtcaaaagcagtttcttttgcctgcttttcttcctatgtatgggctgtgctttcctctttgtttcatatattgtaatttcttttgaaaactggacatttaaaataatatgtgatctcttttccacatcaatgatatgtgtagcagctttaagtaatgaccatctcccacccccacccccaatttttgggacttgctgttatttgtttggttgtctgtttattttttgacttgatagtctatttccagtagtgtatgcagcctctaatatccattccccaattttttttctttgttcttattttttatcctgtcttcttaggggtcacccttgggtgcacatgaaccatttaatcaccaaaggttatgattactccccttagtcagttagactctttacttttgcatgtatttgtagctttgagtttgttttcacagttgagggtgtttatgatttttttttacatttagccagatgttctctctctggtcttttctatgagggtgcagccttgggcatgcacacaatgtaccagaccactagggattagttttactttgtttttagacctgaattcctagaagcagcccttgggtcagaatagcctattgttcagccagtgtttcatcaggagttgtgcaaaagccccttgatctaatggatctgtgtgtggcttggagaatactttcaagtctgccttccttctaactctgattgcttctgattaggtgtagcctagcttatgcacacaggctttcagatgtccagtgatgttggtgaccccaggagggctctgcttggctatttcttttttttctttttctttttttgagatggagtcttgctctgttgcccaggctggagtgcagtggtgcaatctcggctcactgcaagctccacctcccaggtttacaccattctcctgcctcagcctcctgagtagctgggactacaggtgcccgccaccatgcctggctaattttttgtatttttagtagagacggggtttcaccgtgttagccaggatggtctccatctcctgacttcgtgaaccgcccacctcagcctcccaaagtgctgggatttgggctatttctatggctctgtcttttaaacttctgatcagtttgcatttcactagtatcacagagctaccagccttcttgaaattgctcaccaagatctccattgatttaataacattgtcagacataaacttctccatattctgttccaaataaagtcaatcccctcaggcagaactgctaaagccttctgtttttattacctgcctctccctctgggcagaagctgtggatcattgcactggagctgaatgtagcaagagcggcctgtttcttctagattgacacccctattatatgagcaagtcctggtatagggtatattcattttcacactgctataaagaactacctgagactgtgtaatttatgaagaaaaaaggttgaattgactcacagtttcccatggctggggaggcctcaggaaacttacaatcatctagaaggtgaagggaaagcaaggaacatcttacgtggcagcagaagagagagagaaagtgaggaagtgctacactttaaaaccatgagctcttgtgagaactcactcactatcatgagaaaagcatgggggaaactgccaccatgattcagtcacctcccaccaggtccctcccttgacacatggggattacaattcaagatgagatttgggtgggacacagagccaaaccatatcattctgccccagcccctcccaaatctcatgtccttttcacatttcaaaaccaatcatgccttcctaacaattccccaaagtcttaactcattccagcattaactcaaaagcccaattccaaagtcccatctgagaccaggcaagttccctctgcctatgagcctgtaaaatcaaaaacaagctagttactcttaagatacaatgggggtatgggcattgggtaaatgttcccattccaaataagagaaattggccaaaacaaaggggccataggcccaatgcaaatctgaaacccagaagggtattcattaaatcttaaagctccaaaacaatctcctttgactccatgtctcacatccagggcatagtgatgcaggaggggctccgaaggccttgggcagctccacccctgtggctctgtagggtacagcccccatggctgctttcatgggctggcattgaatgcctgtggcttttccaggttgtacagtgcaagctgtcagtggatctaccattctggggtctggatgatggtggccctcttctcacagctccaataggcagtgccccaatggggactctgtgtgggatctctgacctcacgtttcccttccaaactgccctagtagaggttctccattaggcctctgccctgcagcagaattctgcctggacatccaggcatttccatacctcctctgaaatctaggcagaggttcctaaacctcagctcttatctgctgtgcacaggctcaacatcatgtgataagccaccaaggtttgaggcttgcaccctctgaagcaatggcctgagctgtacgtttttcccttttagccatggctggagctggagtggctgggatgcagggcaccatgtcctgaggctgcacaatgcagtggggccttgggcccggcccaagccatttttccctcctaggcctccagcttgtgatgggaggggctgccatgaagatctttgaaatgccttggagatgttttccccattgtcttggtgattagcatttggctcctcgttacttatgcaaatttctatagcaggcttgaatttctccccagaaaatgggtttttctcttctactgcatgctcaggctacaaattttccaaacttttatgctctacttcccttttaaacataagttccaatttcaaatcatctttttgtgaatgcatatactgtacgcttttagaaaaagccaggtcacttctttaacactttgctgctcagaagtttcttctgccagatatactaaatcatctcttaagttcaaagttccacagacctctagggcaggggcaatgccaccagtctcttcgctaaagcatagcaagagtgacctttgctccagttcccaataagttcttcattctatctgagaccaccgcagcgtggacttcattgtccataacaccatcaatcagcatgttggtcaaaacaattcaacaagtctctaggaagttccaaacttccccacatcttcctgtctcttctgagccctccaaactgttccaacctctgcctgttacccagttccaaagtcacttccacattttcaggttatctttatagcagtgccccactcccaataccaattttctatattagtctgttttcacactgctataaagaactacctgagactgggtaatttatgaagaagaaaggtttaattgactcacagttccacatggctgggtaggcctcaggaaacttacaattatggcagaaggtgaaggaaaagcaaggcacatcttacatagcagcaggaaagagagagcggaagtgccccactttaaaactgtcagctcttgtgagaactcactcactatcacaagaacagcatgggagagactgccgtcatggtccagttacctcccaccaggtccctcccttaacacgtggggattacaatttgagatgggatttgggtgggaacacagagccaaaccatatcagagggagatatggccctgatactctctgcttgcgcctcccaccgtggaacctatgccctatgagcaagttgtggtgaggtgattggggccttagtattcttggcctgctttgccagagcagagcccttggcttatgagtggagcgaggtgggggaaagagacccagtccacttagctgcagcttcctagagcagcattttcataacaagggcctactgaggataagaggtgccagtggatttccccttctggggtgaaatcctagaataaccttagcctgggtcttagtcttgactatgagctggggataaagggagccttcctcttttcttagccacatctgccttgtatccataaaactgggatagagatgggttaggaacaggtcatgtatcaaatgccactgactcctattgttcttaccaaaattcactaagtttacttgaataaacatttcttcactttccataagccattaggacaatttccagagactttaaatgggagaggatccaccgagctcctcatatccctattctggaagttctatcagcaacgatttcttatatacaataccaaagacataagtgatgaaaagatggataaagattggacttaatcaaaattagaaacttttgttctttaaaagacactgtctagaaactgaaagggggccgggcacggtggctcatgcctgtaacccccgccctttgggaggctgaggcaggcggatcacctgaggtcaggagttcgagaccagcctgaccaatgtggagaaaccccgtctctactaaaaatacaaaaaataaaataaaataaaataagccaggtgtggtggcgcatgcctgtcatcccagctactcgggaggctgaagcaggagaatcacttgaacccaggaggcggaggttgcagtgagccaagatcgtgccattgcactccagctgggcaacaagagcgaaactctgtctagaaaaaaagaaagaaagaaagaaactgaaaggacaatttatattagttttctactgctgttataggaaattaccacaaacttagtagcttaaaaaatacaaatttatcattttacagttctgtacattagaaatatgacatgagtctcactgggctaaaaccaacatgtcagcagggctcatttttttctggaggctcaaggagagaacttccttgccttttttagcttctagaggttgcccatattccttggctcatggctctcttcttctgtcttcaaggagagtttataggctttaaaaggccatgctgtaacaggcaagtgataacaggctttagtgctgtgggatgggatattggcgttgagcggggtaagggtgattaggttttaatgggatcgtaaggggtgcatcatccatcaccaaggagggagtagaggtgtcctacacttgtggattaaggtggggagatacaaggagaggatgtgaaggaggctttgaactgggggaaaaggtggcaatgaggtgtggctgtgcagggaagcagataatttagttaaaatgtctcgacctaataagggaactaggcaggtggggataactaaaaaggagtgcataaaagaatgttgtccaatttggcaccagagctggggagttttaagaggtttagaagcctggccgtcaatacccacaacagttacggagggaagggatacaggcccttgaaaagaagataatgtggagttggtagcctctgtattgattaagaaggggacggacttaccctccactgtaagagttaccatgggctcagaggcctgaaaggaacatggactgactgtatatgagctcaaagctctgatcatcagcacctgctgtagccccagcataccctcaaggtgtggactctcccctctaaccaaggaaattaaagcatcagaatgaaccaaaagcatttaatgggtaaaggcagccatcagtacactcataggaagcccacactcctaaagaacaggagggtcttgcaaaaacctcccaggcttgtttgtttctccctctgtttctctctctctctctctctctctctctccctcccttgctccctccctccctccctccttccttccctccctgcccctctccccctcctccccctccctccccccctccccccaccacatttctgaaatagagcccagatgagaaacctgctcatgtgtatgtctgtcccatttaagaatagtagattctgactcatgggcaatttcattcctgaaattccaattgcagaaaaaagattagcagaacaggttttatttcattttctatccccctccctttccatcatttcccttgacatcacatatgtcaataagtagcatgtacggaagcactgatcatttcttaattaatacctttacagtttctttttgaggacaatggaaatgttctaaaattagattgtggtgatggttgtacaactctttaaatatactaaacaatcattgcatttcgcttaaatggatgaattttatggtatggtaattttattgtgtgtaaattatatctcaataaagctataaattaagaaacaatcagtgcttccctacatgctacttattgatgtatgctatctcaagggaaatgatggaaagggaggatagaaaataaaataaaacctgctctcctaatcttttttctgcaattgagatttccggaatgaaattgcccatgagtcagaatctactgttcttagatgggacagacatacacatgaacaggtttttcatctgggttctatttcagaaattcatggagagagagagagagagagagatgaaaggaaggatggacggaaggaagcaggcctggaaggcttttgcaagaccctcctgttatttaggagtgtgggattcccgtgagtgtattgctggctgcctttacccattaaatgcttttggttcattttaatgctttaatttccttggttaaagggagagtccacaccttagggctgcgctggggtttagcaggtactgatgaccagaggaaaatctactgagtgctaaatgcaaacaagtcaaggactgaagctggcctgagagtcagggaccccttcccttaggtaggttttagcctaacttctatacatttgctgtaactgaagccccacccccagcagctacattccctggccttcccagaacattgctgtgggcccccatactagatttccctccttcctctggacatctctagaaacatcttttctgcattgctgcaaactttcattttaactccctctctgctattacttaactcaaggacagaggaaatagctgcagtccagaaacagaataaaacaaagaagaaagaaagagaagaagccccaaactcctcccaaatctttaagaaaacaatcctgtaggatttggttgggaattgccatgcaatgtggggaatgtgaaacatgtgctaatcatggccctttctgcttggatcctacctgacttctctccaccacccccagccagctgggctaggctaggcccaggggagccacaaagctgccagcttagaaaatggagacaaatgaggaggccccagaggacaaagcaagacttgttactagttttgaggccaaagcaacacatacagtatttaagggctatgggggtagatgctgcaaagcctggaatcctagctttgagcttaaagattcaggctaatttgcagtgactgactgtgtcagaggtgtttgaaccagagcaactccatcttgaatagaagctgggtaaaatgaggctgagacctgctgggctgcattcccaggaggttaaggcattcttagtcacaggatgaggcaggaggtcggcacaagatacaggtcctaaagaccttgctgatacaacaggttgcactaaagaagccagctaaaacccaccaaaaccaagatggcgaccagagtgacctctggttatcctcactgttacactccatccagcaccatgacagtttacaaatgccatggcaacatcaggacattatcctgtatggtctaaaaaggggaggcatgaataatccacccgttgttgagcatatcatcaagaaataaccataaaaatgggcaaccagcagccctcagggctgctctgcctacagattagccattccttattcctttacttccttaataaacttgctttaactttacagactcactctgaattctttcttgtgcaagatccaagaaccctctcttggggtctgaatccagacccctttctggtaacaactgttctggagtcagtagtttctgagctaggcctcacttggttcaccatcttgactcttgccttgattattgccagactttcctggctcggtgtccctgcatgcagtcagtgccacagtgatcttttcaaaacagagatcagagatctgatatcagtactccctctcttccagtctatctcatctccaggagaaaacccacattccctaacatggcatatgaaatgaaaccctttataatctggccttagttgctctcgcttcatattctatcacctgtcctcaccctcaggtgatcccacaaaactatttatactttcttgaacattttttttttcttccccacatcagtgcctttccatctgctattccttcagccaggaatgaatgcgctttccatctttttctccattaggttataatcccactcttcatttaagactaagtgcctctgtgaaaccttaggcttgctagggaggggttttcagctttcttcttgttgccagatctcactgaacataccttgggaaggcagagttgtgcaatggaaagaacctacatgatagagtcagacacactatgggatggtgagtaaaagactttatctctcagtttcttcatctgtaaaatgggagtatgaatcactacaaggcaaaaaggtttatattggtaagtgccaagcacagtacttaatacatagtaggtacttgggcaatattgtatgttgtagaagaaatagaaaaatgattcctttactctcagttggggactctaaggaggagtttctgagcagacaaccaagtggatggtgttctctggggcctgtttacctgtcttcttggggttcacctgcctttggccaccctcatgtctaaatgatattttgcaattatcctgccttgttgggagcagccatcagctgctttcccattcatgtcccttaaaaatctgtgtgggcaatcataagaggagagggaagaaattttcacatccccttcttttcttccccatgtccttgtcttgcccccaagcctcagattgtctagcagtcacttcatgtcggccttaccccttcctgcaaacatgctccccctagtcttttttctgcaattgagatttcagaaacaaaattgcctatgagtgggaatctactgttctcagattggaatggacatacacattagctggtttctcatctggactctatttcagaaatgtacacaagatgtcaaaaatataccatttggaaccagagcaatatttattttgaaaaaattagggagaaaagtttccttgcttcaattcctactggaatgtaaaataactatgtgctgatgctgcattttgacagcattgagttagttaccctcagggtcactagatgagtggtgcacagacacacacgcacacacatgtgtgcacacacacaaacacatatattcagagtgctttgttgttgactggaaattgcaggcagtctgatgccagagttaggctttaatggatcaagccatacattaacaacactttagtaagtgttcccttatgtgccaaatcttgtgctaggcggggagaagaaaaggacaagtcacagatggagtaatctgaacacaacaagagagcataaagcactaacacattaatactgagagtaaatatttaaagaagaaggggttgaggttactgaactatagttaccagggaaaatttcctggagggaatggtgagacctgagcaaggacttggaggataaaattggcgactctgatttatccacagaattctcttagaaatgactattagaatagatagaatgaatattagtttgcaggaggtggaaacaaaaatgacctgaaattgtatctgaaggaggttatatggaaaagattgagaggaacatgggaccaagaagtagaaggcatcttagtcgtagagtcactactgactcattgtgaatgaccttaggcaagtcctttctctttgaaggacttttcccgtctctacattggagctaaataatatcagccttactgacctcctaggactattgttaagagaacaaatgagataattgtgtgactgtgcttggaaaaatagagaagactatccaaaaatatagtttgggtttatgaaggcagagtttatactgtagccactctcttgcagctgggaataggatgacctcagtatttgaatgaatttttcttggcaggcctcttgcctgccataattacagcctgccagccactagttgagtatacatactgaagcaggatctgcacacaagcatgcatgtgtgtgtgtaagtttgcattgggctaggagattgtagccaagagaataaaaagacgggagaattcttaggaaccaaggagatctatagaaatggagatttatgtaatcatctttgggcctgccacttcagtaattcaggacatcatccatcttccttggtatattacaaagccttcctacttatctgcctgacttcatggtgccccaatctagcccatcttccacactgctgctaaagtgtgtttccaacccaatgacattttggggctcctggatgaccacaaggtagcactcatgctcattcacatgacatagaagcagggctgtatttaactagtattcactgatatgaccacacttcttgttaaaattatgggatcctttgagaggctctttgagcctcttcaagacccctcctgctgccccagctgcccctcccaactcttggacccagccactaaagggttagtgcccagcacagcaagggacctggaggacattgttccatgcactgacctgcatctattctgctttgttggtgctgctgctgctatattggtttttatatatgtttaggattacttttgcattcatgattcatctcatcccagtgcatgtttccagcttatctctcacaacttttccacacagatatcagcaaattgaaattatcatattccgcatctggatttatatgcctgtctctaccacaatactgggaaccctttgagagtagggacaagtggcttcctcaccaatgtagccccaaagccaagctctggacccagcacacagtggacactcagtatatgtttgttgcttatcatagaggatgttggtagatggagccattctgtttgtaatcctctaaaaaccttcaggatctaggcctgaacctggtgcagggcactttcttggtcttcttgcagacctcatgaatgttattcacatttccagtgtccttggaagggagggaaagagcaagtattatttccattctattactggggaaatggaagtattccaagagtacatctcagccacacaatgaatgtttaatggaactgagacataaagtcatctctctggaaattttccttacccacagtgctggaaagccttttgagatttggggtgaaaactgctgccctaatgtgagtaattgaagactgctgccttctggggagatgctggcttggagtctttttaagtgggctgaaggactatctggtggaagtgatgtaaatgttcttgtcccttctgtcccagcactgccaagagagacactggtgtgtggggttgaggtggagaatacattaaatctcttctgatttggttgcttggcttctgctgcaaccaattaacatggcttcaagccaggtatggtggttcacccctgtaatcccagcactttgggatgccgaggtgggcagatcacgaggtcaagagatagatcgagaccatcctggccaacatggtaaaaccccgtctctactaaaaatacaaaaatttagctgggtgtggtggcggtcgcctgtagtcccagctactggggaggctgaggtaggagaatcgcttgaacccgggaggcggagcttgcagtgagctgagatcgcaccaatgcactgcagcctggtgatggagcaagactctgtctcaaacaaacaaacaaaaaaaccatggctttacaactggtggtcccttcagcaacaagttaactttcatttcaggaaatcctctggcaccctttctctgagatggatcccccttacccctacaagaatagtcccttgtagtgagccagcctggaagtgctgtagagaaggccagactgggagaatgactggagccctatctttaagaaatttagtcttcctgggaagcaggcatcgtacgtcaggtacgacttaggctgcaagtaactgaaacccaaactctaactggcttaaacaattaggaaatgtattatctcacataacaagaattctagggaagaggcaggctttaagattggttgattcagctgttcataatgactgtcagcgggtatcaaggtaaatcattactttgttctccagttgaagtgagaggaacctaacaagtaagtctgggaaaccatataggtgtcaaagtttctcagttctatctttataaaaaggagagaaacatgggcactggaaaacaatagggtagattcaaagtatccactgagttcatattagctgtgtggccttggacactcagttaattgctccaagccaattcccttatgtgtcaaatggcagttgttaaaatatttgacttgcttctaaacaggctgctggtaggggtcatgtgaaataatgtgaagacatttggtaagtcacataaggtgccatatacctttgaaacctttgtaaaaaaattatttttaattgacataaaaattatatatatttatggtgtacaacaggatgtattgaaatatgtaaacactgtggaatggctaaattgagcgaattaaaatatacattacctcacatacctgtcatttttgtggtgagaacacttaaaatctctgtgattttcaagaatatgatacattgttctaactatagtcactatgttgtacatctcttgaacttattcctcctgtctaactgaaattttgtatcctttgaccaatatcttccccaaacccccttccccctacttatctgcccccacccctggcaaacaccattctaccctttgattctaatagttctaataagctctcacatgagtgaaatcaggcagtatttgtctttctgtgcctggcttatttcacctaacgtaatgtcctccaggttcatctatgttgccacaaatgatgggatttccttcatttttaaggttgcatagtgtttcattgtatatatctaccacattttctttatccattcatccattaatggacatttagtatcttggctattgtgaataatgctaccatgaacatggttgtgcagatatctcttcaagatactgatttccttttttttttttttggaatatatacccagaagtaggatgactggatgatagggtagttttattttaattttttgaggaaccttgataccgtttttcataatggctgtactaatttacattcccaccaccgctgtgcaagcctcaccacagcacctaaccaccacctttcctccacagcctcaccaacacttcactcttgtttttttgatagtagccatcctaacaggcatgaagtgatatctcgttgtgattttgatttgtatttccctgatgattggtgatgttgagcatatttttatatgcctgctggccatttgccatgtcttcttttgaggaatgttttggcagatcttttgcccattttttaatcaggttatttgttttctgaggccttttaaaaattactatcatcagacataacacctactgtgtaaaaggcactgttagattgaaagtttaaaataaaacctaggtactaaccttaagtttccccaaacagtgcaacacacatctactgagcacccataggtgctggggacacaggtatgagagagaccccctgcccagtagagcaggggacacagacttatgaacagacaacttcagtacaacttggtaagtgaacacaagagtagaggtgtgtgcagagtgctctgggagtgcacaggccttactaacctaaccaggcttcacagggaaggggtaggcagaatgtcaggagcgtatcaagcaataagagggatatgaaaaaatctgtataacatagaaacatatataagcaaagccctcaaacagccttcttattttgtattttagggacacactaaggggtagagtctatagaaaacaatgagtaaacaacagtgtaatgaacttttttctccctcctctccatctgttgtggttaactggcacatgttccctagagcttctaatcaacagtctgaaaactaagcctctctatgtaacagggtctcaaaatgtctctgaacatggaccttcattggcagaacagtattctctgaagcttcatgatcttctgtagcatatcctctgggaattgcagaagattgagcctctaataactggttgggcaggtgtatcaactttttcaggaaggattatttgactacagagtttcacatatcctatcattaaaagttgcactctcctatactgtgttgctatcttaacatactgtaaattaaagttataatttaaaagtgttgaagtgcattttaaaaacagtaaatattatttaaatataaaggaatctcccaccccattgtccagttttttcctttttttcttttattgatacataatattctacatatttaagaggtacatgtgaatatttgttacatgcatataatgtgtaatgttcaagtcagtgtatttggggtatccataccttaagtatttattatttctgtgttggtaacatctcaagatactttcttctagatactttgaaatatacaatatattgtccattgttggatgaatagtttgcaaatatttttcacagaattggaaaaaataatcctaaagtttgtatgaaagcaaaaaagagcccaaatagctaaaacaatgcttagcaaaaagagcaaagctgcacgcatcaccttctgacttcaaaatatattacaaggctatattacaaaacagcatgctgtcggtatgaaaacagacacataggccaatggaaaagaatagagaacccagaaataaagccatgtaaataaataaataaagccaacagatttttgacaaaggcaccaacagcatacagtggggaaaggacacccttttcaataaatggtgctgggaaaactcaataagcatatgcagaagaatgaaatgatttttgtatctctcaccatataaaaaaatcaaatcaagatgaattaaagatttaaacataagacctgaaactataaaataactggagaaaaacctagggaaaactcttcaggacattggtctgggcaaagattttatggctgagacctcaaaagtacaggcaacaaaaacaacaatagacaaatgggaccatgctaaatttaaaagcttctgcacaacaaaggaagcaataaacagtgaagagacaacacgttgaatggaagaaaataaagcaatcttttcattttttcaagtgctagtttaatcagtcccatcagtactgtgggtggcactgtgaggacagggtgaaccttagggttatttttaaatttatttttacttttgttttttgagacaagtcacccaggtgggagtacagtggtgcaatcatggcttactgcagcttcaacctcctaggtaggttcaagcaatcctcccacctcagcctcctgagtagctgggaccataggcacatgacaccatgcccagctaattaaaaaaaaaattttagagacagggcctccctatgttgcccaggctggtctcaaattcctgggctcaagcaatccccccacctaggcctcccaaagtgctgtgattacaggcatgagctactgtgcctgccccgaatctttgggctagatgttgagtcccagtgacaaataattgcttgacatcactctcttgtgtagacatcattgctgccaaagactttttgcctcctaaaatgccttaattatagcctgattaggtctgaccactataaagtctgctgcactttgggtgcatgatttcctgtgctacatagagctctgctgttaaacaggctcgtaaagaaccctcccggacagcttctcaggcccaggtttcttttctgctgtgctttattatctcctggggtggatacccgcctgcctgctctcgagttgcttccccagacccagagtttggcagtgctttcctggcagaacagtcaaccttcctgttacctcaaaccaggtaggggactcagagaagccagacgcaaccccttgcagaggagcatacacctacccttgaaaagcagactgtttcacctctctcataccaattagtgaatgatgggatacgcatcaaggggaagagtgctgagagaatcctctcaggaagtgaactgaaaaggaaaccaacaagggttgagcatgttttccaaatgacaggattctgttttgtggggagtcatcccagagctggaaaagatgtcagaactatgagagaaggtaagcaagagagtgagtcaagtgttttcaccatgggttcaaatggatgtaggcagaactaccttagaccacactccagctttaatctcttgcttaaattttgctttatactcctttcagaaagtttctatttttaattaattttggggtacgtaataggtgtttatgtgttacatgagatgttttgatacaggcatgcaatgtgaaataatcacatcatggagaatggggtagctatcctttcaagcatttatcctttgagttacaaataatccagttacactcttttagttattttaacatttacaatgaaattactatttactatagtctccgtgttgtagaaggatggttaccagaggctgtgaagggtaatctttctaatttttcttgtttgcaaaggggagtttgaaaaccaaaactcaattgaatgtcagggagtcagttgaaacatatgaacactatatacccaccataatataaggtcgtggcccaggctgcaattttcaagaaacaaaaagtgctcagcaatcaagctgaagctgacacaaaagaatttccatagttgagatcccctacagatcccacaggggagaggaacaagtagcacttaattgagagttccctactcaatatagctctcattaggtggtcagcaattgaagtgtaatttcaacaataaccaccctgggaggtaggtgttattattctcaccattaaacaaataaggaaacaggtttcagagaggtgaagtgacttgcccaaggtcacactgtcactaaatggcagaaccaggatttgatctagtgccttgcacatagtacgatttcagttcatgcatattggaatgcatacatcaatgaaaggtctgtgggacaataaaaatccaaattttttacttgtttttgtgtgtttctgacgttttataacagaatgttttaaatttacagaaaagctgaattttacattaaacacttatatatacccatcacctagattctactaatctattcctgctatacttgtttcatatctattcatgtattgattttctctattcactcatcaatattattttctgatacatttccaagtaaattgaggacatcagtgcaggtccccctaaaatttcagcacgtgtattatttactagagttcaatgtttgtttacaggtgttcttttccttttgaggtaaaatttacagacaatgaaatacaaaatctgacgtgggtgagttttgacatcccatgcacttgtgtatccaaaatctctattaatgtatagaacactaccatcaccccagaaattcccctcatgtgtgttggttttaaccatgctgtgtaacttccttacctgaaccagaatctctgttggtggttagaagtcattgattctaactgggaggctgtgttgagatctcttttctttccttgactgatgctttgggagaaaaccaggtggcatacaataagatttggtcctcagtgcacttcactttgataagtttcacctggaagcatttcttttccttttcagcaaatgtttgtgaaaggttgcccattgattgcagcagttaactttgtcggtttaaactgaggtgaaacaatgactatttgttgtaatttattttaatttaatgttactaaggtataagggctagcattaagtggtggttctttacagcagggactctttcatctgtgtttgtttaaaattaaaaataaggctggtaaacataaaatgttcctggcttggtcctagagtgagctctagtcagttccttgagacttagatcaaggctaagggcgaaaacagtcacagaatactcagaggagtgtgtgtgcctgagtaggatttagatgaaaaacccaaagggactttggcttatttgaaagaatcttatcaaagcagacaggctgagttacctttgaaacccaggcttcaaggaattgggtgtgtagtaagattcagactattccatgacccaggaattgtgagatattttttatttattttttatatgtgtatacatttttaaaaataatttcaactttttagattcaggaggtacatgtgcaggtttgttacgtgggtgtatttcgtgatgctgacgttcagggtacaattgatcccgtcacctaggtactaagcatagtacccaatagttagtttttcaaccctcgtccctctccctctcccctctggtagtccccagtgtttattactgccatttttatgtccatgagtacctattgtttagctcccacttataagtgagaatatgtggtatttggttttctgttcctgcattaatttgcttaggataatgacttccagctgcatccatgttgctacaaaggacatgatctcattctttttgtggctgcgtagtattccatggtatatatgtatcaccttttctttatctgacccaccactgatggacacttaggtggtttccatgtcgtagctattgtgaatagtgctgcaatgaacatacaagtgtgtctttttggtagatcaatttattttcttttggatactcagtagtaggatttctgggtcgaatggtagttttaagttgtttgagaaatctgtgagagttattataggctaaattagcagagatactgatgggctagtgcctgcccctaccaaacatgcctgtgactttgattcttttggttaatattattgttgctggttggcaatgtgagcatcaccaggaggacttctaattcagagatttttacactgtagcattcgtcagcatcacctggagggattaaaacacagattactggcctcacccacagagtctgtgattcatttgacctagggtgagtcctgaatttctaacaagctcccaggagatgctgatgctactggtccaggtaccacactttgagaaccactgctctgagtactgaatgaatgaatgtataaataggatcccttgtgccagacacatttcttcccctctataaatatggcattatttatgattcagtgaggacaggcatgccccttagctccagctgcattttagagtgaagagattctaggaaagacacatagactactccttttctccaacctgcacagcaggaatttcagtttgtactggacttattatgaccctatcttttcacagtcctaactgatcttgctgcatacagggaaagaatctaggcccccaaccacatggcatagttttaattaactcccttctgtgttgggaccctcagaagagataatatgtggctatggagaccatacacccagatttcctgggacagctctgatttcatatattctatccttttgtcctcataaatataattgtcagaccatgttctgcttttgggttcagaaaatattgttcccatatgcatggcctaggggccctgtggagccaaaagcaagtcttcgcttgctttcttgggattgtgggggccagggcaaaagcttggctcattgtgagggatagaaagttggggagaatctaaatgtttaagatcaccagcaagcttctcgttgcttctttcttttcaagtgtcccagtgaccgtgttacagatcccggaatgttgcaaataagagattctgagtgctgaaagggactaaattggacctctggctgcctctctttcctccgtcccccacccctctggaaggaccacacagaaatagcagagaagagccactctaaagaaggaaattccacaaccttcattgactgaccactcagtctaacatttacctattttgcctggcaggaagttcttcctccttgcttatatcagtccttctcgttgcaatgtcagtttcttttcctttgctctgctttcaatcaaaattgagaacagctggtccttccctctaaattttttttatgtgcttagaagtcatattaaaccattcttcctgggtccaggtttaaccatccttggagctcctttatccttcccgcatgtatctgacttgccaaccatttcatcattttgccataggaaagcagcttaggcagcctgggcgaacagtacagcaaagcctaaagctttatggcttgtgctaatgggcgtgctaaatgtttagtagagactatttttgagcacgcaattgtgaacaatttaaagtggaccgtacatggaacccatttcctctcctggctcccccaacagggcctccccttagcagctgaaatgagttagtggcaatcagcgcaaagtaggaatcctgtggtttctgcccttccctcctgctgcttctatggcagctagtctcttaaaatgagcattctctctagaatagccagtaaatgtgacattggaatcagttggacaaagggtctaggagtcactttagctaaatagcaggaggtgctagtgctgaagcaccactggaggttttaggagaggttgaggggacagggttgaacagcgattgatgaaagagtttggacccagaatatttgctatccacagaacggttgtacctcagagttgtacatgccttttttgcaagtttgtagaggacgtttctggcctttgttcacttggcctttgtccactgtctcaactatgctaaagtgatgccaggaatctgtggcagaatcccagcttcagggccagttgggttcctaaaagagaggagggtaacttgccatgcatgggattcttctgtcaggcaggctacctgcctttgatgggatatgttctttgattactcaagtgatttgggagggctgctgccttaagttggcctgcagggtgggtccagggcccatgttagggtgaattggatatatctgatggcactgcagagaaaagggatattgtcctgttctcatcttctgactgttggctcctctgttttaatcaaaccttaaaagctcttctctttataagcaccagccaggcagtttgtctcagcagagctacaggagcacttaatatatgcagccataaagaagaaggaagaaaaagagacggagaaaaaaaaaacctttggcatttgtatgagagtgtcactgaaggcttcatcacagatacactcaagacttagaaactgaaattgtcttggggtgggggtggggagagcagtttgattgaagcgttagctgccttggccctgagccaaggcaaattgccagagaaccattaaactctgtgtaattccatataactcacagcagccacaggtaatctgaatcagacctgacaaaacttcactatcacttattgtccattagcactgaatgcatgctacagatattaaactttttaaagccatatcatggtggccatattttctaaatcccaatcagaaaacctggcttgacaaaggatttattttctgacttgtgaatttgtttatatgaaaagcctcacaaaaggtataatcactaactcacagaggtataaaatactaaacccactgaacaaatggtttttaaggaaagaactatagttgcatgaaattgggtcagggcaaactcatttggacattgatgagggttccccccaccccacacatactttttgggggtctgagggcactggttaacgaagcactaaatcaaattagaatctggtttatgcccatcatctggatttgctcttaaatttttcagggatggtgaactgaaagagcctgttgtaatgtctgtacacacgaaggtggagtcgatgttactttgaattcccagatggtgggagtagttaaatatcccactgttcatggtctgtttgtgagggcttgtgtgtgttttaaattaacttcctaaggcagagaatgttaaaaactgaggagaatcatatctggatacaagttattattgccatacacctcagtttccttaaaggctccattccttccactaaattgagagtctaacattcaccctggggcacctcgtgacaaatgggatatttagctcaaaggataattattctggattattctgagccaataataatgctttttacaaagtttaaagtgtctctttagcaagaactcttagtattgctagttaaggatcatgaatagcaatatacccgtgaaatccaaaaggttttgtcacaaccttgcagaagaaagtatcttaaacctaatagatgctctatcccgggcaagtcatataatatccctgaacctcagttatatgaaaaacaaagtgaaaatattgttacttctccagaatcagtcaaatgaatagggtgatatcctgagatcccttttaattctaatttcaacaaatatttgttgagcaactacaatgtgttcaatacagacatttattttcctaggtgccagtgacagagctgtataaaggcattgactatctcccacactataatgtatcttgacagcaagtaaacatacatagaaataagtgagatcatgtaagatggtggtaaattctatgaagacaataagacaggtaatgtgatagagagtgatgagatgtgggtagagaagagaaggaacattctttatgtggttggtcaggaaaggcctctctgaggaggcaagatctgagctgacacctgaatgataaaaggaggtatgtaggatctagaagaagaatgttctcaacagatagaatagtaagtacaaagatcttgagatagggatgggcttgacctctctgaagaacagaaagtttggtatgacgtgtgtgtgtgtgtgtgtgtgtgtgtgtgtgtgtgtgtgtgtgtgtgtagaggatgagaggttgtgggaaataaggtcaaaaaggcatgcatggccagatcatgtagagcttctgatctgctgctgtttacattgtaaaaatcattctttggtctgtctgatttaattaatgaatgttagtaccagatgttaatgacaggagggcttgaagtttgcccataggaaacccaaggagagggtctgggtgtggagtaggggggcagaaggggaagatgaagtagaaaaggcgagctcaaatgccttgttggcagggcagggagaggtgggagtggaaaagataatgtgtagggagggttggaaaaagtttgagggaggaggaaaagcaccagagtgacctcggctgtgaggaacaccgtcagtgccaaggttgtggagtctgctatcagagggggtcaacctttataggagaagggacaggactgtactcttgtttaaagttagaagagtgagaatgagcaggaactgaagctaaaaatctggtcctctctttttatccagccttaacttaaaaagcaggtctgatgtcagagagaatggcgttcacattgcttgccttatttattttccaggtcttgaactcaaatgcctatcacttcctcctgcattttcttctcaacttaatcctgtcattgcaaaaggaaataatctctgatgcaagagtcccttcccgccactaacacataagcaattgagtgcattttttttcttttttttcagttgtggaaactcagttttgttttatgttatttggcacgttttgttgagtaggaaagagatggtgtgtcatttctcagtcatgatgtgaacaggacagtagcttggaacagactgtgtgatggctcacttattcccagatttgtagcactatgtgaaagcagcagcaagtgtgctgatttaatataaaatgggatctgtcctaggctcagtaaaggatgttattattattgcttttgcaacatacatgtatgccttggtaggttatttatttgggagctgtttgctttggtagcagttattcataagggtaagaggaagttaaatctcttttctcctcctccacctcccactggtcagaggtctaagtggagaccagagattaaaattactgccaaggaaagggggcctgggcagggtcaaataatgttctgggagtggcatgcaggtgcccacctccgggaaatagaaaacaaaccccctctcccttcgtccacatctgctggagggtatacaggctcctagtaagctggacaagtggttttcaggcagcaaagcaggcctagtagtttccagaggcagccttttgtccctaccccgaagggtgtttagtccctgggtccttttccagtcagaaatgactaatgttggctatgtgtactctttagaaactgtctttggctttttgcataatggattataaataaatggctttagagaaccagcagtgagttattgagtgaacctggctttgggatggttcagattccagatagttaatcacatcctcttgggctggaagactgtatccaactcactcacattcagtaggcaagttaaaaaggcatttttgatcaacttgaaaaatagttttcacatcaacaatggcttgttactgaagaaataaagattatattaatccaagtagaattattcccatcactctctaacagtctggtggaatttaacacacctcttgttttaatttggccatttcttacaagtattaatgcacagtttgaaaatgacaatgaattgatatgtcctctttatagtgtttttatattaggcggtaggtaaaagactgttggtcttttcagcctcctaaggctcacctgctagatttgtacacagtgctctcttaatgctggaggacattatggactttctggtttgtcctagactattttaatgctatacaagggtaaactctgttgctgacaactgcttctggaaatcaggagcaaattcacttgcactctaccatattcattcctccggtttgttccactctggttctccctgaactctctccaccacatcagctttgcaaggttctctgatcatttgtatcactgaaagtcatatcttattagacagtcaagaaacataggcaatctaacaaagagactgcattagtccattctcacactgctataaagatactacctgagactgggtaatgtataaacaaaaaaggtttaattgactcacagttccacatggctggctggggaggcctcaggaaacttacaatcatggcagaaggtgaagtggaagcaaggcacgtcttacatggcatcaggtgagagagagcgtgaagaagtgccacacttaaaaccatcagctctcatgagaattccctcactatcacaagaacagcattggggaaactgcccccataatccaatcacctcccaccaggtcactccctccacatgtggggattacaattcaacatgagatttgggtgggaacacagagcctaaccatatcagggacagtaatggtgcctgaggaaaggctagttgcctgtgtgacaacagcctgatgaagttcagcttctaggagtaggtgtcacgaactctggggaccgtaagaaagaaacatatctgagattgacatgaactctggggaccataagaaagaaacatatctgatattgacaagaggagtagcagtagatggctccaacattggatgaggaattgattctatttttataatatgtcaagacaaaaattggctggagattaaaaatggaatcaaatcattaagacttttcacctttacctgtcaactggtaaaataaagtgttgttctttattttcattttttactgaaatcctctaccttctaagaggtagggaggatgaatactatctcaaagcagacaggaacagtgggtagattaatagattatagccctattgtgaaggctaacgttttaagagaaatgttttgccttgattaaaactatgagtatgtgaaaatgatgctggagtcttggtgcctacctcagaaatataagctgaatagtctagaattaaagactaaagaataaagaataaaccatcaggtctcgtgagaattccctcactatcacaagaacagcattggggaaactgcccccataatctaccctctttttccttgttggtatctcttagaatctgatctaattattcttttaattctttcttaaattaaggaataatttacatatagtaaaatgcacaaatcttaatgaatgtttagttatgtatattcccatatgatctgcagccagataactatgtagaacatttctagcaccccccaaaaattatgctcatctgcctttacaatcagtagtacagagttaaccattttttcaaattatcacctctcttctttaccttcatataaaatgaaatcatacagtatgtgttgtttttgtctggtctctttcatgcaacataatcttttagacattcattttattacatatattgcttttttttgactgctgtatagcatgtcattttttgtatgtgtatgttttgaaggacatttgggttgttcctactttctattattaataaagctgctgtgaacaatcaaatctttttatggacacgtgcacttatttctcttcggagtctctaagtatggaattgctggatctgagagtaggcatacagatttccaaaatggttgtacagctttatactcctgccagcaacgtagagagatcaaattgctgtacattctcaccaatacttaagtctttttaattctggccattctggtggatatgtagtgacactttactataattttaaatcacatttccctaatgaagaattatattgagcaccttttcagatgcttattgggtatttggctatctcttttagtgaagtgcttgttcaagccttgccaattgttaattggctatttgcctttttcttattgatttgtagttcttttaatattctggatataagtcatttgtcaggtaatatgtattatgaatattttcccagtctgtggcttgtcttttcccttttttagagctgaagattttttttattttgatgaactccaatgtatcactctttcctttatgattactaccttttgcatcctgcttaaaaaatttttgcccacctcaaggtcacaaagatatgctccatgtttttctctaaaagccttatgattttagtcctctcattgggtctgtaatccagctaacatttttagtaaaaatgtacatcagtaaaaatgttttgagtatgtgtccccagtatacacaattttatttatggatgatctaatttattatcaccaatattaaatattaataaagcttgatttttaaatttttgtagatatataaacagaagttccagtggatcaccttgtacacagcctgggatatatgtaccccattctgaacactattgttctataccaccaaagactaacatttgccacaaacactgatagcattaatgtcagaagaacacttcagtgtaaacaaatggctagaggtgacagagccccagtgagcatatctgctagcaatgtaagaaaccctcagtttactcttgtgccgtcacgtttgtctccccttaccagacttatagagacagcaggacgatctgacttggcaggagcaaagacaaatttgcctttggttgctgacataggggacagtgctcttgagtcttcttcccctgtcctcaccaccaaattcctagagctggtggcactgggctgagttttggcaaagatgcttagaatttgactggagctaatccccagggaaatttaatgatttggagcttagacggcctttgttgtgaggattagtaaactagatggtgattaagcagctggggaggaagaagctgtctgttgggctaggtcatgctgtggggcacagcgcatagttccgttggctcaaggtcaggggagcccttgggcctgattcacagagctttatactctggggcagctccttgtaggatttgggcatctgcttattagctggtagagggaaagaatggcttctcccttggtgtacacctcttccctctatccacatatagggattactcctttgaatcaggtctacttacatctttttaattggttattgtttttcaattctcattgaaaagtttttgttgtctgttttgccttttggaaaactggtgtaaagtacggaagatgaaattaggaacagagtttcttggttttctaatctagactgcttcggaaatttgagagcggtttttaagggaagaagttgctgaaagagacaagttaggtattgaaagccatggcaagaagactgccgaggtttgaaagcctgtatctcccatgtccagggaaccctgattaatttctcctagcatgatcagattctaagagataccaacaaggaaaaagagggtagattagaaacagcccccaacctgtggtttgcttaagatttcaaactaagtttcagaatgagcaagcactttattcattctttgatgctcctacttcttaatagttaaacttcccaaagccagcttaaccctagctctacatttttctattcgtttcccagaaaaggccaaattgatgaacggatgcctggagtgttagtaaaaacttgaaaatctttctaagatgctaaaaagatattcggaaggtatattctttctttaaataactggactacagtattctgagtggatcttttctgtctatttgcaaaaacaataaaacaaaaacaaaaaaacaaacacatcaatttaaacaattatgttgtttgccttctttagatgatagacaagctggtggaggtagcagtatgggctggtaatttggccagaagctcttggaactgaccaagaaagtttcagttgatgcccattttttccaataaatttcctgtagcaggcagaggtattcacaatcatgtcactgatttttaatgctgctcttacactattgtaataggtgttcagtacctgtcagttattgctgcagatggtgtttctcctctgaatgcatttttaaattataaacctgatttaataattcttctattccctttttcatctcctaaatgtattcaaagacccaagcaagtatctgttagtatctgactaaataaaagctactagaaagccagcaagtgctgttaagtcaattgttgtttgcctttactctcaaggggccaacttgtcactttgttgacagctatcagagtacttcatgcttcattgaagacccatcaaaaatttccaaattgctagctcattagcacaaaatagggcttcaggaatctctttctctcagtgtcctgactgggccttattaagtgttccaaccttggtggaccactctgaaacagtggataaagaccaggggaattgagagatggatgttaattagtcaattttgaaggagtaaaacatgggtgaaggcagagtacaatgggacaaaaagctgagattatctgtgtcagcagaaggataatgcatgactttgctaactgttcacaggtcactgaatgtcagagctgaaaaggcccagagctgtcagagccccaggagatcatctggtcagtccctcttacacattttaccagtaagagaagagaggctgcaagaagggaaagggacttgtccaaagtcaatcagctcttcctagctttccaggcaccacctggcttttggttatatgacctctatgtaatcaattttcaattacttgggccactcactgctagcccagcaatcacttgggtaatccaaaatgacacataagttaaccatcgtttacattgagctttgtgatgtgtgtttataccgacattccaatgcatctgggtctaatctgagaattcacaacacttcaactgaaacaagaaagccaccctgaaggtctgattcaggaagagctggaaagcttactgaatggatagcatcatatattgttatacagcccctcaaacaaggtatgttaatttcaacaagtttgttgattcacacctttccagggccccagccagagttaggaggaggaaggtgggaaggggaaaacaaaaccttttacggaagaatatgcatatcatctttcgcccctccatcccccttcacccttcctctcattcatttttccttccttccttcctttcctttttttattgatagaaacatgaacatctgctttgtcttccatataaacaaatatgtggctgagacattgacctatagaactggctgtaaggaggccagacaataaatagaagacgtgctagacctcagaaatctagaggtagagtggggaggagaaagaccagtgagcagtaatttaaaaaggaccaacaagtctggaagagtatagagtccattgcacagctcagtaaataccctgggtctggaaaagggctagtctgggatatagttgaagggatcttcaaccaaatggagtcttacttcctgatctggacccttctgaactcttggattatgctggggacccaaaatttgctggctttttgtctgagcatcttcagacttgcactaaagtaggattatttcacttaacatatctcttaaggaggaggatgctggtgactgagaaggggcatggaacagaaaaaaggggtatgaacagttggcctgatgctgtagtccaagaaggagtctgtgcaaggactcagatagtggcagctgaaggagcagtaaggaatgccaaatgcctgagcttttgctacagcaataattaagcattttagtttaaaaggttttccccttttatcttttggtctagaataaacagagatcttgctgctgtaacagagtgtttaattaacgaaagatggtacttaatacatattgaggggaagacttgctatgggtaacagtaatatggataattaagttgtatgaattaaaaacaatgggtagagtgaattaagactaatgtacatcaacagggaaaatctattagcattcattagttagacttctgtttgtggttctttgttagcctcgggaaactctttcaaatggctgatccctgttgaaagttctgactggtgctaagggccttctatggatgccaaagtaatgagtcattcaaatagaacttctgaaattcaagtacagcactttccttttctctctctctttttttcttggcggtaggcagcagtgactgtgaagtaataatgataatgacaatggaaataagagtgtaatcctgtttaatttgcttagagttgttccccatttaccaatattggcttgtttggtgttgagtgtggcccgggtaccggaacaaaggcatatatattcaatgtcacttggctaacctatgatttgtcagacaaaggttaatttttttaaaaaaaagttggattagcagcaataaatgtaataacattctgtgatttaactcagaagttcaattaattcgatggagtttaaaaaatcctgaacttaattttttctctgcactcaggaggtctcatctgccaaatttgcacatgagctggccaacctaaagctcaacaatattataacttccatggtgtggggatagatggaggagacattataaaagactgagagagagattggaacaagagtagaagtgtaaaaatacctccagtgaataccagcccttaattgccccatttagaatctgccatcccctaaggactatacaatttaattatccttacgttccctttccctggaaacaaacaaaaacaactcctgattatatcagtgagttggagccttttttacctgaccgtcttagttgataaacaagctgtagacaactaatttctgcccctgaggctagaaattaggagccttgttcatttttatatctctagcatgtagcatgttgtcctgtacataatagaaatgtgattcaatacttaaggaatgattaatggatggatgagatgactcctttcatggattatcatggatggaattgatgttctaataggtggaaatcaccttcatggtaaaaggaatgtaataaaaatgaatgtataaaattagccataagcaaggacccccagagacattctgctttgctttgctttgcttttgcctgccccagtggctattatttctgcctttgctttcaatacccctcagtctgacaatcttcttccccagattgccctggttagtggaaattctataggctgtgttggaacagtaaatacccatatttccagctttctctgaatgctcactgtgtgtcagacactagaagcactgtgctgggcacatgttgaagagacatagataaagaagcagctacattgtacctacttgtatcttttgaatttgccattctactcacagaatgttgaactgtaagccactttccaggtcttcagagtcaactcccttgttataataatcagagctcatgttaattgaggacttactgttctcagatatatactatactaacaactctgtgaggtagctagtcttgttatctacatgtcacgtaggagggaattgagacacagatgttaagtaacttcctaagggtcacacagctaggaagtagcagagccaggattcaaacttacgtttgtcagacttcaaagcctgcccaaagataggaaagagcttaccaaaggtcattttgatggagcctagctcttctggctctaatttgtctgcacgttttggtaggccacgctgctgctttagccacatagtagggttcattccaagcatcagtttcgtatttagaagttctagtcttcccagttggactgctcattcctccagtcagggattgcattatttccatgttgcctccttcctcaaaggtttgcccaagctttgccttcagtaaataatgacctgtgatcagctcctgagctactcccaggagctgcctggagccattccccagtactacttgtggctccagggttggaagaaacaagtagaattttggggagaaagtcatctcactacctgctttctgttttgttctctgcaacacagattgaagatggaggcaaggcagctttgtcccagaagatgaggactggtgatgagctggtgaatatcaatggcactccattatatggctcccgccaagaggccctcattctcatcaaaggctccttccggattctcaagctgattgtcaggaggtaaggtacagggagattctccgtaaggtgcagaggccactgaaacttggttggtaataaagctcaatagagtcatgtctctatcaatattataaaggaaagaggtgtttcacttgaatagaattttgcagacaactgaagcagaatagcacaggagaaagagcctttggttcaaatcctggcactgccacatagacacataatcttggatatatttattagtcctctgcaagactgtttccttatttgctataaagaggactaaattactcattatataccaaagggctacctaatccagtgtttttcaatctccttctttataatacactatcattcctgaaccacatatcaatggagacttaaagagcccctactacagccatggaggctgtagcaaactcttagaaaccctttccttgaggattgcacagtctagcaggggacaaaatatacacatgtgactaagtagcagtatatttttaaagaaggcaataaagccttgtgtgtgattatcaaatggattgttcagacaaaaattgctgttagagaaagagatcactgcagaaggtattgatagggtaagacttcatagaggaagtggaatttaagctaaagggtgagtataatttgaaaaataaaccatcagaagaggaagacattgcaggtaagtgcagtggcataagcagaaggaagggaaggacatatttgggcacagtcattctgctaccaccaaaagcatctgcctattggtgaactttccacatggcttttctttcattttgctgctgcgcctttgctttgtattattggagctcagccttctccctttctattgtttttttttttctttatcgtatatacacacctaagtttttccatcttgcatcttcccacaatctcacttctccctctggctcctgccccgtctttctccttttgttcatactcagtctcaaaggaagagtctatagtcactatctccacttctccacctgccatttagctttccaccctctgcagccagaatttgaccctcagaactccactgaaactactctgtcaaaagctacaaattattgcctaattgtcaaagtcaatgggttatttttcatattcatcatatatggcatttaacattatagctctagattttgcccccaccttcctttatgaaactcaataccaaaaatctcacacagcaactcaatagcaaaaaaaaaaaaaaaaaaaaaaaaaaaatccaacttaaaaatgggcaaagacctgaatagacatttcttaaaagaagacacacaaatggccaacaggcatatgaaaaaatgctcaacatcactaatcttcagggaaattaaaaaccacaatgagatattatctcactccagttaaaatggtttttattaaaaaaaaaaaaacagatgctggtaaggatgtgggaaaatggggaatcctggtacactgttggtaggagtgtgaaatagtacagccaccatagaaaacagtatggaggtttagcaaaaaactgaaaatagaattatcatatgacctagcagtcccctgctgggtacatattcagaagaaaggaaatcatataaaagagatatctgcacccccatgtttattgcagcactattcacaataaacaagatatggaatcaacctaatccatcagtagatgaatggataaggaaaatggggaatatatatacaatggaatacgattcagccataaaaagaatgaaatcctgtcatttacagcaacgcagatgtaactggaggtcattaagtaaaataaggcaggcccagaaagacaaatattacatgttctcactcatatgtaaaggctgaaaagagggatctcatggagatagagagtagactggtggttgctagaggctgggaagtggggaggttgaagagaggttgatgatgggtataaaaatacagttagatagaatgaataagatctagtgttcaatagtttggtagggtaactatagttaacaatctattgtatatttcaaaatagctagtagagaagaattcatatgttctcaacataaagaaaagataaatgtttgaagtgatggatatcccaattttcctaatttcattattacacattatatgtatgtatcagaatgatacatgtacccccaaaatatgtataactgttacgtgttaataaaaaaaaaaaaagctcttactttttttttttttgaaatggagttttgctctgtcgcccaggctggagtgcagtggcatgatctcggctaactgcaacctccgcctcccaggttcaaacaattcccctgcctcagcctgctgagtaactggattacaggcatgtaccaccatgcctggctaatttttgtatttttagtagagacggagtttcaccatgttggccaggctggttgcgaacttcggacctcaagtgatccccctgccgcagcctcccaaagtgctgggattacaggcataaggcactgcgcccggccaaacctcttactttcaagatagtcagtttccttgttattttcctacatccctgtccattttttaaaaaccaggctctttactacctgctcttcctctgaccattccttaaatgttggtgtttcccatagttccaccatttttaacttaatgtaccctggaaaatctcacccagccctatagcttcaatttattttctatatctcctatgctccagaccatataaccaacttcctattagacatttatacttaaatgtgtcagagatattgcaaacacaacatgccccaaacctaacacatcatcatcttctcccaagatcgctatctatgaccaggaccactatgtatgtactcagccaaccaagtcagaaacacagaagccatctttaattattccattatcctcatgttctatatccaaatgatttatcctgaagagagaatatttaaggagaaaggctttggacctaggaagaatgaggttatgtaggatcccactgacttctattacctgctggtacctaagattaatccatacctgcccatgtacatggataggaggtgacatgttaagtaatgccttatataatagatacattatcactgattaaatcttggattggtcaagatttaggtcttaaataaggcttcttggaggggtaatttggtgaatttggaagcgtttttgttttggagttagatattcccatgtttgcaacttcctaggtctcttatatgacaaataataattcctatataatggcattattgtgatgattaaataagataatttatgtaaaatgactgtcacataatgggttgtcagtgaatttcattcccatttgtttccttagggtctaaaagaagcataattggaataaacaaacattgttaaattgggagagcatcagaatggtggtgtgctttgcagcctaacctgcagagaatgatgtgctaaggaatcattaggggtggcaatgatctgaataagaaataaaggcccctgtgagatgctggttgtacagagacaccagcaacttagagggagtgtgaacactatctagagtgtcttctgagccagtcacaagaatgagagtgttcaggtgtttcacccactcatctcgccagggtgagttccatgtcctctttcctcatactgtagcaacatctgccactatcagtcacttaggagtggctataattatgggcttggactagcagggccctttggttttcatggtgtggcaggtcctatggctcccggaacctgtattttctacccttttagcctccccatctcagcccctattggtgaaggcttacaatgacataatttattaggtgatgctgccctcttgtggaaaacttaaccttcacatgtggactaccttgggcacggtataggaaattaattccctctcgttcagtccaaatttttcgtcaactttatgaaagagctcttaacacgtaaaagaagtgtgattaccctaaaatttgtgaatattcagcctagtgttttatacaggtagaaagactttggtttgagtaaacaatcagctgacaaagatccaacacttagctttaggtctgggcttgagtccttttgggatgaatataaacagaaggaactttagaacatggccaattctgaaaagccaacccagctcttcttcctatattgctgtctagataatggtcagctaaatcagaaatgtaggtgtcaccctcaactcctctctcacccaattcaattaattccaagtctacatagacctcttggttgcctttgtcttaatccagccactcatgatttctcacctggactattctaagagccttcccactggcttctcagctttcagtctcactttttcctaatcaatccattctccaaataggtatttgagcatgtcacttctctattaggaaaaaaaaatcaggaacaatgaccacacaaccatgttgatcccaagatattcattttatattgattgatgatacaaaccgtattgaagatattatatttatgaaccattttttttttgcaaaaaacatggcatccaaatatataaagaaaaaactgtcagctatacaaaaagtgatagaaacttctgtatgggagagtttaacataatttaattgacaataaagtagaccaaaataaagtacttagaagatttgaaaaacaattcattagatccaattaatacattttgaaaattgtttatagactgcatattgtctcttcaaatattgagataatatttttaaatgatcatatgtatgtcacaaagaaaagctttgcaaactctttttttgagatagagtcttgctttgttgcccaggctagagtgcagtggcacgatcttggctcactataacctccgcctcctgggttcaagcaattctcctgcctcagcctcccaagtagctgggactacaggcgtgcaccaccacacccagataatttttgcatttttagtagagacagggcttcaccatgttggccaggctggtcttgaactcctgacctcaagtgatctgcccgccttggcctcccaaagtgctgggattacaggcatgagccaccaagcccagcctacacacgcttaagagtagaaatatctgatgataatgtacaatgtttacaatttaaaaacaaattttaaagtcttcaattacttgaatattttagatcacatttatatgtgaatattagcacaaagaaacactagcagactaacaaacaataataaaaatgagatcatgacttaccaaaactttgagaatattcagaagtaaattcataaccttaaatattttattattaaaaatgaagaatgaaattaaatgactaataattcaatataatatgaaaccaaggactaggtttcttttcagagggatgaattaaatagataagcctttagcaaatttaatcaagaaaacaaagatgaattaccaataaaatttaaatgacaaatggaatacaacaacaaagaaagattttttaaattaaaggcgcactactataattgtaccttaatatatttgaaaatctcagagaacttaaaaatatctaataaaatattaaatgccagaaattattgagaagttgaaaactaaatggacatgtaacagtagaaacttcgaaaacaattatcaaagagaaacttccaaaaatactttagggacatctaaaaatactttagggctttaagggacagatatttttatctgtgaattccttcaaattttctagaaatagccacgtttaattctataagtatgttatagtattgaaaatgttgcagaattattcacattgtttttgaagctagcattactctgataccaaaacctgacagactgctctaagaaagaatattctatccaatttgtgaatttagatgcaaaatatatacatggaattctatgaaatctaattcaatagtataggacagtaacaattcattacaagtattaaaataatttttaaaaggcaaaattttgattcttacgtagacaaaaaatgaacatgttaaagattgtatttcactcattaatgaggaaaacgtaaagtgttacaaccagttcaaaggagaagtcaaagagtaacaaatttaaaggtaacaatagaccacagtaatcaattagaagctatatggagaaatttatgtcattcgtaatgggaacaaactcataagcaatcaggaatgcccttaagaaatatgcatgaaagaaagaggttgtgtatggaggaaattacaaaaatgtacagacagagaaaatgaacacaagtaatttttgatgatgtgggtaaagtcttagggtactgtattactttttcttacaaaaaggcaagatacaattgaatgtacagtatattgacatattctggtttagccatgctctccatagacaacttccgaaccatcattcctccaccctcatgtaagattcccttcatttttgaagctcagacaagcagggattatcactctcatttccttaccaatgtcatttatcagcctccaggttattctttcacttccattttttaatttattttaactgatacatagtacgtatttatggggtacatagtggttttccaatgtgcaatgtatagtgatcagatcacagtaattagcatatctattatctcaaacatttatcatttctttatgttgggaacattcaatatcctttcttctagttatttgaaaatatataatacattaatcttaatgctggtccaggatctagataccaggttcatataataaaaactagattttttgctttttgatcagtgtacccaaaattgatcagttatttaaaaacagtctttcaaatatccataatcataataaactgaatggaatgtcatatgccaatttaagtgaccacgaaaaatataactatcaagaaaaccagttactcatagttcctacttccctacatgaggatgtgtaaaaaaaaaaactcctgagtccttcctatgtgtcatagagtgtactaggtgctgagaacgcaacaatgaacaagcagcccctgtcctcatggttctagtctaagggtcattttttttcctctatagagccaaataaatattttaggctttttgtgtcacacagtctgccacaactcaattttgccattttgtattatttaacaaatctctgtatatccctcccttccccctaccttctcaccctctagtaacctctgttctactctttacttctatgagatcaatatttttagcttccacatatgagtgagaacatgtggtgttcaactttctgttcctggcttatttcacttaacataacgtcctccatgttgctgcaaatgacaggatttcattctttttatggctgaataacactccattgtgtatatataccacattttctttatccattcatctgtttttgaacacttagattgattttatatctcagctggatactgctgcaatagatatggggtatagatatctctttgatatatatatacacacatacatacatatatgtatatattttaaatggttggtggaaaaaagaatcgtatttcatgatatgtgaaattatatgaaactcaaatgtaagtgtccataaataaagttttattggaacctattgatttatgtactatctatgcttctttcatactaaaatggcaaaattgagttgtggcagactgtgtgacacaaaaagcctaaaatatttatttggctctatagaggaaaaaaaaatgacccttagactagaaccatgaggacaggggctgcttgttcattgttgcgttctcagcacctagtacactctatgacacataggaaggactcaggagttttttttttttacacatccttatgtagggaagtaggaactatgagtaactggttttcttgatagttatatttctcgtggtcacttaaattggcatatgacattccattcagtttattatgattatggatatttgaaagactgtttttaaataactgatcaattttgggtacactgatcaaaaagcaaaaaatctagtttttattatatgaacctggtatctagatcctggaccagcattaagattatgaaaaggaactgccatatctttgagccttgtctaggccacctgccagcctccctagctgtcctgtctttgttgttgtcataatactcctgccatctataattaaatggaaggggttacaactgttgaaacttgttaaaactgaagttgtcctaccatgtattaatataccagggataggaagatgtttacagttggcacagtgttagagaagtcctggaaaggcaagagagagaaaaattaaaataataatataaaacagaggtggggtaaactatggtctgtggccaaatctggcctgctaactagttttccaattaacattttattggaataaaagcaactggagcaggcatgctgatctatctatgtgttgtctatagctgtttttaaaaaaaaaaaaaaaagacaccaaaatggcaaagttgaatagttgcaacagacactatatagtctacaaaacctaaaatatttactacctggcccttcacagactaagtttgctggcccctggtataaagcattctccaaaaagaagaccttgaggctctctctaaagcttaaaaagactgaaagagaaccatcgtagtctacaagtgagaatgaataaaaaaatcacagaatatttaagccaacaaacatggtaggcaaactgctggattcttgagattcaattattcttttgaatttgggcaatgatgtggttggtacagggtaaaatgaatggtatatgggttcacacaagtgtgtgtttgcttgcctgcttccttctgttcacaagatatttattaaatgctacttccatctagatacggagttagctgttggggataccatggagaataacatagacacattccctgcccacatggagcttataaatctgttgtgtttgactctggcacgacccctacaggttgtgtgactttgagtaagtttatataacctcttttagtcattcttttcccatccgtatgataagaacactaatgtctcttttgcaagtttgttataatgatcaaatgacattatatacacacacatataaaatatgtgtatatataaaatatatacatatatttttcaagtcattcaaacaatattgaaaactatgtgctaagcactattttaggtattagtgatatatcagttaataaaacagatttaaaagaaaatcttgccttcatgtaaattaccttttaggtaaatatatgaaagtacctgaaacagagtagccatttggtaactgctcttttctttttcctaagtaaaaggaaggcagtacttatccttcagtactgattttagcaggcagtacaatactggttaaaacttcatccggccaggcgcggggactcacgcctgtaatcccagcactttgggaggccgaggcgggcggatcacgagatcaggagatcgcgaccatcctggctaacacggtgaaaccccatctctactaaaaatacaaaaaaaaaattagccaggcatggtggtgggcgcctgtagtcccagctacttcggaggctgagacgcaggagaatggcgtgaacccgggaggcggagcttgcagtgagccgagatctcacgccactgcactccagcctggaagacagagccagactctgtctcaaaacaaacaaacaaacaaaaaaacttcattacacaactcatagaccaggtgttattatcaatcacatagtaccctaataattgtcaatcagaatgatcattaggttggatagctcaagttgtgaaaatgactagttctgaattcattcatttctcttttcttaaatgtgcctctttgccattgtatactatttcttgatctagaaagttatctacctctcttgccaaaacaaaggccaaagtcaagcttcaatcaaaggaaaatgtactgctagagctaaaagaggtttctgtaatcaccgtattcagtgacctcattttataggtgagaagattgaggattagaatgagaaaggactttcctaaggccacacagcgacagaggtagactagactagaaccagcagcttcttcttaccagtcaaggtttctttccactgtttctgggatgtttcacatttgctacctcctctaggaagcctttctatacttgggggaaatgtctcctttctgtacctaaagtaagtttgtgattctatcctttgccttaactttttcctctgccaattcatcttttatgaatttatccacttccaaaggtttcacctctctcctggatataggagactgccagatctctcttcccagctttcccttcttcctgagctccagacttccattccaaggtgtacattaacccttacccaaccaaccccctccagtgtcctaatatctctatttcagtctatggcatctttcccatccttgtcaatcaagctcacaatagtagaatccacttaaattccctcttttattcccagcagtcaccaagtcctttctgagctccctgtgcagtgtttctaatatccatctcatctatttccttttccttcgtcctgctactgccagggactcattacctcttgtctggatgccctccaacccattctctgcacttctgccaaattaatcttcctaaagtacatctctgtatttatttcaatcagcagtaattgtgctttgggtaaatctcatgagttatgaggtctctattgtgcttagcctggctcatgtcatttcctttctcaaaaaagctccaactgcctgcagaaataagtctaaatacttcatcccagcatttaagaccctgtatagatgaatctacgtgacttttttctatccttatctttctgaaacccaaaggggtatatcttaaaagagtttacctcctcacttggacatacccaattttttcacaggtgtcctggacctcattctcctccactttttaaagaaatcttgctcctttaatttccactctccctttttcaggcattttcaacctgttacccttctcttgtcctagttttttcccctaagtctacaaaccagctcaagtctcccattttgaaaacacctttcccagacctatagtcatctttaggtattgtgctcttttttcctttcacaggtaaactattttgaaaagcaatgaactccttttggttcctgtgttacttcacctctgtattagtgtcctagggatgtcacaacaaagtgacacagactgggtaccttaaaatagcagagattacatagttcaggatactggaagtctgaaatccaagtgtcggtagggccatgctctctctgaaggctctaagggagggtccttccttgattcttcctagcttctggtgtttaccagcaaccctaggcattccttggcttgtagacatagcactccaacctctgcctccatcttcacatggccctttcccctgtgtctctgtgtgtctgtgtctatgtggccttcttgtaaggtcaccagtcattggatttaggtcctaccttagtccagtatgatttcataataactaattacatctgcaaaggctctgtctccaaacagggttgcattcaaaggttctgggtaaacatgaattttgcaggggcaccattcaactcagtacaacttctcatcagcacttaacattgttgaacattattgtcttctaaaaattttatcttcctttggctccagaaacactatgcttcccctggtttttctttgctttctcttgtctattccttttttatggttcctcttcctctacttgccccttatgtattaatattctctgaagttctgcacaagtttctctactcttctaacactgtacattctgggtgatttaattcattccatgatttaatttagcaaataagacttctaaatctctcactccatcccatacctcactcccatttataccacttctttctaggtatcttcatttttataccccacacgtatctccaaaactctatatgttaaagtcattaacttctacctccaaaccctgataaaatctgcttctcctcctgtgtgcctctataaaggtaaataattcacagtgaacccagttttttcagctccttattgctatatctaattgagcaagtcttggccattttatatatgctgaaaatttctcaaacttcttctctcttgtttgctcactgcaagtctctcaatttgtttacctacctctagttttaccatgctccctacctcctgaatttattctccacagtgcaaccagagtcatcttttaaaatgcaaatctcatcatgaaatctttactcaccaaaacccttcaaagttccctattgtgttcaggttaaaatccaaactccttaatttggtgaacaggccccttgaaatagaacgcctgtttatctctgccatctccacacaagcctgcactttatgttatggccacattcaactgcttatatttctccaatgtattcgtcagagttctctagagggacagaactaataggatatatatatgcacacacacatatatataaaggggagcttattaagtattaacttacatgatcacaaggtctcacaataggccatctgcaagctgaggagcaaggagagccagtctgagtcccaaagctgaagaaattggagtctgatgttcgagggcaggaagcatccagcatggcagaaagatgtaggctgggaggctaggccagtctctgcttctcacatttttctgcctgctttatatttgctggcagctgattagattgtgcccaccagatgaagggtggttctgccttccccagcccactgactcaaatgttaatttcttttggcaacacccacacagacacacccaggatcaatactttgtatccttcaatccaatcaagttgacactcagtattaaccatcacatccagctacaacatattctctcatatctctgtgccttttcacattctgctccttcttcccaaaatgatgactgctccttcctcttctttgtttagctaactcttattcaacactcaagacttgacctaagctttatcacttctaagaagtgttagggttgatatccccagactgtattaagcttcctcccataaacaacaccctttaatttcctctatctagaatcgtaacagcctgtttacttgtctatttcccccctgtaaattttgggcagtgtccatgtgttgtttttcctcctatcttaagtatagtgatcatagtgcttagcagggttacatgctcgatactcattgaatagctaattgaatggaatgaatgtatgccaggcaagggcagtaagggttattgcagtgaggattagaggctgagacttttaggggtattgggttgtcaggcatccaaatacttgaaagctgagatagtggattcagcaaaggaaagagatagagtcaaagatgagtgcaaggtttcttgccaaattggattgagttaaaagatactagttacaaatgctatttataagaactagcatttattgagtgcctcttagacactgagcatttgactaggtactttatatgctttatatcaaaaagaaacaaaataatgagctagttttagacatgtggaatttgaagcatctgtaagacgtccaaatataaaggacgagtagacagttgtaactatggttcttgggtacacaaagaaaaaaatgactcaataattaaattgaaagttatttgggtcgatagtaattgaagccattgggatggatgggatcttccagaaacagtaatgtagggaggaaaagaagacgatcagggaccagattctgggggacatatgtgagctaaatgcaaagaggggaaccattcattcattcatctaacaaatatttactagagccatggtctgtgtcgggtactattttaggaactgggggtatatcagtgaacaaaatagccttttccctcatggagctgatattctaacaggaatgggagaagtagacaataatcacaaatacgcaaacatgttatatccattactggtaagtgctataaaggaaaataaagcaatgcaaaggcatataaaatgactaaatgtgggtgtggtaggagcagcaggggcaggggagactttagctcattcagggaagaccactatgaagatatttgaaccaagagttaaatgataagaaagaggcagccatataaagatctggggagaagagcattccagccagaagaatatcaagtacaagagctcttaaatggaaaaatacatgatgtattcaagggtcagaaagaaagctttaaaactggagtgtggtaagcaaaggaagcatgaaaggagaggaagccaggcatataatcacacagggccttgtaggctctggtaagaagttcaaatgtgtacaaatgtattctatttgcagaaggaagctgttagagagttctaagcagaacagtggtatgattagttttggattgatagatgatcaccgtggctgctgtatgggaaacagactgtagggggcagagaggaagcaggaaaacttgttaggaggctacttggaataattcaagcaagagatggtaatgagtcggatttggattttagtgatggagatggtaaaaagttgttagatttaggatttgttttggaggacttgctgatggatcaagtgtgaattgggcagggctgtggtagggaatgggtaggcaaggactaaatgcttccttgggttttgacctgaataactgggtggtaccatttactgaggcgagaaagactggaggagaaacaagttttatgggtaacgggaagaagtaggaaagaagtagcttggttttatacacattaactttgtaaatgtaatgacatgtctattggacagctacatgctaatgttaactaagaaattaggtagaagagtctagaattgagaaaataggtcaaggttaaatatttaaattttggagtcaccctctgataaagctttgacaccaggtgagaacattaatgggttaagtatattataaaatggtattaatataaaaattcctgaatttgataatagtactgtaattgtataagataatttctctccttaggaaagacaaactgaagtatttagaggtaaaggggcatgaggtctgaaactctctctgaaatagatgagtaaatacatacatgcatattaatttatatgtctagagagagagggagtgaaaaagcaaatgtgacaaaatgtaatcagttggtgaatctagataaaggctacacaggaattccttgtactgttcttacaactctatcatacattttaaattatttcaaggtaaaaaatatttttaagcctaagttggaccagttgaggaggcagcctctaattttggcaggagctaaaaccatggacattaaaaggaaattaaatcttgataaaataaagttacctttaatttttttaagtgtaggcagcaaagaggagaggtccttgtattgagccctgggatactccgatatttaaagatagggcagatgaagaaaaacccaaagaataatctgaggagaagtggccagtgaggtaggagaaaaaccaaatgagagtggtatcccacaatgcaagtgaagaaactgattcaagaaagagggagtactcagctgtgtcaaatgttgatgagacattgattctgagaattgactattgattttggcaacatgaaagtcattggcaacccagagacaaaagcctgaatggattgtttcataaaagaatggacagtgaagaagtgaaggtagtaagtctttctatgagtttagttgtaaaaggagtatagaaaaataagagtgttagctagagaggcaattgggataaatatatggtgatttttgtcggttaataaaattaatttttaaaagaaaggaataagttccagtgtctgatagcacagtagggtgactatagttatcagtaacttattgtatatttcaaaatagctttaagagaagatttggaatattcttaacatgaagaaatgataaatgtttgggtgatggatattccaattactctgatttgatcattatgtattatttgcatgtatcacaatatcacgtacccccaaagtatgtacaattattatgtatctataaaaatacatgcacacaaaacaatatatatgttaaagggacacattcaataaaagtatattaaacataaggggaaattttaaaatcacaaatattaaatatctgactgctaatggaaataattcagtagcaagggagaaattgatggtatagaaaagaaatggacagcatagacaaatataattgcagcagcaaggtccttgggaagatcagagcagaagtgcggagttgaactttgttaaggataaggataattcacccatattaagaggagataaggcaaggtaggttggtgatgcagcggtggaaagaagaggaagttcttttctcaatgcttatctttttaaatcaactataaggagaagctgtctgctgagaggaaagggagaaagtggtgtaaaggagagaaagaaagggcactcagaaatgtaggaggagacgtgggagagtggtgtcatggaaaccaaggacagggagaggatttcaagaaaaagcagtccaacaatcaatagtgctgaatattcttgcattttagttggatgaatattgaaaaaagactattgagtttgctaattcagaggttactggttgactttggcagaaaaggctttattaaaacattatgagcagaggcccaatttcagtgaagagtgaatgggagatgaggaattgtattttctttagaaaaggagggtggcagggggtaaattggggagagggacctatttatctcctgtattagactgtgaattccttgagagagaacatgtcagattcactagggtatgacactgctagttttcaacaaaagttgagtgtgagagtgaaggaataagttctgcacccagatagattcaacaaaatcttctaagatgttcttctgaattggatctgttctgccagaccctcaaaacatgtggttagaaaaaaatcactgaggaagtacttctgtaccctagagaagtagaagagtggaggtgacaggatgtcattgaaatgcaatttgtggtctctggacacctgccccactgcccaatgtataggaagagacctggaaggtctgacctcagaactgcaagaaattagttggtgttttctgcatagggtaggaaatactgagatggctagaagttatggtggggttgcagttttgtctgctgagtttagcttaagattaggtcagccatggtggagaggggagagaatttgttatgataggcatatagctatatttgaaggatataaatacagcagcaaaagaggaattgcatagaatgagatcagggtagatcagagcttaattagatgaaatcaggacaagggctgtttaggctgactatcagagaaaccatcttgatgctaaaaattactggagcgtgggctaacctttgagaggaaatggtggaaactttgccactgagtcatttataattatttacaattatacaggacaattttgttgaaaaataatgtagcataatacaaggagtggttttgctctgttcccaggatggaatggatgtgacttaataactttttcctacgctaatttggttgattgtgtcagagaaaagataggttggtcattttgtttttccccttttgaatgactcatacttgagttgatcacagccatacaaccaaaagaatacccactgattaggcagataacagaatgtagaatgggaagtcaataggttgacttagaactcagacttacctaaaacttggagaattggtcaggaaccaataagtttccataaagctaggccttgtgtttttcaccattaatctccaggacgtggcttcagagcctggaatacagtatttgatgaataaacaaatagtcaatgaatgaatgcatgaatgtcactttgggaagaacacctaggaccaccagtataagattagcagtggactgataagttggacgtctgccttaatatctctgggtccattttctcacctctttttcactgatttctactgaggatgaaatgagagcatgcagatacttagaatttagcatctttagaagtattagctgtcttttcccctttatttttctagactcaatctcaccagtcaaatcaaactttatgttttaccacattaggaagagagaaaattatgccttttgtctattaaaaatcctagatatcggtgttgagatatcttagattgacattaaccaaaaccactggcaattgtagaacaatttttaaaaacaataaacagctaaggcactaccaggtatgatactccttcactttgccttttatcagctcatcccaaatcttaatttaaattcaaataaaatgaaaatgttctctagaagcatgttttcatccttgggcctcccttagtatccaaaatactcaagtctgccattctcagggattaactataattcatactgtgttggccattgatatgttcccctagccttgactattggagctaactagtgggaaactccaactttacctgttcaacatctttgctttcagatttccttccaccattctttgtccttccacaccagacagaatttatagaaaagggaatagcttcattaaggaagtgatgccactatgtatgtaaaaatcccgtttctctctttctttaagcaggaaatattttctatttttatcctttgcattacttttcttccttccactttgctgcttttcaagctggaattaagagacaccagtttaatttggatacaataactggacttgattaatattccggtacagctcacttcctttaacaacagggcctgacactttttttttctctgaaatgtttttttcaagggcttatatcccttgcacagaacagaatgttttgaacaatatttaaacgcagtttttgatcagagagttaaagtgatcctatcataatagctaaagatgggtacaaagaatttggtgagcaatcaaggaagtgatataaaataattaatggatagaaaagtcattcaagtgaaggctttgtgaaagaatcaagattattcaacccagagaagataaaattttcaagcccttagaaatagccacttgccatggatggtttcaaacacaaaaacaaaacaaaaccaaagcaaaattgccgacttaactcatttcacagccaatttaatgtccataggggagttttgccttgcaaaataaataagctgtgtatttgattcttcatatatttgttttgtaagacaagaagaagtgatttaataactgctttcaaggactagaaaaaaaaaaaactacttttctagaataccaggaattgaatcccataatcttatccacatctttttccctgtcaaccctagggcctcccatcagccactttatttgtcttgaaaaatctacttccccatgctgtccagactggaaaacataattccatgatacacacaatagggtatctaactgtcttctttttccattaagacagcacatgaagaaacagtatcatttgtagcaggaaggattttagctaggtcttctagagaactaaatcactttctgcagtcagtaataaatcaccaaagaaagctatggaattttctttactgacttcagcagatccttacctccccagagatgctatgtggagatagaagagaagggagttggcagcaatggctgagaaatggcagccttttcatctctttgtcttattcaagccagagttctctaaatgttaatgcattgaggggaatctaaactagttttgtgaagaccgaatggcaaatagtcaaaaaggaacattggactttgctctatcaatttttttttgtctctcagacacccagcttctcagtgtgccctttcagtatgtaacataatttactactatagcatcaactatttgaatactgatgcctcacacatttacatctctagtccagaactattttctcaatactaacttcatatttccagttgtctggaggacatttttgccaagaaacacaggtacctcaaactcaatatgttttaatactttccccccatccagaaacaagaatgccctctcctcctttcctgttcctgatcacatttaatggtcctagtcctttaaagtaggaattcaagaagcatcttgatcccctcttctctcagctacccacttcacctttatcaaatcagttaccaaatcctgttggttctacctcagatatgtattcattcaaatctcatttttcaaaacttttattgtaagttcaggggtacaagtgaaggtttgttacataggtaaagagttaataggtaaacttgtgtcatgggggtttgttatacagattatttcatcacctagatattaagcctagtactcattagttatttttgttgatctctccctcctcccaccctccaccttccaaaaggccccagtgtgtgttgttcccctctctaaatgatgacaacgtatggacaaatctcatacatttagcctccttgaacatattaaccgttccctgaatacagtgtcctctcatgtctctgcctttgcagatactgttctctttgcttagaatagtgtcccactcctttacctgctaagtctctgctcattgttaaaggtttctgctatgtattacaaactgttcctcatccctacaggagagctccgtcctctgtgcacttaaccacatctcatcataactgttagtttagatattgcttttctctactaaactatgatttccttgaagacaggggctgcattttaattatctgtaaagtctcagtatccacaacatgatagtctatgttaacaattaatgaaggaatgaatgatgtaactcaaatccaatttatcggtttttcctttgatgaattaatatatacttttggtgtcaagtctaaaaactattttcaatgtcctagatcccaaattttttctcctatttttttctaaaatatttatagttttacatttacattacctctacattaagtctatgatccattctgaggttttgtgtgcatgtttaagtatcagacttaggtcgaggtttgtttttaggcctgttgttgtctcattgttacagcaccatatgttgaaaaggctatctttttttccattgaattgcttttgcaactttgtcaaaaataagtttggcatatttgtgtgggcctatttctgtgttttctattcgattccattgatatatgtgtctgaccctctaccaataccatacagtcttgactgctatagttatcaaagtcttgaaattgggtatattgattcttactttattcttctttttcacaattgctttatcctagttgctctgcctttctggaacaattgtgtctatatcaagaaaatatcttgatgagattttgataggaactgcattaaatatgtataaacatttagagaggattaacatgtttactatattgcgtcttctaatccatgaacacagtgtgtcttcctattcatttggatttttttcttttttcagcattatgtggtttttagcatgcataccctatacatgttctgttagatttacatctaagcatttcatttttttgcagcaactgtaaatggtattgttttttatttgttttcacatgtctattatttgtatacagaaatgtgattgcttttggtatgttgatcttgtatgcttcgtacttgctgaacttgttttgtttgtttgactgattgattttgttagttttagattctttgggattttcaacatatgttatctccaaaaagcgacagttttattttatcctttccaaatctgaatgccatttatttctttggttgcttactttatctgctattaatatagccattctctctttcctttcattcacatctacatagtatattttttgtctttgtactttcaacctgcttatattatttgaagtgaattactgttgacagcatatagttgaatcatgtgtttttatgcactctgccagtctctgtcttttcattgatgtgtttagaccacttacatttcacatacttattaatatgttagggcttaaatcttgttttgttttctctttgttctcttttttactttctttactttcttttttctctgccttacagtaggttacttaaacattaattagaatcccattttgatttatctttagagattttgagtatatctcttcatattgattttttagtggttgctataggtattagatatacatcatgtatcacagtttattgatattgtcattttaccagtttgaagtatagtaactttacctttctttacatctctttatgcttctctttttacaataaaattatcttaaatatttcctttacatacatttagaaccacatcagacaatgttataatttttgctttcaccatcaaacataacttagataattcaagagaaaaaggaaatctattttatttacccatatacatacatacatattttctatgtcatttcttctttcctaatattccaggaatccttcttttgtcatttcctttccatttacagaacttcctttagccgtacttttaaaataggtccaccagtggtgaatgctgttagttttgcctcatctgagaatgtcctgatgactccttcattcctgaaggatattttctcttgacataggattctggattgaaagttcttttctttcagtagttgaaaaaaatattgtgccacttcctctggctccattgatttctgatgagaaatatgatgtcattcaaattatttttcacatatcagtaatgtgtcacttctttctctctgctttcaagatttttttgtttgtctttagctttcagacttttgactaagatgtgtcttggtatgaatttctttgggtttatcctgttgggattttcttaccttcttgaatcttcaggtttatgtcttttgccaaatttggggaagttttaggtattatttgttcaagtatatttttagtcttgctctgcttctctccttctagtacttcagtactatgaatgttagatcttttggcatggtcccaaagatccctgaggctctgtttattttttcagtctattttctttctgttgttcgtattgggtaatttatatttttctatcttcaactgtactgattcttttgtcttctccattctactgttgagattacaggcatacctcattttattgcactttgctttattgcactttgcagataattatggtttttacaaattgaaggtttgtggcaacctgtgtcaagcaagtctattggcaccatttttccaatagcatgttctcacttcatgtctctgtgtcacatgtaattctcacaatatttcaaactttttcattactatcatatttgttatgatggtctgtaatcaatgattttttgatggtactattgtaattgtttggggcaccacaaactgtgcccatataagatggcaaactgaattgatgtcaaactgtcaaattgatggcaaactgaattgataaatgtcgtgtgtaccgacaggccattcctctatcactctccctctcctcagacctccctattccctgagacacaacattgaaattataccaattaataaccctacaatgccctctgagtcttcaagtgaaaggaagtgtcacatagctctccctttaaataaaaagttagaaatgcttaagcttagtgaggaaggcatgtgaaaagccaagatgggctgaaagccaggcctcttgcaccgaacagccaagttgtgaatgcaaaggaaagttcttaaaggaaattaaaagtgctactccagtgaacacatgaattataaaaaaagtgaaacagccttattgctgatatagagaaagtttcagtggtctgcatagaagagcaaaccagccacaacattcccttagccaaaccctaattcagaaaaaggcttgaactttcttcaattccatgaaggctgagaatgctgaggaagctgcagaagaaaagtttgaagctagcagaggttggttcatgaggcttaaggaaagaagctgtctctataacataaaagtgcaaggggaagcaccaagtgctgatgtagaagctgcagcaaattatccagaagatctagctaagatcattgacgaaggtggctacactgaacaacagatttttaatgtagaccaaacagccttatattggaagaagatgccatctaggactttcatagctaaaaacgagaattcagtgcctcaatttaaaacttcatgggataggctgactctcttgttaggggctaatgcagctgatgacttttaagttgaagtcattgatcatttaccattccaaaaatcctagggcccttaagaattatactaaatctactctgtctgtgctctataaatggaaccaaacctggatgacagcacatctgtttacagcagggttactgaatattttaagcccattgttgataattactgctcagaaaattcctttcaaatattactgctcattaacaatgcacctgatcacccaagcaccctgatggatatgtacaaggaggttcatgttattttcatgcctgctaactcatccattctgcagcccatagattggggagtaattttgactttcaagtcttattatttatcaaaaagtgggcgaaagatatcaacagacactcctcaaaagaagacatttatgtggccaaaaaacatatgaagaaaagctcaccatcactggtcattagagaaaggcaaatcaaaaccacaatgagatgccatctcatgctagttcaaatggcaatcattaaaaagtcaggaaacaacagatgctggagaggatgtggagaaataggaatgcttttacactgttggtgggagtgtaaattagttcaaccattgtggaagacagtgtggcaattccttaaggatctagaaccagaaatagcatttgacccagtgatctgattactgggtatatacccaaaggattataaatcattctgctacaaagacacatgtacacgtatgtttattgcagcactgttcacaatagcaaagacttggaaccaacccaaatgcctatcaatgatagactggataaagaaaatgtggcacatatacaccattgaatactatgcagccataaaaatggatgagttcatgtcctttgcagggacatggatgaagctggaaaccatcattctcagaaaactaacacaagaacagaaaacaaaacaccatatgttctcactcacaagtgagagttgaacaatgagaacacatggacacagggaggggaacatcacacacaggggcctgtcagagggtggggggctaggggagggatagcatcaggagaaatacctaatgtagatgacaggttgatggatgcagcaaaccaccatggctcatgtgtacctatgtaacaaacctgcacattctgcacatgtaccccagaacttaaagtataataataataaaaaaagaaaaaaaaagaaatgcattttgtaaggctatagctgccatagacaatcctctgatgaatgtggccaaagtaaattgaaaatcttatggaagggattcaccgttttgatgtcattaaaatattcatgattcaagggaggagatcaaaatatccatattagcaggagtttggaagaacttcattctacccctcataaatgactttgaggggttcaagacttctgtggaagaagtaactgcaaaggtggtaggaatagcaagagtactagaattagaagtggaacctgaagatgtgactgaattgctgccatctcataaaaccttaacagacaaggagttgcttcttatgtgtgagcaaagaaagtggtttcttgagatggaatctactcctggtgaagatactgtgaacaatgttgaaatgacaacaagggatttaggatattcaacaaacttagttgataaaatagtggcagggtttgagaggattgactccaattttgaaagaagtcaggccaggcacggtggctcacgcctgtaatcccagcactttgggaggccaaggcatgtggattgcttgatcccaggagttcaagatcagcctgggaaacatagtgaaaccccaactctacaaaaaaaaaatttagttgggtgtggtggcatgtctgaagtcccagctactcaagagactgaggtgggaggattgcttgagcccagggaggtagagaccgcagtaagctgtgatcacgccactgcactccagcctgggtgacagagcaattctctgaaagagaagagaggagagaggagagggaaatcctactgtcggtaaatgctgtcaaacagcatggcatactacagagaaatctctcagggaaggaagggtcaattgatgcagcaaactttgttgttgtcttattttatgaaattgccacacctactccaatcttcagcaaccatcaccctgagaagccagtagccatcaacatcaaggcaagaccttccaccagcaaaaagattatgactcactgaagacgcagatgatcattaacattttttagcaataaagtattctttcatcaaggtttgtacattgtttttaggcatgatgctattctacacttaatagactacagtgtagtgtaaacataacttttatatgcatggagaaaccaaaacaattcatgttactcactttatttcagtatttgctttattgcagtggtctggaatcaaagcaatatctccaaggtatgcctgtattcattttgtttttttattttgaatattgtatttttaagttctaagatttccagttggttcttctttatatattctacatctttgccaagacttgctaattctttgtaagtctttctgttttttcatttgtttcatgcatgtctgtcattactcattgaagcatttttataatgggtgctttatcatatcattctaacatttctgtgatcttgtggtgtctcatgattatctctctttcattcagtttgagatcttcctggttccagcatgatgaatgattttttcattgaaatctggatatttaggatattatgttttgagactctgaatcatatttaagcttgttttagctggcttcctctgacaccactctggcaagtgatgggggttgctgccatattactgccatgtggaggtagaaagtccaggctctccacttggcctctattgacacctgaggagggaggctgcttgtttctgctaggctttcactgatatctcccttgctgggagtgcctctgacaccacagagaaggggagtggcttgcttactgctgggcagtggtggaggttctaacaccccactaggccgcctctgaacaccacctcagctgggaggaggggctccttgttaccgccaagcggggagcggatgcctatgctccccatgtgttctccattaacatcatgagtaggagacttgttatcacctggcatggatgaaagtcctgtctctgtatttggtctttcctaccaacacctggaggaggagatttgcgacaccttattaatagcctagtcagagtggaagtctaggctccccactcagccttcattggcatgagggtggctggggccacagttttcctgtgctgtttgactggagtagagcagttattatctaaaagttttatgtcttggtgtctacccctctcccagtcctctggatagtgagagcaggctcttattggggcttatatttggtccgtgcccacaagtatttccaggttgttgcttctcagctccaaatctgggctatagaaggtaaaaagaaaagccagagaccttatcactgtgtcattccttggaactcaaggtccctcactggtttgccttcttaatgtaatagaaatcattttcattacattaacacccttctaactagattttttttactcctaagttttgaaatttcttttcatgttctagatactagtcctttgtcagaaatgtgttttgcaaatattttctcctaatgaatggtatcagaggcagtcagctgagagtcatcttatgtttgttttatacataatgtccaagggttctagttatattagtgaaaggaatgggagaaagttcatctccattttcccagaagcagaagtctcaataaataatgtttttgcccccaatcctaagatttataagtattacctccccatatctttaataaattttaaagttaaataaatatatttatttaaaacccaatatctttagtaaaacagctaaatgaagcaaaccttaagtacctaagctgtttgtttcagctgatgaaataaacgtgtgaattttgaagatgttgaatatgcctcaccagtctattacttaacaacttcaagcctcagtcttaaacttgggttctgataagcatgccaactctggatcttagcgcaaatgtcaagatcccttctggggattagtctctgaactgccgactttttggacatcaggccagtttctatcctgagtgagagctccaatctaacaagagtgcattgattgctttccagctaatcaaagggaaagcatgggttggctgttctggcacccttgttcagctaaaaatgattgtctctggctcctaatgcagagatatattcttccttttttctgtgatgaaggtgtagaatatccctcaattttgttaagtataaagttaatgaatgcctttgaatagtctttgagaagttatacatggtagttttttttttcctctgggggaaagagtagaacatcacctgcccttctctcagtcataaaaaaaggcttgatttaaatttacacacattgaaggttacttacctgaggttttccctctttgcacttcagaaagatatttcttaaagtacccatggcccttccaaaagaatggaatattttgaacaaaaattaaaaacttgttttggtgtatgcattttgtatgagattaagaaatgtttctcttgttatattcctgcctccccacctcctctctctctcagtatgtgtacctgtgtatgattcttttctactttctatttcctgggaaaggcctggagttgagtaaaggaaaagtttaaggatgagtaggagaggctgctcatgaagtgatgaagagtatggctggtctataatatgtgattcagaatcactattatgatgaatttcctagaacaagaagaattgctagaggcccctttcacgccacagtaagttatcaccataaaaataatttcttttcccctccccataactcatcagggtaaaagcttgcaatgaccattggtttgtcccagctagactgggaaagtagctctgtgttgcctgtgtgttgtatcccaggatctgagtagcttgcttggcctgagacctcatgccatcatggaatacaatagtgatagcaaaccaaggctcaaatggacatgtcagttgtctaagaccacaaagctagtaagtgtcagagctggaactcaaattcagtctctgtgtttgactccagatcccatctattttccctgtataaacggggctgagttttggagaattccattcattaggagtatcgtaattctacagctcactgtgatagtgccatatcagtccttggcccaacagttggtctgaaaatattaagaccaggaaaagataaacaaaattatccttagggatttcaatccagaatgaagagttcttccatgatgccttcccacctaacttagaggcttggccagaaccatgattactttcagatttaatagacactccgtaaatgttagttctgtccctctatcccagcacatacggtgggtgaaatacagtgctagcagctaacaaatgcatcatgtcatttaattggcacagctctcttatgaggtgtagggataaatacatccccacattacagataaggagactgaggtacgaagaaatgaagtaactgacatgtccactgtctcacagccagatctatctgacttcatatctagtttgctcatatctagtttgctctctgtagcacctcaattggttcctactgatgtacctacctacctctgtctcagcggtattttcagaggctttaaatgaaatattttgactgggttcttcagaaatccttatttgagtttaaaaatcaagttgtgcatgctttctcccttgcctcaccctgtgttatcctcagtagtaaccttgacaccccagtaaagcccagagaaaaagaaattgtaaattgatctgagaggataattgaggatttctaagttacccaggctttaactttgcctcgacctgagatgctcaccagtcttcacagaagaataaactgagttaattagctctttgattggatgagggttaaggttctaggtgtgggtctgcttgcaactaaagtgatgattgttggctcctaacgttaagacattagtagccatctgttgggtgaaggcatcctcttttctgatttgaagctaggtctcagtcagtggaaaaatgtcatttgtattctgcattcctcctgtttccttggggtatgctatgtttaataatgtatgcattaggagatgctgaaaagtgtcttttcagtatgtctttttaatctagtctttttctcccaataggtttaaattgtccccaaagtgtgtgtgtgtgtgtgtgtgtgtgtctgtgtggtgtgtgtggtgtggtgtgttgtgtgttttagaccaagtattgctggagaacacctcattatgtgtaggttattgcatttgtggagcaaaatctcccttaagtaatatatctactatgtgtcattaaaaatgtattcactttatatgtgcatgttttcaattcaggcatctttaatagggaaatatattctagtagattaatttacagttgtttctaaatagtaaatcataaacaccaataaaagaaaacatgcaaaatgtgcatatttgagagtcgattatatgttgattaaccttatgtgcttttgctataattcttactattgtcatttcccttgctgtcaaacaacaattcatttctggaacatatgatgcataattatgaatgttaatgcaacacccagctgcatctcatctccctttgcattatggtacaagtttactttggggacacaaaggtactttctctcattagtgacagaaactgtaattagacactaaacctgagataaaaatatactcattatttacctattttcttaattagaattttcatatcaaaagtacagaaaaataatctttttaattcaagtaagaacaatatgatcctgtttaaaaaataaaaatgaaagaaaaaatctgtgttgtggagaatagagcaatggacttgggggttttgaatgcaggctgtgagtactctgtagaagtagtagaaatactgggcaagtctttaaacatgtcatagtcttctctttatggtttcagagtaataaccttcacccgacagggatctggtaagaattaaataggtacttcaagagaaagtacctgatactgggtacatagtcagtgaatgtgtattgttgttcttaatatggcatttgagagttttttaaaaaggcattttccaaaattaattcaccaatgatctcttcaaatggcaaggtctcatgatacaatttcattgatttaacaaatatttttgagtgctgagcatgtatgttaagcaatgtggtggtgatcatagaaggagtatgctctagccctgtactctagttgagagagataagacatacataggcaaaatgcttgagcagggaagtacgtggttatcaaaatgagtgatgccagcagcaagtgattttgaagattagaggaagaaaacataacactatgcttgcaaacaagagggggagctttgcttaattcctaaatagttcataggaatgcataaaaaagggatggaaagaaacgtagttttgggaaacataaaggaggtccatccaacttaagatttatataggggatcagtgagagataaatgtgaacaatctatagaaggcccagaaaaagcaagctttacttagtaggccatggggaaccactgcaggattgcaagcagatgaataagtatgagattggaatttgtggaaaattggtgtgggttggattggatgtaaggagctcatgctacacaattgcttatgtagtacagggagcagtgacagtaggaatagacaggacaagttaataggtgaagatatttcaaagccagcacttggtgactaattcagtataaaggctgaagaagaggaggagtacacaatgattaccaggtttgagccagtcagacctttaaggatttaaaatgaacaaacaaaacaaaaatagaaagagctaggcttggcatcaatttttgtttggtttttgttgtttttagtttggggtgatagaagatatagaaagccagtgggcagttgtagggagtaggtagaactggtgtggtatttaagtgagaggtcaggactagagattgtcctggagccttagaatgaaatttctaatctaaattaatctaaattctacataaatatttgcaggtggtctcttcatcctaaaaacataatctgcccttaacctttaccctcatccaactaccaatttcttttccttcacagccaaacatcttagacattggctctattttctcacctcccatttcctcactacagtctgccttctactcctaccactactatgccactgtcctctgtatggttccaaggtgaattaatgtcttccagattgaaaaaaaatccaaggagcgtagtttcttctccttttctaatgtgcaatttttcagtaagtttttaagccattattatatggtagaactggtgtcaaatcacatataagctagatgacctttggtaagttacttaatcacagtttccttttctgtaaaatggggataatgatatttactttattacatgagtaaatgagctgatatacataagccctttggaaatagtagttgcttaataaatattattttgtttcatcattgcagctttgggcactgttgagcactttctagaaatttgttttcttttattatcataacacttttttttttttgagatggagtctcacactgtcacctaggctggagtgcaatggtgcgatctccactcactgcaacctctgcctcccaggttcacgtgattctcctgcctcagcctcccaagtagctgggattacaggcacaccccaccacacctggctaatttttttatatttttagcagagacgggctttcactatgttggccagactggtctcgaactcctgacctcatgatccgcccaccttggcctcccaaagtgctgggattacaggtgtgagccaccacgcctgacgcataacacttctttttccttgttttcctactactagttatcttgagctctttttccttaatttgtcttatccacagatataccctagaacagtagttctcagatttgaacatacgttaaatttccctggagagtttatattaaagaacatactgctcctcccctgtctccagagtttctgatctagtaggagctcaagaagttctcagataatgctgatgctgcgggtgtggggactgaattttgagaaccactaacctagagttctatctcagcctcattttcttattctatgaacttttattgaggggcttcaggtaccactgatgactcccagatttctatatctagggaagaacacatgcccagattccagattatcattttcaactgcatgttaaatttctacacacggagttgtcctccagacgcattacaatccaacatgcccaaactgattctgaagtacatatgtaagactagtcaggaaaggtctgaataaaagaggaataaaagacaaagcagctagtcctgttaaaacatattataaaattacagtaattaaaatactttggtactaagcacatgaatagactgatcagtaaaccgtaatgaagtctaaccatgattcaaagacaattgtttagtatataacttttagtatatgatcttatctttaaataagaaaagtctttctaagcaaaacacaaaacctgggtgctggccgggtgcggtggctcatgcctgtattcccagcactttgggaggccgaggcgggcagattacccgagctcaggaattcgagaccagcctaggcaacatggcaaaaccccgtctctacaaaaaatacaaaaattagccaggcgtggtgttggacgcctgtaatcccatgagaatcacttgaatcctggaggcagaggttgcagtgagtggagatcgcaccactgcactccagcctgggcgatagaatgagaccctgtctcaaacaaaaacaaaaacaaaaaacaaccaaccaaacaaaaaaacctggaagccataaaagagaaaattgttaaatctgacaacacgaaagttgaaatttaaagcacccgaaaaatacaaaaataaaatccaaagaaaaaaactggggaaaaggttttgcatctgatatggcaagaggctggttcccttaatatataatatataaagagctcttgagaataacaggaaaatgccaacaaaccattcaaaaaaggaaaaaagaacctgaacaggcagttcagacaaaaagaaagtgggcttataaaaacaaatgaaagatactctgttggcacagtgtctcatgcctgtaattccaacattttgggtagccaaagcaggaggattgcttgtgaccaggagttcaagacaagcctgagaaacatagtgagaccctgtcttgacaaaaagtctaaaaattagccaggtatggtggtgcacgccctgtagtcccagctactcagagaaggctgaggcgagagcatcacttgagccagagtttaagtctgcagtgagccgtgatcacgcccctgcactccagcctgggcaacagtgcaagaccctaactcagagatggagaggggaagagggagagagagagggagagagagggagggagggaggaagggagggagggagggagggagggagagagagggagggagggagggagggagagagagagagagagagaagctcaacacttacaattaaagcagtatagattaatttaagcaataagatgtaactttcacctatcagaatgggaaaaatcagagcgtttaatgtacattttttggggggcaggcatgtggagaaatacatgtgctcttataccttgctactcaaagtgtggtccttggatcagcagcatctgcatcaactgagagctttttagaaattcagctccaccccagatctactaaatcagaatctgcctgttaatcagatccccaggtgacttgtaggtatatgaaacttcgtaaagcactgctctgacacactgttggaagtataaattagcataacctctttggatcttagtatattttatcacaattaaacattgatgtactttttgacctatagttccacttgtaggactttatataaaatatataatcatgtatgtgtgtgaagacatgtaaaaaggtattaatcacaacattatttgtcttagcaaaagcaacttcagtattcattacttgagtaaaggctaaataaactataaaaagttcacttggtgaaatactattcagttatttaaaatttatttaagaaaagtatatgtggatacggaattatctccagtatatatcgttaagcacaaacggcaaggttccaagcagtattataacctgccttttctgtgtcccattattataattcccattttagagataatgtaagtgaggcagagaggttaaataactagcccaaggacatacagctggaaatggtagattcaaatacagacagtcttgttctagagcttatgttcttcacactctgccatattgctgctcagggataaacaacaaactgttaaaagtggtttcccctggagtatggggcactcctttttcattgtatatgcctttgtactatgtgaatggttttccttctacaagtattgctttaaataatttaaaaatacttaaaaactgcaatttttctaaaaccgaactaattctcctccccactcttctgctgatgctagcgacaggctgaatcataaactagagtgaaaaatctaatagacactgtatactccctcttatttatccctcacatctgtctcatcagctaccaagactaactgattttacctcctagaccagacatttctcaaacttgcccctctactctatccctgcattatacatcacttggactatagtgttcatttcctctctgatccacctgcatcttttctccctacaaaatgccaatggacacatctttccaaaatgtgaatctgattttactattctccatgttctggcccagtttgcctgtctggccttactgttcaccacttctcttcctcatatatcctaccctcaggacaccattgttcccctttcatttccatgattttaatatgctattccttctctagaagtacctttcatctgagtgaatttctacccttccttgacaaccagatctcaatttggatttccccctggatgcagactgttagtagacattatatattctgtattatgcatgtcagaatacctcaagtttcatgctccttcagtgttccataagaaatgtccccagcatcaaagcattcctgcctgaatgctgtgcattcacattccttgtagactcctctgctccccaacatggatgcagtatcctgcggactgcttctccagatctccccatggctaattcatggtttttctttgtcctaagttctctcctggccctcagcactcttcttggtcatgaaggatttctgggaggctttcccttttattatcaatttcaggttcatcatcttcccttcctatccctctacctgtacctgtagaggagggaggttagaatagtggttaagaacaaggaaggtctaggctgccaagctaatgaatttggacttttcccataagtactaggaagccagtgaagaattttaagcatgagagtggcaggaccagatttgcactctgaaaagatgtattcattggcattttgcagggagaaaagaggcaggtcaaccagttacaaaatgaatgctatagttaaagtgattcagggatagagtggaggggcagatttgagaattatatagtctaggaggtagaatcaataagtcttggtgcctgattagacagatttgaggggtaaataagaggagggagtccagagtatctaccagatttctcaccttagtaaatgtcacctgtcaccagcaccagcagaagagtgggaaggtgtcttagttcgtttatgctaccacaacaaaataccttagagtgggtaatttataaggaacagaaatttgtttctcacagttctagaggctgggaaatcaagaccaaggcaccagcagattcagtatccagtgagggctattctttgcttcaaaggtggtgccttgttgctgtgtcctcacatagaaggaaagcaaaggggaaaaatgctgtgtcctcacatagcagaagaagtagaagggcaaaagaggcaaactcttcctcaaacccttttataagggcactaataccatccctgagggcagagccctcaatgcctaatcccctcccaaggggccttatctcttaataccatcaccttgggagataagtcccaatatgaattctgaagggacatacatatttaaaccatagcaaaaaagaattagtttggttttgtaaaagttgatttttaagtgtttcttttttttttcccaaagcaatacttgcagaaggaaaaccattcaaatagtacaaaggcatatacaatgaaaaatgagtcctctacacttcaggggaacattgttaacataccataatgctatattattttccttctgaggaacatagattcacctacccccaccttcgcaacccattccccactgaatttccttatttccttactgcaaagatagttcaacatacacaaatcaataaatgtgatataccacattagcagaaggataaaagtcttatgatcatctcaatagatacaaaaaaagaatttcacaaagtgcaacatgctttcatgataaaaaaaaaaaactgtccaaaaattaggtgtagaaggaatgtgcctcaacacaataaggctatatatgagaagcccacagctaacattatattccatggtggaaagctgaaagcttttcctttaaaatagggaacaagacaagggcacccattttccccacttctactaaacatagtactgaaagtcctaccagagcaattaggcaagaaaaagaaataaaagccatatcaattgaaaaggaagaagttaaattgtctttatttgtaggtgacatgatcttatacagaaaaccctagaagtccaccaaaaggctcttagaaataataaaagaattcagtaaagttgcaggatacaaagttaccctgtaaaaatcaataatgtttctatacactaacaacaaacttagaaattttaaaaatgatcccatttacaatagcatcaaaataaatctaaaatacttaggaataaatttaatcaatgaggtaaaaatctgtatactaaaaactataaaatattgatgaaataaattaaagaggacacaataaataagacaaataaataaaaaataaagatattccatgttcatgggttagaagaattactatcattaaaatgtccatactgctgaaaacaatctacagattgaatgcaatctctatcaaaattccaactacattttttcacaggaataaaaaattctaaaatttgtaaggaaccacaaaagaccccaaatagctaatgaaatattgaggaaaaaaaaaaagctggaggcatcatactacctgatcccaaatatactacaaaactatagtaatcaaaacagtatggtactggcataaaaacggaaataccattcaatggaacagaagagagagcccaaaaataaatccacacatttacagtcaactggtcttcaacaaaggtgtcaagaacacataatggggaaagcacagtctcttcagtaaatggtgtcatgaaaactggatattcacatgcggaatgaaattggactcttatcctacatcatatataaaaaccaattcaaaattgattaaagacttaaacataagaccttaaactctaaaactactacaaggaaacatatggaaaagctttttgacatttggctttggcaaagattttttggctatggccctaaaagcacaggcaacaaaagcaaaaataggttggattgcatcaaattaaaaagcttctgtacagccaaggaaacaatccacagagtaaagagacaacctgcaggattggagaaaatatttgcaaatcatatttgataaggagttaatatccaaaacatataaggaaatcaaacaagtcaatagtaagaaaacaaataacttgattacaaaatgggccaaagatctgaagagacatttctcaaaagaagatatataaatggtcaacaggtatatttaaaaaaatgtttgacgtcactaatcatcagtgaaatgcaaatcaaaaccacagtgacatatcacctcacatatgttagaatgtctataatcaaaaagacaagtgttggtgagggtgtgaagaaaaaggaacccttatacactattggtagaaatgtaaattagtatagccattatggaaaacagtaggggggcttctcaaaaaactaaaaatagaactataatataagccagcagtcctacttctgggtatatatctaaagcaaatgaaatcagtatgttaaagagatgtttgcactcccatgtttattacagtactattcacaatagccaagatatggaataaatctaagtgtccaacaacacttgaatgaatgtgttataaatgaatgaataaagaatgaatttattctttatgatgaataaagatgatgaataaagaaaatatgttatataatatatatttcatatataaaaatatatgttatatataatatatatttcatatataaaaaatatatgaaatatatatatacacacacacatatacaatgaaatactatacagccataaaaaagaaggaaatcctgtcatttgtacaacatggatgatactgaaggacattatgctaaggaaataaaccaggcacagaaggacaaataccacatgatctcatatgtgaaatgtaaaaaagctgaactcttacagagcaatcccattacttggtatatacacaaaagaaaataaatgtttctaccaaaaagacacctgcacttgtttgttcattgcagcactattcacaatagcaaagacatggaatcaacctaggtgcccatcaatggtgaattggataaataaaatgtggtatatatacactatggaatactatgcagccataaaaaagaatgaaatcacgtcctttgcagcaacatacacagagctggaggtcattgtcctaagcaaattaatgtaggaacagaaagccaaataccacatgtttagctcccacttataagtaagaacaatgggtactcatggacctaaagatggcaacaatggacactgggacctactagataggggagggaaggacagagggggacaaggactggaaaactattgggtactgtggttagtacccaggtgttgggatcattcataccccaaacttcagaatcacacaatatacccatgtaacaaacctgcacatgcaccccctgaatctcacatagaggttgaaattatattaaaaataataattataatagtaaaacatcaaactcatagaagcagagggtagaatggtggtcaccaggaatggggcgggtggggcaggaaatgagctgttgatcaaaggctataaagcttcagttgaacaagaggagtacgttctggaaatctaatatacagaatagtaactgtagttaataataatgtattgtatacttaaattgctaagagagtagatcttagatgttctcaccacaaaaaatgataagtatttgaggttatggatatgtaaattagctttatttaatcatttcacaatgtttacatgtatgaaaaaatatattgtatattataaatgtgtacaattttatttgtcaactaaaccttaataaagctatgcaaaatgaaatgaacagcttgatgaacttgaggtttgtgaatgtaaatacctcagaaagagaaatttcccaagggcttatgtgaacattgtggaaccagacaaaagccttaatgaaaagaagccttaccagggaagtacatatatggcaactgctcaccagcacttatctccccctgacaagggcagctgtgattcaagaattgccctcttggtcctgggagcttcctcaccctaaagaagaacattcctgtccctggaacctaaatactttttaagcagctgccctctattatacacatagcactgatagctaaaggtaggcttccagcctaccttggaaagcagcaccccacaagagccaaaatagcagcagcccgtatttagaagtcacttgaaaatctgttttaaaatgtatgctacagtaatggttctcaaacttatgagcgtgcattagaatcatctagaggatccaccacgatcaagtcggcttcatccctgggatgcaaggctgactcagcaaatgcaaatcaataaatgtaatccatcacataaacataaccaatgacaaaaaccacataattatctccatagatgcagaaaaggccttcgataaagctcaacacccttcatgctaaaaactctcaataagctaggtattgatgaaacatctcaaaatagtaagagctatatatgacaaacccacagccagtatcatactgaatggacagaagctggagacattccctttgaaaacccacacaagacaaggatggcctctctcaccactcctattcaacatagtattggaagttctggccagggcagtcaggcaagagaaggaaataaagggtattcaaatagaaagagaggaagtcaaattgtctctgtttgctgatgacatgattgtatatttagaaaacccaatcatctcagcccaaaatctccttaagctgataagcaacttcagcaaagtctcaggatacaaaatcaatgtgcaaaattcacaagcattcctatataccaataatagacaaacagagagccaaatcatgagtgaactcccattcacaattgctacaaagagaataaaatacctaggaatacaacttacaagggatgcgaaggacctcaaggagaactacaaaccactgctcaaggaaataagagaggacacaaacaaatggaaaaacattccatgctcatggataggaagaatcaatatcgtgaaaatggtcatactgcccaaagtaatttatagattcagtgctctccccatcaagttaccattgactttcttcacagaattagaaaaacgtactttaaatttcatatggaaccaaaaaaagagcctggatagccaagacaatcctaagcaaaaagaacaaagctggaggcatcatgctacctgacttcaaactatactacaaggctacagtagccaaaacaacatggtactggtaccaaaacagatatatagaccaatggaatagaacagaggcctcagaaataatgccacacctctacaacaatctgatctttgacaaacctgacaaaaacaagcaatggggaaaggattccctatttaataaatggtattgggaaaactggctagccatatgcagaaaactgaaactggaccccttccttacaccttatacaaaaattacgatggattaaagacttaaatgttagacctaaaaccataaaaaccctagaagaaaacctaggcaataccattcaggacatagccatgggcaaagacttcatgtctaaaacaccaaaagcaatggcaacagaagccaaaattgacaaacaggatctaattaaactaaagagcttctgcacagcaaaagaaactatcatcagagtgaacaggcaacctacagaatggaagaaaatttttgcaatctatccatctgacaaagggctaatatccagaatctacaaggaacttaaacaaatttacaagaaaaaaaacccatcaaaaaataggtgaaggatatgaacagacacttctcaaaagaagacatttatgtggccaaacatgaaaaaaagcttatcgtcattggccattagagaaatgcaaatcaaaaccacaatgagataccatctcactccagttagaatggcaatcattaaaaagtcaggaaacaacagatgctagagaggatttggagaaataggaatgcttttacgctgttggtgggaatgtaaattagttgaaccattgtggaagatagtgtggcgattcctcaaggatctggaaccagaaataccgtttgatctagcaatcccattactggatatatacccaaaggattataagtcactctactgtaaagacacatgtacacgtatgtttattgtagcactactgacaatagcaaagacttggaaccaacccaaatgcccatcaatgataaactggataaagaaaatatggcacatatacaccatggaatactatgcagccataaaaatggatgagttcatgtcctttgcagggacatggatgaagctggaaaccatcattctaggtaaactaacacaggaacagaaaaccaaacaccacatgttctcactcataagtgaaagttgaacaatgagaacacatggacactgggaggggaatgtcacacactggggcatgtcgggggttaaggggctaggggagggatagcattaggagaaatacctaatgtagatgatgggttgatgggtgcatcaaaccaccatgacacgtgtataccaatgtaacaaacctgcacgttctgcacatgtattccagaaagtaaagtataaaaacaaaaccaaaattcatattgctgggccccacccccagagtttctgatccaaaaggtcgaggatgggtccccagaattttctttcctacaagttctcaggtgatgctgatgctggtctatagaacaactttgaaaaacactatttgggggttgggggacatagaaatttggatgcaaaaaacttgtgttcaagccttatgtgatttatttcacctccctaagcctgagtttcttcttttctgaggtggacttagtaaggttatgagaatgaaatggaatggtgtatatgaaagttctttatgaactgtaaatgttgcataaaaatattagcagttagatggctttacaaatggtacttgctgccacacctccaccaccaccactaaattttcttgtacttttgttccctctctagccaactttgtcccaccaagtctatcaggcagctggaaaagaactaaacccaggaaggccctgagtagtgtttttttgttggtttgtttgtttgtttcaacacactgggcatggccttgatactgaccttgacttgacttctcttttcctttgcctggcctcctctcaaacttgctcctggttcttccagccctggtctactctcacagcaaagaatagctcccagtgctaatattaagggtaaaaaactgtcagatggaatttttaaaaaatagtaagacaaaagaatccactgccaagcagcaaaattatgtggaaaaaaagcattttgctaggttggtgggctctaggctgatttccctgagggaaaaatctagatctttgaaatagttaagtgaaatcaccagtataattgcagattcctaatttaagaatatgtcagacagttatatcagacagttgcctgggtaaatgatatgtccatgtagaatggtgacatttttctttagaaacctctttttatggctggttgcggtggctcacgcctataatcccagcactttgggagatcgaggtgggcggatcacgaggtcaggagatggagaccatcctagccaacatggtgaaaccccatctctactaaaatacaaaaaaaaaaaaaaattagccaggcgtggtggcacgtgcctgcagtcccggctactcgggaggctgaggcagggccatctcttgaacctgggaggcggaggttgcagtgagccaagatcacaccactgcactccagtctggcaacagagcaagactccatctcaaaaaaagaaacctctttttatttaaaaggtaatacatgtgtggtgtataaaatctagaaatgatttaaaagtatgaaaaataaaaataacccttaattccaccacacaaagataaatacccactgatacaatattagtacatttacatccagcctttcaatatttgcatatctgtataagaatatgtatatatgcatatatagttcttgaattgaacttgtaatatgttcaggtttatatacaatttttaaatttaccattacattgtgagcctttttcaggatcattaagtagtcttcaaaaacatggtttgtaatgacaaactattattcctccatgtaaatgcacaatatgttctaactcttcctaaatgttggacagctaggatattccaaattttaccattatgaataaccctgcagtggaagacacttcaagtacataaataaatgtgtacatctttaatggctttcttaggataaaatcctaggagtggaaaaactggatcaaaggatatgaaatttcttaaatataattcacataccataaaattcactatttcaagtgtgtaattcagtgggttttagtacattcacaaggttgtgaaaccattaccactaattgcagtaaaaatacagagcatttcacaaatttgtgcattatccttgtgcaggaaccatgctaatctctgtatcattgcaattttagttatgtcagccaaagcaagcacagtagaaacattttaagtcttctgataacatatgccaaaattcccttaagcaagtgtgtacccatttccattcccacccaccaatgtatatctatttccccacaactttgtcagcacttacctttagaaagtattgccaatatgactgaaaatggcatttcattgttttgtctctattaccagctcttcttcctcttctcactgaactatagctctgcagagatctatcatcccccgtctcctttgcatacattcaccgtgggcagtcacatccacggcaacagcctcggctgcctcctctggatagtgaccacatgtccataccgtgccccaacctctttctagcactgcagtccacacatcaagctgctcgctgggcacacctacctacagaatttgctagcataacaaactaatatctgaaatcaaactcatgtttcctaaagctggttcttgcctatgactttgctatttagattactgatatcagccttctaggtgcttcacagtcatctgttctctctgcttatgtaattagcagtccaacgctgttgattctctgtcacattcttcctttctgctccatccccactgccattgctctgattttaccttttattgtgtctattccattagcttactcacttctctatgcttccagtatctatccacataatttatcctacacatggctaccataataactttcctataataccgctcgtaccatattgctctcctactctggaacttccaagggctctctcttgcttattggattatgtgaagtaaaggctttaacttgactcttaaggcccaccatgctcttgaatcattctaatttcacttcctctgtgccttataaaaactgtgttttcttccttcatggtattcctgtgcttctcacttctgttcatgcaaatctggcatggcctctctcccagtcatcttcagtggtgattgtattgactcttccaaaatcagctcagaggctctgtgatgccattcttgattcaggcagcagtgctctctccttcttttgactctcattttgttagcatttcctttctgatacttctgacattccatcctttttaatggttttctaggtatttttcatccaccctctaccacacttaattccttgagcacagggattacttcttcttcattttggcatgttgcctagtacctctccaaacaccttaaatgtagatagaggagctctgtaaatgcttggacaaaacaatagtgaagactgccaattttctttttagagcccctaatgactcagtttcaggaatgaatactgtgctaagaaggtacagatgccaggtgactcaagtatcatagctcattcttttttcctcattctccatattcagtccatcaacaaatactgtcagccctacctcttcaaaatacctctaatcaaatctcttgttcttgtcccaactgctactttcctagaacaaaccaccattatctcttacctataatagcccctttaaatggttctctggcttctactgttgacccccacacacacaaatccatcagccaagtcaaacctttataaaacttacatcatgttagtcccctgcttaacaacctctaacagcttcccatttcactgagaataaaattcaaactgtttcagcctttggaaactccatgatctggcctatgcacctccccagtatcatctcccactgcagtccaccttgctcactgtgctccagctctgctgggtcttggctcctcctgattgtcaagttgtatcaaagcagagtgactgggtgttcttgtttctattggggtcctaactgttgttggttattgtcctagggctccatgtctttagtagtagagatgacctggggagtggccagaagtagttctgaggattttgagacttgactctggggaaaacctttatggattccatcagacctctgaaaagtggtaggtcgaacagtgagtttgaactgaaagggataatgggctttaaggaggaagaaaagaaaactggtattattcctacagcctctttcccaagggacgctataaatgttactgatagaaaccagagctggaggacaaacatcctccaccttctttatcgctttgggtgttggtttaggaaactgggcatcatggcaaaacctttaaggctatctgttgagtcagatggtgcactgtgaacttgatgccattttccctatgtgctcctctgaagtctcccttagccctctggtgttgcacccttaacttctgtacatagaagggagagggaaaaaaactctttcattattcagattctggacttgctccccttgctcctagaagcttcgaaatattcactatccacctctttgcctttaggatcattgataagatcagccagctttttccctcttctgtcagttaaacaagtctatgactggtatgttttatcacactatatatagaaaaactagaaatttctctctagcccattctgaaagagaatcccgagtactgcatttctaaagtactaagcattttcctacccgctgctatgtgcagagctttcccgagtcatctgtatggttacttcctgccaaccttctttggaaaaagaggtgtccccctgtgtcttaaagatttcaatgtgaaaatggagaaatggaagcagagggtcaaatgtaatgccctagccagatgaagttatcactccctatgcagaaagacaaagagcacccctgacacacaccacagcatttgtggggagtctttatttccactcgaacattcccttcttttcttattccctaccctgggtttctttgtagccagggatggattctgaggtggagggtggagagggggacccagcagatttacatggaagaacttgaactggctattcagaggaggtggggagaggaggggaggcagggaggcagagctgggtaccaaaagccccttctccagagagtattcatctctcagatgacccagattatagctttcccagactgatgagaaagccattgtcctgaaagttctctttcaaattacacacacacacacacacacacacacacacacacacacacacacacacactcttccccccttggttgggtctataataaggaagggtttcctgattaccaggctgcaaggaccccagccaacagtgggtgggggtgggccttcagagctctgtgtccctccatggtgaccaggcagcttttcccctcttctgtcaaataaacaagccatgcattgttctgtcctccggcttgtctgtgggcttcccttcctgctgagcctgccagaatgagcttgggcttcttcgtgtggggcaggtggaatgtgctgtttggagggaggctggaagagccacagaaaataaacagagctaatcaaggacgttattttgtgcttctatttatataaatactttaaaaagaggaaagtacccacactctgttatggtccaggcctcaggttgagcacaaccacaagcaacaggggttacattttcctttttcccctaagttagagcagagtcatggttctctttctgctcatcttctcccaagtatctcttcaggggtctgctgggagccaggctcaaagacagatggtgctatcggaagatactggggtgacagctgactagcgcagctggagactgactcctttcagaattggtccacctccacccctcacctctcacaagagcctttataaggcctctcctgggagccagcttctggcttttctgctgcatgtgcccaccctcctgtgcccccatgccaagttcacgtctcctgagtacttggaaaagaagcagtcatctttaccgtcccctgagcacaggaggtcatacttgatcatgttatctggaactcagctccgctaaatgggagcatatgcccttttccctccaccacctctcccaacctcttccccaaatcccaaactggctaaaccgctcaagtttctctctcatcttccctcaacgaaggatttcttgagtatacactatttgtgcccacctgcctactcctcatctgatgacatcccaactctcatcttcgcaccctttctccctacctcagccagctccatgaacatgcttgcacctctagtcacaatttcttcagcctcacctggccactggcagggtcacactgataacaaaccagttgctctttattttgttaggaagtggggattggcaaacttcttcaggcaagcgtttgcatgggctgggccactgagcaaaaggagaaagacatttggcgaccagaagagcaagggcggccggacacccaggcctgaggaatgaaatgaaaagagattttaacctgatgcattttttggaccagattatgtcctggtatattgccactcagaatgtggttatcacaccaggagcatcagtatcactctggagcttattaaaagtcagaacctgggcctcgctgaatcaaaatctgcattttaacaagatccccaggtaattagtatgcccactacaatttgagagtgctgttccagagtgtactgggtttggcatttgagccttctcttaactagtcctttctcttttatcttcatttggattgaagaaatcagttttcttattgctaatggtacctcgctcattattattttgcatacgggtaatattaaaaacagatagcatttattgagtgccttttacatgccaggcatgttttatagatgaggaaaccaaggttctgtgacatgcccaaggccaaacaactagtgaatggtagagctgagactgtaagccagatccatatgctcctcaaagctcccaaactttcccctatacagttgataaaagtcaacccagactctcctgtgagatacagagggaagaaaggggaaggggcctccaggcatgatttccccagagaggaaaggccctagcatacatacttcatgtcctaagggagtttgcataagccctctcaggagccagaaattactggaattgaggccagaggccaagggaaactggagtagggaattgggagtgttaatgaaaggaaaaccctgactctaattccccaagataaattaaatcctggtgcctgagcctgggcttagggggtgcaacaaatccacatagggctgctctggattctggctactgcgctaatcacttagggcatcatttggaacctcagcctggggcctaggactactacatcatagcatgctagagtgggaagggtcatttgtgacgattgaattcaatgttttattttacagggaggaaacagaagcccagagagtgggagtaagttgccagaggtcagagtgaattcatggcaaatccagggacactgaccccaaacaccacatttccagcattgctaatgggcaccttttctggagttgaagtctctggtgtaaaattgggttttctttggatctgctcaagtccgcacaggaagtgcagacccctgtaaatacatccgaaaatgtttgtgagccttcgtatctcaccaggaccttcaccttggaaaatctctcagtcacttgcccccagctatataaaatcagctggagtgctactcctctggacctggaggctgctagtcctggcttatctgtacttttctggggcccagaggacctgcagagatggctgggtggggtcaactcagtccaggaagcacaggaattcttttaagtgtatgtgtctggggtatttttctctctcacttacgtgtatttttaaaaattctttttagacacccgctttatctttcccaaacatcatttccttgctcctttcctgagttctagcagtggctgggggcccagcttccttattggcctctgagctgccgagggggtgggccagggctcagaggaggttggagtagggagcaggggggctgtttatgctgctggaagtgcctttcatccttccctttgccaccagggtgctggctggttcctggagcagcgtcttcactcctatccagctcttgacactggctttcgttccctaaggctgtggccatatctaggtccatccaggctgatggtcataccttgccttcagtgctactccttcctgttcttagaactggaacctgactgtgcctgagccccttggatcacactcagcatcttgggctgatggtccctcgccccagaaggtcttaactggagggcagatgggtcccagctaagggaggacgctggctggagggtttgtcaacgagagtctgagctagccggataccccgctctctcccaagccatctctccaccctgggcaacttccatggtaggtacagccagtagccatggctgctgccactcttccccctcttgctttctttcttcaatatctctttctttttgcttcctaagaaaagcattttggagtaatgaaggatgggatgaggtgtgtgcttattgatagtgcctgagccagccttaggagaaaggcaagcactggggtcactgccttcacatcttggcctagagctgcatggttggtcgtaggcattttcttacttttctgtttgtttctcctcctctctctccccactgcctatggagggaatggtttcagctctaggactaatgagacctccctttgctgactgcttcttgagggaattgctatgggaaacctcaggaatacaggctttttcagatagactcttccttggagaggaggggtcgtgtggtatcctaggaaaaaactggaggatctgagtttcattcccaattctgctggttattagctatgtgctcttggcgaatcacttaagctttatgcatctctggttctccatttgtaaagtggggataataacttaccagctggacatggtggctcatgcctgtaatcccagcactttgggaggctcaggcaggaagattgcttgaggccaggagttcaagaccagcctggccaacatggtgaaaccccatctctacaaaaaatacaaaaaaattagccgggcacggtagcatgcacctgtagcctgtagtcctagctactcaggaggctgagacagaaggatagcttatgcccaggagtctgaggttgcagttagctatgagtgtaccattgcactccaacctgggcaacagagccagagaggccctgtcttaataataataacaataataaaactgtttcacataaggttagagagatgattaaatcagttaatgcatgtgaaatgcttagtgcctggcacatcttcagtgttcaataagtggtcctgctgtgtgttttctttaagtttatacagtatgtcaggcactatgctggttgatttcacacatgggactgcatttaatccaaaacataactcatgaaaaacagatggtcatcttccccattttgcagataaaaaatctgcaactcgcagaagtgacttgcccatggccacacaactacagtttgaatgcaagtgtagactgacttcaagtctagggctattccgagctaataataggccaaatagtagaccatatagatagtttattctcctgtcccaaactagggttagaaggctctagctctggctccagctccctctgtttggatttttcttcttccagtctttagttttctctgtgtcctaaaagcccccacttccctcttctgtctactttgggattggttcctactcctggagaaaccctagaaagagtaaggggccagccaggcgcagtggctcacgcttgtaatcccagcactttgggaggccgaagcgggtggatcacctgaggtcaggagttcaagatgaacctggccaacctggtgaaaccccatctctactaaaaatacaaaattagctgggcatggtggcacatgcctgtaatcctagctactcaggaggctgaggcaggagaattgcttgaaccagggaggcggaggttgcagtcagccaagattgtgccattgcactccaggcttggcgacaagaatgagacttcgtctcaaaaaaaaaaaaaaaatagtaagagtctttgtaaggtatgtttcacagtgtggcaaggtagtggtacagtagaacctcaacagtggatggtaccctaggtgtgggtactcttgagccatcaaaaggtacaagtctgagctaataaccattattatagtacctgctacttactgaccacttgctgtgcatcaggctgtgtcccagatgctttgagaatactatctctaatccccacagtcacctagccagataggaattattgtttcctttctcagataagaaaactaaatttcagatgggttaagcaacttacagatacacacatctaaagtggcagaggggatctgaacctacatctgtctcactcatttttcacccattgcctactggcttggtatagttggtgagatgagactgacacacatgaaatgatgatgggcaatatcaaatatcatattattatggacccaattgtgagggctagattaccctgaacaagcttcctggaggagatggtacttgagcagtaccttgaagaacaggtaggatttaggttaacaaaaggagagggggcattccaggcagagggaacagtcatagtcataactatgattggtcgaggccttgccaggcctgattcaaagcacttgcattgtctcatttgatctttcaacaatcccatttggtactattatccacattttactgccatgaaaactagggctctgagaagtgaagtcacctgtctaaagcaacagagctaatgagtggtagagctgggattcaaacaaaggtggtctgaccccagagcctgtgttagatcaacaggaatatcaacagcaaaggcacagaatcaggaagggacagagctggttgcaggctgtgattggagcagagaaatgagagattgagctgatgggtaaggatagcttattgaagactttgaaactgatctagtttacgtttgatgtgggacagagtaagaaatagggagccagtgaagattcttgaataggagagtaccccaattcagttggcgtttaacatgatatgacctaaaagcagtgactggaggtagaacaaggcagacaggccggcagacttctgcagtatttggggcataaagtttcaagggcctggactagaacaggagctgctggtggtgggttctgggagaagagctgtggttctgtctaatggccacagtgaaaatggagggggggtagggggagagagagagagagcaaaccagggccagagaaacatcataaaaaaaagactcagtagaactccgtgtgggattggatggttagggagaaggtggcaccaaggctgactgcccgcactttaaacccagaactcaagaaccctaaatatggaaaaaggcttgaaataggaaggataccctgttcaccactatatcctcagtgtctaaaagcataggtcatagtagatacccatggtacatagtactactactggtagatgcttgacaaatagttgttgaccggataactacctggtagcagcagctggagagatttcccggcagtgtggctttgtgtgtaggactccagagcaagcatagcccccaaggtctccttgtgccttcagcccccactctgggcactctgaaatcaataatagaacaatgtgattacaaagctaggggcttcacctggctttcctccgcttaaatcttagccactgttgctgacctgtggctatacttcctggcctttgacaaacagcttcccctgcccttcctcctatacctcctggtctgtgtctggcctattaccactcaatccttgttttccccagcaaggctattcttctgaagactatctttttaggccttagccctctagagccttgtactactgagatcttctatgcttctgctggggtgaggggcatttccagctaggatggaatcctccagcttgagtgtgaccatgaatgctcctgggaggtagagagctgctttatctcacgatatagccagcttgttgaaggcaggggcccttatcctattcaaccctgtgctaccagtgcctagtctggaccctggcacagtaaatatgaataaattgatgaaaataatttttctgtttacttctgtatcatctacttatttatcatgtttcttttactctgccattcacctctttctctgtcatccatttctctctactatatatttctctacaatctttctcagagttttctctttttctgtcatttattttcccctctatcatctctccttcttatctctatcatttgtctggcgcttccagcatctctctctctccattctctctctactctccctccttctgtcattctccctcccatcaatcacctttttatctcctggcattatccatgccccacatgtactcttcaccacactactcttccccactcgcaagggtggcaactgctcatgcgaagtatgccaggggacagcgatgggtcctgtatgtggcagtcagtgcaaaagttgtggctgtattcagagtcatggcctcaggcctatttccctttatatacccctgacctgctgagcagccaatctcctctgtcagcctaacatggtgcattcaccactttgttctatcttccctcacaggagttggggcttcctgccaccagtttgcctaccaactcaggtgtctcacctctgtacccatcttatctttcactctgtcaatacctatcccatgctttgtttgaaccagctctgtctctcccattagtctgtaagctctcaagagcaaagactgtattggattcatctctgtaatcccagagttacacgtagaggacacacagtaaacatacaacaaatgcttattcaatgaatggctaaaaattggagaattgacagcccagtgttgacctgttcaaacttttcaatcacttgcccattcctttctcagagaaaaatgggaagattgaccagattgattttctttctcaaagagaagtgaggatgtgctcactgttcattaggcagcagcactcatttattccacaaatatttattgaacatctactatgtgtccagcactgtgatacgtgctcaggatactcttgtgaacaaagcagccctatgaagctgacattccatatctccagaatgaaggagacttgagaactaggagctcaggagggccactaagattcccacaccagttccttgcaagatgttctactttactgaaggaaaagagggggtggggcggaagctgcctgggaagtgatttcagctctggttccttcagcccacttcctgtccctttcttgctgtaggaggaacgcccctgtcagtaggccgcactcatggcatgtggccaagctgctggagggatgccctgaagcagccaccaccatgcatttcccttctgaagccttcagcttgtcctggcattctggctgcaacacaaggtgagtctagagccctcccctcaagacaggctggagggtagacaccttggacactcctcctcctctgctctagtccctgttggatgttagagcctcaagtactataatggaaaagcaagtgggagtccagagtacctgagttcaagtgctagtctcttgctaattctctgtgattttgggctagtccctttccttctggatgatgtttccttgaaatacctcattgggcttacaagacaccacactgtcctgcttttcattctatttcactagctgttctttctccgtatctcttttcctaattccttttgttctcctgtctcttaatgtaggaggaccccagggctcagttctggcctgcttctctgtcaatggcgactcactggtgcccttatctggtctttattacctctgtcacatagccaaagccttcaaaatagggaccttcctgaataaccattgttgaaacagttgcccaagaggcagacaacgttttcttcaggctgagagccagcaaaggtgctgcccttcactgccttttcccttccacaagagcttccctccaagaagggatttctgttgcaggttcagagaaactaagggttgcgtttaccccaattcggtgactttatttggaaaccaagggctcagggcacaggcagttttgttctggaagaatatgcagaaacacactttgacattcttgagcttggctcctgtttgagtgaggatttgtttttgtttttgttcttttcagcaggaatagtggtggagtgggtagcaggttcccttgccaataagaaattgatggattccttgcccagagaacaagtgagctgactgactaaggggcaaggcagggagcaagaatgagcagaaaatgacctgagggtctcatgggctgctgccacagttcaactctggctttctagactatggcctttctgagagcagcctgcaacctctcgggttctagtcaaagggagttactggcatgacttggttcagtttggctttgtgtttgggaaatggtacttaaaattgaagattgcatctgatcctagcccttcccttggtcttccaggtttggctttgctgtgggagttgggggaggcgtgggtgggcagaggcccctatattatcaatactagtattagagaggatcctgatggcaaaaactaataatcaagagagtagcagctgccatgtattgaacccttgctaggtacctgggctgtggtaaggactttacatttactatctgctttatctacacatcaaccctctgatatagctattactattattcctatttaaaagaccatatggcagtagcgctaagacactggactcaggcctgattcagattccagctgtgcttcttcagcagcttagtgagtttgtcagtttactttacctctctaagcttaagattcttccattgtgaagtgtagataataatctgtcccataaagatgggaacaatagacactggagaatacaaaagcagggagaaaggaagtgggacaagggttgaaaaactacctgttgggtactctgctcacttcccaggtgatgagttcaattgtactccacacctcagcatcatgtgatatacctttgtaacaaacctgtacgtgtacccccggaatctaaaataaaggttgaaaaagaaaaaaaaagatctgtcctcttcagcttgaaatgaaaccttgtaaagtgtccggcacattgtaggtcctcagtaaatagtcaggattgctattatcaagaaaagaataggggaacacctgaattacagccctgtctgtgccagtagttagagctgggtgttcttgagtaaatcaccatctcaaaatcacttccctttgctgggcttgctttacaccagtggttctcaaaagtgtgattgctggatgagcaagcagccccagcagcacctgggaagttgttggaagtacaaattctcaggattcaccgagacctaaagctctaggatgaggacaagtgacccgtgtttcaacaagccctgcatgtgattctgacgcacatgctcaagtttgagaatcactgatttatttacaaaatggtccggctaaaactgaatcagccctttagggcccctctctaatgctgatattctgtgattgtctcttttggcagggagccacatgctgactccctagggacagggacagcctagaagcaatttcagacttgctaatgtcagggaaatagaggataacccccatagagctctcccacttttagtctttggggtgtttccccatcttttttccatatatcatcttgtgtcccattttactaagcccctgaggcaccccaatgtccatcttcttccctgtttccctttcttcccccttttttttttttgcctaccctcctctcttttgtggcatgggtacctctgggctggcctgccctctcctatagtagggctggccatgacttcgctaactaaccagtatgccctgtgtcttacagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcaggtgaggacttggttcttgggtgggtaaccttcattattgtctttgagaggggaaagctacgtaaattatttaaaaatataacaattataattccttgaaactgtacagcactggcttcagtagttgttagcttagtaaccttgaaaaagatactcagccaccaaaattgcagttgtctcatctttagggttagataaaagtaacttttgcttcataaaatgggcacaactgagatttatatcctgactataaaattgatatctgagtgacccaaagcaagtcattcaaccacacaaatttgaagtatgtaattctaaagggaaaaaataatttttctgtcataaaatagccagtattaagaagagtctcactacctcatctctaaaatggaggaatatcatggccgcctcatggatcacttgtgagaatcaaatcagattgtgtctatggagttctaggcccagtgcatgatacaaaatatcacttattgcctcccattttctacttcagaagtatttagagatgcaaaacttgcaaatatccccaggctttgctttcagagatctgacttgttgggtttttaaaaagacaaatcctttcccctttctccatcctgtctctgttggagacccaggtctaaactggctgctcttatatcccggttatgacctattaccataacacaagctaccaccatcccccaggctacttctgggaggactccctaggtccttgcctactcactgccagattacttccccatggcatccctgatgccatcttttggccggtgcattcaaaccagaagttaattcctgtgttcagctgttgcatacacagacacttttgaaatgacttagtatctgaatttgctcaatatatatccttggtaaaaaggaacttcaagggtgatagaagccttacacaaaagactatgaactctacaattccttttatatgaaattctaaaacagctattctatgggggaacaaattcagaacactgctcgccaatgggaggtggcacagagattgactggaaaagggcagagggaacttgtggggtggtgacaatgttctatatcttggtaagagtttgagttaaacatatgtacctgtcagaactcaacaaatgtatagcaaggctcctagacagccaatgcacttagtatttgtgcatttcactggaagtaaattttgcctaaaaatgttgtaaacaaatattaaactttatttaatatgtatgctgaagtgtgtttgaagtatactgctgtattcaacttatgttttcagcatacaaatcttgtacatattttgttatatttgtccctgagattttatgaaagcgccgaatcctagccacccaaccaccagggatatttgtccctaagattttatgtttttagatgctattataaagagtattattttcttaatgtcaagttgaaattcttgattactagtctatagaaatataattgaattttgtgtattgacattgtatcctgcaaccttgccaaactcacttattagttctaatagctttttggtggattataaaacattttctacatacacaatcatgccatctccaaatagaatttagtgtcttcctttctcctgtacatgcccttttctgggagagagaagagccttattgcactctcaccttcaatacaatgtttggaggaaatggtaagagtggacattgtagcttttttcttaatctttgactataaagtttgatgttagctgtaggatttttttgtaggtgccctttaattgaggaaaatctcttttattcttagtttactgagagttttcatcagaagtggatgttgtattttttttcaaatgctttttctgtatctgttgagatgatcatatagtttttctcttttagtctactgatgtggtgaatgacattgattgatttttaaaataaatagaagcctagcattgccaggataaatcccacttggtcatgatgtattatccttttatatgttactagatttgctaatattttgttaaggattttgcccttatgtttatcagggattttagtctatagttttattataacatctttttctgttttttgttttttttgtttgtttgtatcaaggtaatgctagccttaaaaaatgagttgggatgtattcccttctcttttattttcaggaagagtttgtataaaatgtcttccttaaatgtttgcttgaattcatcactgaagccatctgggcctggaggttttttggtagaaagctttttaactacaaattcaatttctttaatagatttggggacatttaggtcatctatttctccttgagtaagctttagtagtttgtgtctttcaagaaatttgtccatttcatttacattttaaaatttatggggatatagttgttttcaacttactttaaaatgcaccaggattttaagatggattggtagatggatagaggagtaaatggatatatgataaggcaaatatatcaaaatgttaattgtagaatctaggtgctgggtatatgggtgatcactgtgaacttctttcaacatttttgtatgtttgaatatattcataatgttgaaaaaaagaggagaggaaatataaaataatggttttaagggcaccgaagctggaaccagactgcctggttttgaatttcttcccccgaacttacaatgcctaagctttcccatctaaaagcatgggggtagtaacaacacctacttcataagttggttgtggggattaagtgatgtaacacatttaagactcagagcagtgactgccagattgtaatcatcttataagtgagttatcatctcttaaagggacattttggcttagcttgagagacttttgctggaagaaggactcacagatagacagtagacaaagggggctgagattgggggtgagtggggcgggggaagtgaggagatgacggctgcagcggtgtcagcccaggaccagcagctctataagagatggaggtacgatttgcaggttgcagcaattggcagcagtaatgcatgcgggtgaggctgtgcctacaccatgcctctattttttgtactctgagggagggataccttgggttcctaatgcttgttagaccagctaagcaggtctgcttagatactaggcattccgacacgtggatggctgcctaggagacaccacatgcccatttctgcccatcatctgaaccttccactcctactccacccccctcaagaaatgggaaaaacttgcagcatgggttaagatgccatcgctctgatgactcaggtacttgtggtggtagctatctgaagtagggctgagatcctgctcctaatgcccctggacgaggttggtgaactaattgtctcctgttcagtgctgtgaagactgaaatcagcatgcactcacgtccttcataccagcttgtttttcattcattgtcaaattatttcacttaccaattgtatgggataagttataataggatctcccattttacagctgaggaagctgagaaagccaaggctcagagaggtcacacatctagcaagtggcagagccagaatttgaataacatgacagtaactagcatctcagtgtctactgggcaccaggtactattctagatgctttacatgtatcaagtcattgagttctcaagcaatattattatcgtgattatactattatatagttggggaaactgagataaagagaagttgaatggcttgcctgaggccgcaagtgaaaggcaggtgtgcgatttgaatccatgctatcaagctccagaggccaagctcctgactgtgctacactgcctctccataagctgattgcaaagcccaggccctctctagtgtggccggatgccctctagcagtatcacttccactgggacagcaagttcccatcacaatctccatttgcagcaagcggtggggataactgcctctttgattcaaagggtgcaagcaatgtaccaggaacctatgtggcttagggaaaaaaaaagtagagtgatactgtggacctgggaaggtggttgggagttggtataggactttggtttggccactgctatttactgagcacgtccacagggctagacagggcatggacaggaaatcctggcccccactgtggttgaacaagtaatggtgtctttgcaggcaggaacgtctcacaagggcatcgaggcagagtctaaagtacaagtggttagagctgttctgacatgccagatataggcagggactgctgtggtcctttaaaagctgaagccaagaaataaacctcaacttttccattgctgctaacatccagagcctcttatgtgccaagcaatgtgctaggagttctctctgcatatcttatttattatcactactggtcacccagataggaaactgaggtgaggttcaaggaggtaatatgaataacctcaaataacaccactattaagtgtcttagccagtgagactgcgccaaggatctatgtttattctgcttcaccaggcgtcttacttccagtagggagacctactggggcaaaggtaataaaactttgaatgggactaatagtagtagcattggagaaagagggagtttggaagatcagtgaaatttaggaaaaactgtgcattcccattgaactaaactctgagtctctaggtgtggagtattggatacaaagagagaatctgaaaggctaatttgcattcagtttggagctaaaataggaaggcagggacagttttacaaacggcacatatggcttggcctagaaaaaaaaaagagttgcttggacatggcccttaaggaaaaaatgcccagggtagagagtctgctcctgtaatgtagggactgtggcaacctgcactcatattccccagagatgggcccacctcagcccctgccagcagatgtgggcagagaaggaggagccactgcagttggaggcatgctggcatacctgctgtccctctgcctcacctggggagagggttgctgcagccggagcttctgccctcaaagcccccctcaagggtcagggcttccaagtagatgctttctctgttggaagaggcaggaggaatgagcaggttcacccagcagaacaaacaaaaagacctccatctctctgtgcaggcaagagccagggcaaacagcaaacatactaaactggtttttaatgtggtttgggaggggagtggagaaagagggaaacagcattcctagaccatggtgtccaggtccctaagtgctcccttagtctctgcatgtctgcagcagtttagcaagcctgccgacagaaaggcagccctccaggtacaaatttctcagcctgcatagcagagtagaagaaacaagctggggggctgggccagacaccggctcctgacctcttcacatttttgaggccatctagatacctggctgctcaaagctttctaacttatcaggatttttctttacaggaatttcctggggacaaatggaatccaataacaggaaacaggaagaccagccagtcagggaggtaagtgagcgctcagggagttggggtgggttggtgcctctggagcttctgtagaaattgctaaggtctttggtttgcttagtttcctttgaggaaactggcctggtatctagactaagggcttgataccatagatataattcagcctgtccccctgccccccgcactcctagatagctgggtacagaccaaactgattgctaggacattttggaatatgcaagtttcctgtattagactgagatccttgagagaggacaccataccttggtcatagctttattctctgtacctagtacggtgcccgatacagagaagttgctcaagaggtacttgtcatttgcttgccaaatgaagaaatggaacctcctccaccattaatgggtgaaatgacacaaaataatgctagctaacatttcttgaacacagtgctctattctagaccccattcaaatcattttacaagtatgtatttatcactatgaccttatggagttggtaatattagtctctccatttgacagagagaagaaattgaggcacacagagatacattcatttgcctgaagtcccacagctaatcagttgactagacccaggcggtctagcttcagggacactatactacattacagtgtttctctgaaatggttcttttactgattagtcagtgaaataagaggactttattgaaaacctaatataggtcctgcctttttctgggcaaggtgagaaatacgagcaaaagaacagcaggaagcacagtgcctgcccacagcttgagcagggaagactaacccacacaaagctaaatggcaataataataaattaccacttgccaaacaacctatgtgctgcaagccgaattacacatattatcttatgctttatcttcccaacaactctgtcaggtaggtatgattataactggggcggtgggtctcaaaacttgattgcgcaattgaaacacagataaatagttggacctgaccctgcatcctgagagtgattcagtaagtggggagtggagctcaaaacctgcaattcgaacaggctcaaacagcatctgggtgatgctgatgcagctggtcctgggatccagtttgagaattgctaactcacataaagggtcacagtcagagagcctaaggaatctactcaaggtctcacagctagtaaagggataagctaggaattaagcccagcttttactttctcacacaagttgacagaagatgaaaccctgtcaaatacagggcttaagaagcacctggcacctggtaagggggcagcacgtggtaactattactgtacactatttaagttcattggaggataaaaataactgagggttggtagctgtaagaggaaaggcccatagaggagactaagcagggtgtgttggaggaataatccccactggttaagttctggccttggagtcagttctgcctgggtacaaagccagattcttctattcactagccatgtggccttggcaagtgcctacctgcctgcctcactccctctctctctttcccttccccccttatttataaaatgggataagagtacctatctcaaatgtttgttgttatgaggactaaatgaattaatatatgtaaagcatttagagcaaaacctgacaccgtaaactctcaggaaatgttatctgtaatgaggaggaagaagaacagcagcagcagagaagaaaggtgagtagtgaagcactggaccagcctaggcaggccttgaccagcctaggtagaccagcctaggtaaacctagataggatcacaaacatgggagcaatgaaaggttaccatcaggtaagtgatatgataaatgtggccctttaggcaactttgcagtgtttgcagcctaagtgggttgaagagagaccaattaggagaagtgatctggccatgacagaatgtggccctggattggggaggtagaggtgcgatagaaatggagcagaaggaatagataaataggtgtgatatttgggggaggggagtttgtttattgtaaaaacaatattacaggaaattaaaaatagaagaaaaaaaaaccttattgtcaccaccttaacaccttggttgttttcatttccctgtcagctttatctataggtatagagagttttctaagcatgattataataaccatgtagatgtaattttgtgtgtcctgcttctttttcctctctaagcattatgtggtaaacaacttttcatgttgctatgcaggcttcctcaagtcataatttttagtggctgtataatatttcaccagcttaatatgctctaatttgcttaatcattcccaaattgttgggtaaataggttgtttccaatttctggctattataaagtaatgcagcagaaatattttgagtcactatagctttttttctcattttgaattatctcattaaaaacaattatgtggagttgggattactagtgcaaacaatacaaacattcttatggttcttcatagatcttaccaaactgttttccccacgagatgttttacatgccattagcaatatatgagcataccagttttccaaaattatgtcaccattgaaaattttctttttctaatgccatacagtttgatgggacctattatagtattaatttgcttactttgataattctagtttgaatattttgtgtgtctaattaatatattaatatctttattgcttctcatgtgaattatctgttcagattatttgctcacaaatatgtgacaccttttgagggcaaggtagagaaaacttggtgactagaacttgaggagaaaaaaggaaatatatcttagccaagcatgagatagtacacacctgtagtcctaactgctcaggaggctgaggtgggaggatcacttaagcccaggtgttcgaggcggcagtgagctgtgatcacatgaccgcattccatcctgggtgacagagcgagaccctgtctcaaaaaaaaaaaaaaaaagataaaaagataaaaaacaactctgagccccagtgacttggagaatgttattggcatagatggggcacttgagaaggggacctggtttggtgaagatgctgctaagtttgaattgggatatgttgtatttgaagttagtggaagatacaagttgagtctttcaaggcttgtcaaacacccagccagggcacaggatgaggaagaagaatcaacaaaggaaactgaagggtcaagcagctgaagtagtagaaggagaaatctgccagtgtagaagataagcagatgactgttaatgcccttaacagtttggaattacaagtgaccttcaagaaagcaaattcagtaaagcggtaggcatagaaaatagatggcatggtggtctgtaaggggggagcacagagaagaaatgcaagcagcttttaagtgtacctgttttaagtgtacaatttaatgcaatttaaatgcaagtacctgttctaagtgtacaattcaatgatttttagtaaatttacagtgatgtacaatcaccacaatcaagttttagaacatttctatcaccctaaaaagacccctcatgcccattagccattgctctccattcccactctcaaccttaagcaaccactaatctactttgtctttatagatcttccttttctgtgcactgcatatgactctaatcgcacaatatgtggtcttttatgcctgactcctttcacttagcataatgtttagcagttcatccatgtatcagtacttcgttcctttttatttccaaataatattccattgtatggatgcatcacattttgtttactagtccttccactaatggattgttgggttgttttcactttttggctattgtgaatattactgctatgaacattcatgtacaagtttctgtgtagatttatgtttttaattatctttggtacatatttaagagtgaaattgctgggccaaatggtaattttattgtttaactttttgaggaactgcccgttttctaaagcgactgcaccattttacattcccaccagcaaaagagagttccagtttcttttggctaattttactacaaagattaattgttactgtgtggtttttaaaatgtttaaaaaggggcccggcgcggtggctcacacctgtaatctcaacactttggtaggccgaagccggcagatcccttgaggtcaggagttcgagaccagcttggccaacatggtgaaaccccgtctctactaaaaatataaaaattagccagccatggtggcaggcgcctgtaatcccagctactcaggaggctgaggcaggagaatcgcttgaatctgggacgcggatgttgcagtgagccaagattgtgatactgcactccagcctgggcaacagaacgagactctgtctcaaaagaaaaaaaaatgtttaaaaaggaagatgtttaaaaatagtaaattagctaggaaaaggaaagagagaaataggatgatagttagagggagcaattgggtttaatttagtggttctcaaaatgtggccccaggcccagcaacctcagtatcacctgagaacttgttagaaatgcacattctcaggccatactcagacctactgattcagaaagtgaggatgtggcccagcaatctctgttttaacaagccctccaggcaattctgacgcaagctaagtttcagaaccaccagttcaaatgaaacttcagtcagaatctagaaaactgaattaagtttaaaacagaaaggaaagctcaatagaaaaggaagtattgacactgaagatggaagaggcaggtcccaattaaaggtctcaggaaacatgagaaggactaggagatgtccagggcatagatgacatctgtgaggagaaatcctgatagagtttcccttcacaccttcccccaccaccacacacacaaattttaacatttactatgttatttctgtaaaaactggaatgatgagtgtaggtggaaaaatcaaatgtgtattcttaagccactctctttgcctggaagcctgcaatgaattgctaatttcaggtagttatactcttagttgtcttcctccactgttatttggttttccgtgaagagaatgtaaaaattgtaatattagcaggagggataaaaatggtgagtagatctactgggagaaaaagctacattactgtgatatatttaaaagccaaaataagttattttctggattatctctcttggttttctgtacctatgattgcctgctgtgaccctttccatttttttcactttgcacagaactttagaatgtgtagggtgtttttatatgcatgaccacagttaattctcacaacaacactgaggttaaaccttatttttcccgttttactgatgaggaagccaagactcagaaaaggtattataccattaacagcagccacaacaggtataatagctaacatttattgagtgtttattctgtgtcagacactgttgtaagcatttcatatgaagtattttattatttgtaataaccccgtgagagcattactgtttattgacccagttttgcagatgaagaaattgactcacaaagagattaaagtcatttgcccaaggtcaaacaggcatctgacttcagagcccattactactgggattatacagcaagtaagtgaccaaactagagctctacttaggattttccattctcagcctagggttctcttccttccctttgtcacaccacatcatgagcagagtgtgaaatacccggtacagagttcctatttactgattgagtgaaagaatatgggtaattcagagttgaatctgatttcattaggaagagtacacttttcaggaagcctttactacctaagaagaatgcagccttcagaggctcggaaggatttgtcacaagtataactaagtgaatttaaatacttaggaattaatttaacgccaggcacacgaaacttattcaaggaaaattataaaactctaatgggagaaataatatgaataaatgcatagtgtatactttgctttaatttaggaagactgaatatagtaatgattacaattctccctaaatttaatgtgtagacataatgtactccaattgtagtcaccatgggatactttatagaatttgtcaaatttatagtaaaatttatctggaagaataagtaagtgggcggaaataccaaagagtacatttattttaaaagttaatgatggtagacttaccctatcagattttaaagcgtatcataaaacaacaattatcaaaaccatatgatagtgggttaaaaaaagtcaaacagtgaaattaaaaaagagcttctagaaacagactcaagctattttaagtatataggacacactggaaacaaccctgaactggggaaagcaattactatttctttaaaaaatgttgggaattttagatatcaatatggagaataattaacttagattcatatcacatactgtatagaaagtggaccagtagaatcgcatatttattccaggtgtggatggaagataaatttgtgtctgttaaatggaggatatcatcagagacaagatcgatggattcaaatatataaaagttggtgggggggaagcctttgtacaacaaaatgtaataaaaagctaagcaacagaacgaggaaaatgtctgggatcagcatcactgacaacagttgcatgtccaaaaaatatatatataaaaatgggtagaaggtcagctttcagatttagcttcgtaagtgggcaaggaaaatgaacaggcaatttacacatgaggcaataaagggagtaaaatcattgcatggaaaagtaccacctctctagcaattaaagaagtacaaatagaagcaacttcaaggcatcataatctgcttattaaactatcagcaattaaaaaaatcaataaatagaaattgtaaaatgctaccttggcaaggctgtgaggaaacgtgcttctggaaacaatacaaattggtttagtcttcctagagggcaatctagaaaaatgtgacaagagtatgtgtttctgggtttagtcttcctagaggacaatctagaaatatgtgttcatattatttggcctaaaatacccccaaggaaataacctaagagggaaaaaattatttaaagatgttcatagtagtgcttattatactcatggaaagagtttaccaatctaatatatcatcatcttggaacaaaatagaatagccatcaacagtgacaggtatacaaatgttgggtctttcccagaaatgagtggttgtaatattaacaaaaaaataataaatatgaaaccacatgttgaatctaatctgatagtagccatacacaaagaaaattcagaaaggaatctggcaaaatgtaaatagttggatatgaatgtacatggtgttctttaggtacatgtcaagttgttggaatttataattaaaaagaaaatctgaataagaggtggcccacgttggtttgatatagacccgagaagttaaagatcaagggctttgtaaaaaatccccgtaccaatgacagacaatgttacttaccagacatgcttactctcactgctagctagaattgggtttgctagaattctccatccactagcacttttgcttgcttaaatccacaagaactttgacatcaccagacctctacgaatctccaaatttgtcaccaccactacaacatagtaccccctcacacacacccccaccaataaacattttattatctgcctcagaaccatccctttcttaaagcttttccatttcccttcatttctatcactagcactagtttgcatttcagtgctattattcacaaagaagcacattttctctctaccacagtgactgcatatgtatgtattacttgacaacaaatatagattggggtcattggagagaaggagctaagcttcacccaggacagccccagtaaagcaaggacttctctgatttcttcacaggacactttgcatcagcctcctgaggactagagaaggttcagggcaagcactgccacttgcatttgttgttgccaagctaattgttcattacttgaatttctgtgggcccgggggcaagcaggggtggcagcaacaggctctctgggtccttctcccctccctgtgtatcctccttgcgtctcacttcctggatcttgcaaatatttccttcggcaataacctgggagtgtctgtttctcttggagcagtcttacttggctgctgagggaagggaaaggcgagacgggttgggcttgtgtgctgttgctactgagattctagaatgccaagctattgtggtgagcttaaaaataaagtttccaaacaagaaacttcaaaagggccgaggaagaggtaggaggagatttttcagtctctgcaaatattggttttcattttcaattcctattaggccaaaaaaaaatattttaacaaaaagggaaaatccgttcttcagaagaaaaggcaacccatggaagcggaaaagagatgaacaaccctggttttggcaggcaatttacttttgtttttgagatgtagtctccttgctgatgtcaacaaagccctttctcatagtttgctttcatgcttcctctgctttcctcagtgaggcgctaaagccttcatggacgcccgaggatgaatgtagcacaagtaccttttgctgtaccccaggagtccctgcttccctgcgattatctctcagagacagacaaggcaggtctggacactgtgctttttactagctgggaaaatgatttatcctttttaagcctcaggagtctcatctgcaaactgacaataatggttgttgtgaagattaatggaaatacatacgtgaaagtgcctaacacggggcccaacacttggcaaccagagtagtcgactgggtgcggtggctcacgcctgtaatcccagaactttgggaggccaaggtggatagatcacttgaggtcaggagttcgagaccaacctggccaacatggcaaaaaccagtttctactaaaaatacaaaaattagctaggcatggtggcacacggggaggctgaggcatgagaatcacttgaacctgggaggcagaggttgcagtcggccaagattgcgccactgcactctagactgggcaagacactgtctcaaaaataagaaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggaaggggaagagaagagaagaaaagaaagaaaccagagtagttccttttccttaatgaagctccttgccctccactccaaggaaagaatccttacttggtctcaaagcagagttgcaaatttctgtacatttaggaggcctgatccccttgaaaataggacttctagaggccaaccaatatccttggcttgaggctgacacccttcaatggaagcctccctttcaccatcaccattttgcttcaattgttaaagccaggaagacaggagcaacattggttttgctcccctttgatctggtcatcttgcacagtgtaatattcagcaaggatttgttgaaggaatgactagtacacacgttggcccagatgatcccattaagggtagcccttccccttctggagttggtcttcttctgcctgcttgatataagtgactctgcaagtctcaggctgccccaacacagggcaagtgagtgggagggcagtggttttaaaatgagggctgatgcagagaatagcaattcccaagttgccttgtgcccagtacctccagatagggtcacagttccatgacttggggcaccagatgtccctagaagggcatgttcttttcttccaactgtttctggagtttattaccgggatggggtggggggggggatttttttaaggctaacacacatagttagtacttaagacacctttgaatatccagaccttttgattgtcacactgctcttaaccctaaacttgccttttattatatctccctttttagtagataggaaaagtttgagtgaatgagtccaggcttaaactccttagtaaactagggcctcctggctagtcagctatgtggttgagctgggacttgaggtctcctggtttcttggctattgagcagggttgaacattaatcagggagtgcagtccaattctcttgatgggaacaaggagcaagcctgaagcatacaattgtgaaggcaattttccatgttcctagcatcatttctaggtcctttttacatagttcatccttatgactgcttatttgtaagataggtattttgttgaaaatgaggtaagtgaaataccttgctcaaggtcacacagcttttgagttatagagccagatttttaaattttattggaattcagacccaagtctttccaacactgtgttctttctgctttgctcaattgcctgtcctgtgccctggttagggaagaagaaaatgtggtaaatttgattgttatcatggagcagggttgttttcatcacagctgcaatacattggcccaattgttgcctttgaggatattgctgcatttcataaaatctacatcggaggtgaaggtcgggagagaggcagggacaggagatagaaatgggcaaccaggtgtgtgtggtgagggatgggggacagaatgtatagtttggaaaccaacctaattggaacaaataactgcccccaaaccatagcactcccaacccttttactctgaacctttgtttccatgatatggtccctgaaccacctgtgttagaatcctttaggtgaattgcttaaaatgctgattcctggatcccaccacagaggtatgaaacccaatttctagggttggggcctatgaatttgcattttaaacaacttcctgggtaattctaatgaggagccactttgattatgagctgttttcccagactagtggtttccaatgaaagttggatcatgtacccttctcagaaagaattttttaagcatgtaccctcaacatatgttggcaatatatttattaatttcttatatgtgctaatgtcctcatatttatgctttgaaatgcaagaaatagaaaaaaataaatataaaagaagttctgtgaacacaactaccctagactaaaaaataaatgaccagtcaaaaaaaaagggtaggtggttgaaatccagtttcagggagaaggaaaaaagaatggtaaaagcccagtagagtggagagttgaccttatttttctacaaacccagaactcctccagaatgaagaaaaagggaactgaccataaaggtttcaaggtaaatatcagtaacccattaatcgttaatctttggataccaaaaactgaaaaaatgattggacaaggctgaagggcgttggccaggcacccagttgaagtaggaagcagcattttatgagagcacctacatgagacaagcacctcatcttttgagatgtgtagctaaggacggcattgacaaggcaccagctttgatcaaagcagcaaagctccatgcagctcatgaactccggtgctctttgagcactgtagggtaaatcagcccagtaatagaattaggaagcttgataaggttgagcaaagcaaataatttccattagcttgcgctaccccaaataaatacgcaatttaggtaaaaacaacagacttgctatgcaaacacagcctcgagataaatcccaggccactccccctccccccaccacacacaaaccccaatcagattctggagcaattggacagctgctgactgctttacctgctactcattgttcccattgcctggcaacctgggctacgaggttacagtaaaaaagatctaacttttcttcttttccatagtcacacaaacctgcatttatttcacattgaagaaatatgtactgagcacccactgtgtgccgggcactgtgctggatactagtgatacagtggtgaacttgacatgtgccttcaccctcaatatggttatgtggaaggggcagacaactaagcagtagtgtgctaggaaaattaatgggtgctgttagaggacagtctgggcacctatcccatgctttgggggaatcagggaaggcttcctcaaggaaatgatatctcagtggaattctaaaagtaagtcagataaagaggcggaaagagaagataaagagcaaacagcatgtaaaggcaaaaagaagtgtgggaggataggaaaggcagaattttaagaaacctaacaaatcctagtaagggtctgtattttatgaataatgtaggcttcaagcagaaaaatgtataacaaaatcagatttatgctttatttttctgtttactaatttttaattgaaaaaagtaataaatgcatttagtgtatacacacacacacacacacacacacacacacacaataagagaatctcaccccaaaccatcagtacaactctttacaagagacattactggcaatttgttgtgtatccttccagaaaagtaacgtgtgtgcatgtatatacattcttttttacaaaaatgggaacatattgcatatcttttctattgtacatcctgcttttttattttagtgattattctatgttacacatagctctattgcatcacctttaacgctacatagtgttccatatatagatattccctattttatttagtccctattgaaggacatttagatggtttccagtcttttgtgattacatacaaatctacagtgaatatccttatggatatctctttgtgttcatgttggaatgtgtctgtaggataaatccctagaagttgaactactgggtcaaaggatatgcacattttaccttctttgccttccaaattgccctccctaggagttatgctaatttcaactcccaccaacagtgtgtaagatcacctgtttccttataccctcattaattctttaactttttttatttaaaaagtgtcattattgtttggatttgcattttttaaattttaagtgaggtcgaacaccttttggtaaattgataagtcattttctgtgaactatacctttttctccctatggagttgttggtcccttttattgattggtaagcatacttcacatattaaggatatttactcttagttgtatatgttacaaatatttttcccagtatatcttcacctttagactttatggtgttttttctggacataattttttaagttttaagaagtcaaatttataaactttcccttattacttttatgttttgtgtcttacttaaaaagaacttatcctgccaagattattttatatttttaaaaatgttttcttctagtacctttatggtatttttttgacaattgagtcttgatacatctaaactttatttcgttgtaaaaagtgataggatgattcagctttatttttgtctcaatggctatccagttctaaaactacgtattgaatgattcatccttcccccactatttgaaatgcttcatcacaaactaacttcccctatgcatttgagttgacttcagtgttctagtgttctctgttttattccatggatctacctttctatttgtgagactgccttatttactgctaactttagaaattatttcaataattggtagggctggtcttccctctttcatctctctttttccataccgttcataataattcttacgattttaattttcccatatgaaatttacaataatgttccaaaatgcagtctgttgacacttttattgagtttctattaagtttatagattcacttggagttgacatcttaacaatgttgagtcatcgttgctaggaaattgtgagtcctttcatttatgtgcatctagttttatgtttctcaatagagttttaaagtttttgcgtatagatcctgcatatatcttgttaggtttatttctaggcatcttacctttataattgctgcagtaaatgtgatctttccctccattatatattctaactaattgttgcatctatgtagaaaagatgatttccatatatgaattttataccctgacaccttactgaattttcctgttgttggtattatttttaaattgtttatgatgaggctgcgcacagtggcacatgcctgtaatcttagcactttgcgaggccgaagtgggtggattgcttaaggccaggagtttgagaccagcctgggcaacatggcaaaaccctgtctctactaaaaatacaaaaattagccgggtatggtggtgcatgcctatagtcctagctacttgggaggctgaggcacgagtgtcgcttgaacctgggaggcagaggttgcagtgagcggagatcatgcactccagcctaggtgacagagctggactctgtctcaaaaaaaaagtttctgatgaattttccagataaataatcgtatcatctatacataatgagaagatatccccttcttccaatgtttacatctttattttgttaaattgcactattgctttcagaacaatattaaatattagtggggaaagtgggcacctttgccttgttcttgtttttaatgggtatacctctagtgttttgccattaagcacaatattggcttttgactttaaaacaaaagtctgatgataatgatggtattatggaaatagacatctttttctgttaggttttttttttatctggaagtgatgttgaattgttatcaaatacattttagcattagggaaattgttatgtgccttttatcctttgatttattaatgttgtcaattatatcagtagattttctattactgaaccagtcttacatttctaggatgaaccccacttgatcatggtgtatcatatttcttaacatcctcttagattctgtttgctaatattttatttaagatttttgcatctgtattctcagatgagatgggtctctagtttgctttttctgttctgtttgctgggttttagtatcaatgtaatgcaggaatcttttcttctctctctattctctagatttccagattctagaaaatgtaaataacattggtttgattttttttccttgaaggttggtagaattaacacaagactatgtgattgtgctatttttggtcaaatttatacttttttttcctatggtaactggtgggtttatatattctcattcttctgaaatcagttttggtaatatttgttttcacagaaaaatactttaagttttcaaatttgttttatggggtagagcaaagtattctcttattcttttcatttactctgtaactgtggttatttctcaatttctaattttgtgcatttgggtgttttttttttaattagattagcaagtggttaatctgtttcattgttttttattttcttttcaggaattggttttgcctttaattattctatcacttgttctctagtatattaatttctgccgttagttttattgtctttctgctttgttttaggtttatttttatgattcttttcttcttttgttgaatgcttaattcatttattttaattcattcttacatactaatataagtatttaaggctacaagtttttctttttctttttcttgagacagagtctcaccctgtcaacctggctggagctctggagtgcattggcgcgatctcagttcactgcagcctccgcctcctaggttcaagcaattcccctgcctcagcctcccgagtagctgggattacaagcgcacgccactacatctggctaatttttctattcttagtagagacagggttttaccatgttggacagcctcgtctggaactcctggcctcaagtgatccgcccgcctcggcctcccaaagtgctgtgattacaggagtgagctgccacgcccagcctacaagtttttctttaactactgctttagtcaaccatatcctctagcttctgatattttcattgtttgttgtcattttctagatattcaacaatttcaaattagattttctcttcgactaaagtggaagaatttttttcccgtttattttctacatgctaaagatttttattttcattttgttattaatttctagtgttaccgtattgtcattagaaaatatggtctggggaggccgaggcgggcggatcacgaggtcaggagatcgagaccatcctggctaacacggtgaaaccccgtctctactaaaaatacaaaaaaaattagccgggcgcggtagcgggcgcctgtagtcccagctactggggaggctgaggcaggagaatggcgtgaacccgggaggcggagcttgcagtgagctaagaaagcgccactgcagtccggcctgggcgaaagagcgagactccgtctcaaaaaaaaaaaaaaaaaaaaaagaaaaaaagaaaatatggtctgtactactagtgttaccgtattgtcatgagaaaatatggtctgtactacttccattttctggctcagtatatagccaattaaaaatatactcaatgggcccttgattaaaaaaatacagtctgtttcagtatatgaagaaatttagattttctcattatcttagtttttgactgtcatgatctgtcatcagctgaaacagtctcatattttgtttctactttttttctacctttgcatttgctatagattttgctttaagaatttttatgctatgttttttggtgcataaaagatcagaggaggtagaccatcatgtgttctagttgttaacattatagtgcccttctttgtcttatttattgcattttgcctttaattcaacttatgtatgaaatgagtatcataatttattttttctttaattttgaccttaattcctttgttaaacatatttattgaacacttactgtgtgccaggcactagaaacctatgaatgagacagacaagatcctgccctcatggagcttacattttagttagagattggagcagaaaataatcaagtaaaaatagatatgtgatatgatatcaggtggggatgaagatgaatactcaaagaatgaagtagaataaggataattaaatgtaagttgtctctatttttgataaagtagtcaggaaaggcttctctgcctggtacacgtttgtcatttttttactttccacttgtccatcactgtgtgtgtgtgtgtgtgtgtgtgtgtgtgtgagagagagagagagagagaatatgccaggtggaacagtttgcacaaaagggattgttataatcttaatgatctataagtgtgcaaaggcccaaatgagaagatagtgggtatgtctggatatgaatttctgatccacatgagtggtgagctgaccagaatgggggagggataagaggagaattaaggacattttgtcttccattctgtctgaatttggctattattatgtgtattattattttttaaagaactatttccaatcttcatcatgattattgaatggatattctgtatgatgatttaattgaacccctggaatttcctgtcactgggcaggacttagcatgatgctgattgctcacaggctacagcaggaaaccagatcttgtggtttagagggcttaactctttatactctgaggctaaagagatgtcttttaactttagtcagtgtttattatacagaagtttgaatttttatgtaaattcaaataaacctggacttatttggaggttttcttctattgcttatgagaatcttatttcacctcacaatgatagtctttttaattttctgataggtttttcttatgttatatatgtgcataatatatacacatatatatacacatataacatatataatatattaaaattatacacacacacacacacacacacacacatatccatgactcttgatctggaatttattttggtatataatatatgatgtagctccaaaaagcactgctttgcagttatctcaaaaagatttattaaataatatttctttatctcctttttgggggaagattatgtatatgatgtttttataggtagtctgctttgtttctgaactttctattctgttttgttgatcaataacacagtttcaattacaattattttataatatactttatcccttacttacccccttccccatttcttctgtagcagaatactctttaatattatatcctgcttttattacaagttaattttctaaaaattctgtagttaaatgtagtttaaaaattcctattgagaattctgattggaattgcattaggatatttttttttttgagacaaggtcttactctgtcaccccagctggagtacagtggtgcaatgatggctcactgtagcctcgacctcccagtctcaagctgtcttcccatctcagcctcccatgtagctgggactaaaggcacgcaccatcatgcacagctaattaaaaaaaaaatttagagacagggtcttgctatgttgcctaggctagtcttgaactcctggacacaagtgatctacacacctcagcctctcaaagtgctgggattacaggcataagccactgtgtctggccagaaggagatattttaaatccaaaatagcagataactatgaatgacctgtgtggtgttttttgttacaagtataaaaacacagaaagtatatatatctaattcataatacaggttgcatctagagaggcaataggggaatggaagtggagagttatgtgaagggtattatttcttaagaaacagtcataaaacataaatggcaaagtattcaaacttactaagtctgggtgataggtaggaacatgggtattatggcaatcaatctctgtacatttctaaatattcaacatttttataatgaaaaacaaacaaaaacaacagatgaggcaggataaccaggcttgtaagccccagaaaacagcacatgcaatctgactcctataaacagactggggtagtatgtgtatatccagactttggagctaaactgttcaagttcaaatcctagctctaccacatactagctttatgaccccaggcaagttacttaaatgctctatgcctcagtttccccaactgtaaaatcagtgcaatagtaatagctacctcctggggttattgtgaggattagataagtgaagacatggaaaccacttaaacagtgcctagtatttagtgtgtgctcagtaagtgttagctatcattattataatattattattactattattacatttactacacatactacattgttttgtggacattttaaattttatataaatgttgtcatccaaaatatgggcctatctgcaacttgcttgtttttctcagtactcatctgatgttttgcagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggaagaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaagtaagtacatatgaaagatactaggtctctgaagaggcaggcagcacaagtttgaattttacctccactatttactaactggatgacctcaggctggccagttaaactgctcccagcctcagttttcttacctggaaaatgggtataatgatacttgcttcacatgattgttatgaatattaagataatctacataaaggatatagctccatgcttagcacatagtacatgctcagtaaatatcatgttcttatccctaaatatctttattaaagtactatacttttccttagtgtgtcttcatggtatccatcaatttctggcccctgatcccaaaggcattgaacacttgttgcctatactaggtctttcccagaaacctggctcaggcacttttcctgccttctcttctgcttgccctccagaataagaggccagctcacaacctgacctgcctctgctctaggacaagtagcctgggcttctaaactcgtccccccacaaccaccagcatcaaaggtattcctggggctgggtgcttcatgccttgataattccttacaatagataaggacattctttttctcttccactttctccccctccttgtttacctgcctctttgcattcatgtgggtgtgtaataggtggtagttgacagggtgagctgcctgggcagggaggccaaagcaagagtgtgttctggcagcaggactgccagtgtttgttcactccactgagccagttgtcatctgcatgccctatagtgcatggttgggtttttttttttaatttcttttgctccaaagcaaaagccccaggaccatcattgctattattgctcagtgctctggctgtcagcagctccacctgctctcctgtggagagctcagcccactctctgctggggctgaggttcgggaggcaggtggcttataagtgctttccttaactctctttatagcaggaatttgcctgagacttgttgcggttagaagtaccttgttatcatgtcttttattgtcagacaaatctgtgacttgtctatgtggagctagttgatcagttttccagcccaagatgccataagcacagcatttacagggcctggctcccaggcactgttaagaatccttcatgagggggggaggggggagggatagcattgggagacatacctaatgctagatgatgagttagtgggtgcagcgcaccagcatggcacatgtatacatatgtaactaacctgcacaatgtgcacatgtaccctaaaatttaaagtataattaaaaaaaaaaaaaagaatccttcattagatcccatgtggctgcttctcaagctgttcttctacctggggagcattctcattgtaattagaaaacattttgtgaaaaatacctgtgattgttatctatcatagcagggaaaagggaaaatgacctcccaatagtaggcacttaacaaatatttaagaagaaagaacaaataaatgaatggatgaacatttattaagtatttcttatataccagacactgccagacattatgtatctatttcatttaatcctcccaatagccctattagccattattatccccatttgacagatgaggaaactaactaattccaagttacacagcaaacattcaaagccagagctgtctgactccaaagcccatgcttattttgccttcctaggcagcctctcccagagagatcttgttctttccataggccaggagtcacagggtcctcttctctcctgtagggcaaggtgtaccagaggcagcagttacaagccctggttcttccttctttgtgtagctccctttgccttggcaccttggccagacagaaagaaatcactattactagagatcttgtaacttgctccagagatttatttttaatgactctaggatgtaagggaaaacatttgtttgcacacagctctgcttgtgactacaaaatcaattagatgctcctttgagtgatggagatttaaggaacagcatcattcccaaaatagctaatttttttgattgcttactatgtgccctgcattgttctaagcactttgggtaatgattgatttaatcatgaaaataaacctatgaaatagttaccattcatcttctccatttcttagatgaaaaaagcaaggcccagggagataaagtaactttatcacaagatctcaggtagctcactatgcttgctatatcatcccacgatctctgggctcttgaagaagattctattccagaccctaggagaggacagtgtcctagccagaaggaagcagctttaagattttgtaagggacatatagatgcataatattttgaatctaaaatgcaaacaaagatatcctaatttcagccaagttaaactctagtacctttataacctacatactgttctgttaaaaaatgctgggatacacacagaagccagctagtggaataattaagtattatttaagtctaataactgattcaggtataggtatagcttgctttatggactctatgcatttcctctcagtgctctgtgaaaggaatctgctttttgctttgatgtttactacatagaccacctataatcacttccctattaatggaggtgataaggaaaggatccctagaatatagtgcctaatgtgatatactataatatgatgcagggatgtgtatgctggggaactgagtctccaattagcacatcctttttttcctttataacaccttctgacacagaactttcacacataccctaaatatttttcttgtagataggaattccctaagttcagaccttcatattccctccagaatattctccattatctgctaacatagatatactccagccagaaaattccttacatgtaggcttttatatgatctcaagttgtccctttggcagtatagcatagcggcttgaagcacagattctagagtcaggttgtccaggtgcaaattgcaggtctgtcatttaatgtctggtgaccttgaggaagtcactgtacctcatgttgcctcatgttccttatctgtataatggttttcatgagcattcaattatatatgtatatacctatgtgtgcatgtatctatcttaggatggtttctggggcatggtaagtatggtgtgcatgttagctagtattgttcttttatcagtgttacaagcttgaaacttacatataaatgaatttacctaggataaaaaatattggcgggcccaactttcttttgtgtgatgaattaggagacagcatagcatgaatcagtaaatagctgtggagccttttaaccattatttttgacctttaagaactgcaaatagctgcaaaaatgactaatgagtttctcctattttccctttcaaacagctagaggttagcgaaggggtagtgacacagacaggtggaggatgggagtggctagcaggcaatgagaatatagtgagggcgggccaccccctagcataaaccacgggcaaaattatttgcccctccatcgctgagacctaacattgtagcatttctctctacttccttcctcacaccagactggaagctttgatggcagaagaggccaaacccaagccagcatggaaccagaactactttttttcctgagaagttctatttcatgggctggggctctgagaagcaatgcctcagccccacaggctttggtgaacccaagacaacagggtctgttgctatacttgtcaagcccctgggtgccactggttccatttttttccccatttcattctacaaccatggaggaggcaggagccattgggaatatgccagaagtggagagatgctatcccttttcaggctgaagtcctgccctacagcaggcaatgtctgaagagttcatgagagatgtggtgggcggtgacaagtccctggcagggtgctaactgcagcctccaacatggtgaccactgttgaggtcatgggtgacctctttgctgtgggagatctgcagcagagggtccatttcaagtaggagtggcattggaaaagaaaaaaatgatgagagtgtccaggaaagccacagggtgcctttgtaagcaagaagactagatagagccaggatgggttgagatccaggggtaggtctgagggaggccaacaggcttggagaaccaatagataaggtctcagatacttctctaccacctagcccctactttgggatccacatactggggtcatgcaccaaagggatgatgatcagaaggcctgccaggttttctggattttaattgagtgttaatgaccaaaccaaattatctcgaaagaagtctccctagccgatgaagtcaggggcatggaaatagccttctaagttcttaaaacttacctttacttaactccagtttgccttcatgtggcctgtttacatttgaacagtgccttctccatttttttcaactccttggtgaagcagggttccatttttcagatggagaaattaagaagcagaaatgtcagcagcctctcaacagaggtgctcaaatggtcattctttgtttccacagacaagagtttcagcacttttcgcctccttcaggggccccaggaatccctacctcttactcagcttattacaatatttctgtggccaaggcagagctgctgaacaaactgaaagaccaacctgagatggcagagattggcctaggagaggaggaagttgaccatgaactggctcaaaaaaaggtaaagttttttgatgtgtcctagagattttcagaatttagcttgaatgtatctggaggatgaccagccttctacactctctagaacatctcgcattcccatattttcagtatggaaaccatacagcctctctggatttctcacagatccaagtcctgtctatttttgatccagtcaataataataataacaatcataatcatcattattgtctctgtgatccttagaacaacccaacaagggctgggcacggtggctcccgcctgtaatcccagcactttgggaggccaaggtgggtggatcacctgaggtcaggagtttgagaacagcctggccaacatggtgaaaccccgtctctactaaaaatacaaaaattagccaggcgtggtggtgggcacctgtaatctcagctgctcgggaggctgagacaggagaattgcttgaacccgggaggcggaggttgcagtgagccgagatcgcgccactgcactccagcctgggcaaccaagagtgaaactcagtctcaaaaaaaaaaaaaagaagaaaagaaaagaacagcccaacaaggcagatattactatcccttttttactagttgaagggacgaatttgcccagggattacagactaaatggtagatccagcacttgaagtcaagactgtctgaatttctactgtacagtacatgctgtctctctgaattaagccagccttgtaagtaactcactacccagggcacatcagagtttctgccagtgggctcctctaaccaatggcagtgccattgatttttattctttgtgcaactttgtgggagacagaagagactaagtaaaataaggacaacttataggctggcaaactttagtatttatttgcaaggatagtcaattatgtcttaaaagtacaaaatagttaagtggagatgatgatgttgttgtcgttccaaagctttcctttctttgtctaagtaccactagtctggttttctaatccaattcttggaatcactttcccctccctgcacttacctattgtatttcataagcaaatagggttgtcatggcaacctcaaaggctcaatttaccttctttgtggacatctaaactcaatgtaaattgttctgcccatatttctttcaggatatgacccgtaggaagttacagggccatttgcaagagtccttcctccaatttcctatctgaagcaaaatgtcaggggaagaattggaagcatggtggtgttgaagttttactgatgcagatgtctgcttccttggattccatgttccccgagcaggggtactcctagcttactcagggcctggcctctgcaggggcaaacctagaagtctgaccaggaaaagagagagatgatcagaaatggcagagcacagaacgacagaaagtgaactaaagtgattgtgggtgggctatgacagtttttgtctctgaggaagaaaggtgaggaatgtcaccaatttgcgatgtcccagaaaaagcaactcagctctggctggatctgtgatgactccacaactctatccatcacacttccccaggactgaggttcaggttgtagagcccaagttccaagaagtaaagggctctctccacttttatccttccatctatccctggagcttgggaactggggtaagaaggtgattttccaagtgggtcattttctagatggcccctagccatcctttgtccccagcattgacttttatttgggagagcagatggtgggaatataactgacagcctcttcatctaattgtgttgccttattcatatcactgatccccagttctcagtgggttttggaactttccccaaatgcaaacctattatacttcagactgagatcatggtgatctcctgacttttgaagagttctaaaatatgacaacaggtcttggaacctggaggaggctttcttagtcttggtcactttggacatctctaattaaattactagaggggaatacattccagaaaactacaaacctatgggcccagtgcttgggctagaataagattaaaacatacactgaagcatactcctatgaacaagatactattctaaacatgtaacatgtgttaacttatttaattctcataacaactctatgaggtaggtcctattgttatcttattttttagatgtggaaattgacgtgcagagaggttgagtaatttgctcaaggtcgtatataataccactactttccagcagagcaggagttcaaactctggtagtctggcactggagtctctgtgctcttaaccacaaagcagtactgtctacagaggctatgggcagcctgggacagggccattcttgtcataaccttgcagctagacaagtatctattagtttggagtatgttgtagaactaatttaataataataataacattagtaagcatgcattgagcatttaagtgccagtcataatactaagtcttttacttatgtggtttcatttacccatcagaaaatctctggagttggggaggtgtccactttacagatgaggaaacagaagtgggattaggtatctatcctaaggccatagagtttggaggtggaattggaatccagatgtctccgactctaaaactttgctgtacttccctgtgactgtactcacctataggggagacaaatcagaagacacagacagcacttcccttaagaaacttacaatcattagcaggtgagagatcagacacacacaaggaatagaaagtgaggaacttcaagttacactatagggttctaattctaaaatacttaaaagctcggacaaaaaaagatcactgagagaagacttacagaggagggcttcctgtgagggaggggaggggcagagctgtcccctgaagaaatttaggaataatcaaaatgaagaaagagataaagagtaggtggaactgcataagctactcaggaacacaagaatgagtgttgtgaacacagaggagaatgaggagctaattctgaaaggctctgaggagggacattagaatggcaaggtggggccagactgagtaacaaataatagcagcctagcttttacgcagcacttactatgggccaaacactttgcatgcataatctcattgactccttattatgactcaatgcagtgggtaaagcaattatccccattctacagataaagaaagtgaagctcaataatgtcaagtcacccaaggtcccacagctacgaagtggcaaagctataaatcaaacccagtcgttataactccagaactcacagtcttatccaaaaggcctcaaaagccaagctaaggaagcaaagatctagcatagtgtcatgaacttgagaggtacttaaatggattgaaggagaatgaatgaagtgataggcaaataccttagtgcaaatgcttttccaacctaggctctcaaaaggactgtagctcctatttattaaatcgtcccaggaagggactgggtgcagaggctcacacctgtgatcccagcattttggaaggctgaggggggctgatcacttgaggtcagcctggccaacatcatgaaaccccatctctactaaaagtacacacacacacacacacacacacacaaacacacacacaaaattagcctggcatccatgacatgcacctgtaacctcagctacttaggaggccgagacgcaagactcgcttgaacctgagaggcggaggttgcagtgagctgagatcgtgccactgcactccagcctgggcaacagagtgagactccatctcaaaaaaaaaacaaagtgccagcaagtatttattaagttgcatctggtaaatgaagtttagtgcatggataccacttacccaatgccaaaaagtttggtggtgacatggagatccctaccagacggatagaaggtgcttgcccaaaagactggagttgctcatgacttgcccaagtttcctttgtttccagtgactaggatagagcccaccatctgttccttggattccaaaacagaggttacaggcacaaatcagtttctgttgatccccattctcatcctttgtcttctcctgtttaattcccctagatacagcttatcgaaagcatcagcagaaaactttctgtcttgcgggaggcccagcgagggctgctagaggacatcaatgccaattctgcccttggggaggaggtggaggccaacttaaaagccgtctgcaaatccaatgaatttgaaaagtaccacttgtttgttggggacctggacaaagtggtcaacctgttgctgtcactctctggacgactggcccgggtggagaatgctctgaacagcatcgattcagaggccaaccaggagaaggtagagttggggtctgtggggtgtgggtagagggaaataccatttgtttcttctcagggctccctctttcaagttgggctactataggaaacagtagagcatgggattaaaagcatgtgagcactgaggatgggcacggtggctcatgtctgtaatcccagtactttgggaggccaaagcgggcagattgcttcagtccaggagtttgagaccaacctgggcaacttagtgaatccccatctctactaaaaatacaaaaattagtctggcagggtggcgcatgcctataatcccagctactccggaggctgaggtggaaggtttgcttgagcttgggaggcggagactgccgtgagcaaagattgtgccactgcactccagcctgggtgacagagcaagaccctgtctcaaaaaaaataataataataaaataaaaaaataagagtgtgaacactggcttttaagtgccctgaaattcttgccctaccatttattagctgtgtgactgtggacaacttacataacgtcactctgcctcaatctcttcacctgtaaaatgaggtgagcatactacctgccttatgggattattgtgagaattaaattagtttatgttaattacataaaacagggcctgggacagggtaaacactgaatcaatgctagctcccagtagtagtagtagcagcagcagttttgcctcactctagagttggagggggaggtctcatcaagtatttgagattggaaagctgtcagtttcacaggttgggtcactatgcatatactcctgaaccaaaattgcatcacctttccctatacaggtggctttggatatacctttgaatccacaacaagaggcacatatctacatacatatacatacatacacagacacatacactcacacatatccactcacacagacacacacatcatacagaaagcacctccacagtgacagttgttcaccaggtgaaagggacacaggctggctttgtcagagccttcctccaccccaagcccagtggtggtccctacattgaagacagcgttaaagagatggaaagaggtaatttcacatcccctatccagaattgttgtcatgtttaccctcctgctacaggaaacaaaggcttttgcatggaggtagacttcagggcagaaaatctaggactgactaattagcagaatgtatagctgctttgtggcagcatctctggtggagtactgctaggcagcactgttggacagatgcctggtaattgagagagcccttacttggtcctctgcttccccagttggtactgatagagaagaagcagcagctgacggggcagttggcagatgccaaggagctgaaggagcacgtggaccgccgggagaagttggtgtttggcatggtctcccgctacctgcctcaggaccagctccaagattaccagcactttgtcaagatgaaatctgctctcatcattgaacagcgagagctggaggagaagatcaagctcggggaagagcaactcaaatgtctcagggagagtctactcctggggcccagcaatttctaattctaccagcactctgccacagcatccctgcccagccatgtgggaagtgctttcaatcttctttgttagcagtttctcagcaagtagatagcaattagcagtttgttccagccctctaccctggatgtctctcactaccccttccctagcagtggtcctaaccagctaggagaccctggggaagccacaagcttctacccaagggagctgcagcaaggtgtgatcttagaaccacactctccttcccacagttgccaagggcaagtacttgctgcacagagaaccaaggaagtgccttcattctgctttgtactaggacaccaaagacatcaagtactcatcacccacccatatcatcaacagcctctaaaggctcagagggaatctgccttgcagctctactctgccccagggcttgtggccagccatttctcacagagagctggctgccttgagggcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggtaagcaagtgccaaggcgttgaattgttcccaccatagctaccgatgtctaggaaggagttttccccttgaactcagagcctccctactgtggcctggccttgtgcttcccttaaagtctaagtgacttgagtttagcattccccagcagggtttaagtttttcttactgatttctttttgaaaccaaagaaatctcctgaaatggagaaaggttcagtcatttctctaccatctccaagctatgggatcagtagaggtgagctcagaaggaactcctctaaccattgctttctcagcctgtggcctggctcaagggaaccaaaactcaaggtagctgggagctccagccagagccagctccccagagcaattgaagacccagccaggatcttaggcatacaaacaactaaaactgctgctgttgccaaggccctgacaccagtagctagtttctatgctggaaaagcagccctcaggtggacgatggcaagaagggggttatggccaaatgctgccctgttatccagcttagctccctgttcctcactaactggggccaatccttggtatcacacaacccagccaaggcctggcatctcttctagttactgctgagttcctcagggtccttgaaggtcaactgtagcagcagggatgtctcattcaaccaaagaatttgccaaggaacttttgctgctgttacaaatacttgtcactagcttccatttcctcttcattgtatttgaaaacaatgggagaatcttggccagcagggtgtcctggggtagggggtggggtaagcctttctgtggagctctgggtttgctcttagtactgctgccagaaacactgttagaatggcaaccctgccattctcccctccagtggaagattctactttattcaggaaggctggtggcttgcaggggctaggcttacacaagccagccaagattgagaaggtaggggagtgctttcaatggaggccatagttgtcatcttttcttctgagcaggctctaggacaaacaatgagcaaattgagatgtcctgtattgggaggatgaggctgatatgtttcatcattctcagaatttgtgggctagagcacctttttgggaatatgggcctagggaaaagaacggtcacttacctggacactatggccatagtcttgagtttttctagtcagcatgtgattggttgtaccttaagtttatgacaccaaaaatactattaactctgttatttttgttcttaatcccatctcaaattagtttctagagttagaatcagaacacaaggatgctcattttcacatggagggaaagttgccaaagcatttaaaaaataaccccaaaagtatatctagcagtgaagcttggtagataaaggtgaactgctaaacagacactggcgtgccacactcctgccagggcagtctcattgtgtgtgacggtgctgcaacactgccagtattacttgagatgcagtctctctcccctgttctcagttcctgggctcagccctcctccaaggcctgccagtgagtagcagtttggaaggcaggccaagggagatccccaaagacagttatcagtcttaacttctgctgtctcccgtcaaatacttatacaggcccccatgggtaataggcaagcatgatggctgatagagaagtcagtgcatgagttactatcacatgtccccccaacccctcctgccacctcccagggctctggataattgaatcttcctgagtcccacagctggagactcaaccaggatatagctgtaaatgcccaagtagaatctgacagaataagacagagacactgaaaataaagccctagaaaggaagaaattggaagcaaagaaaaggagaggtgaaaagataaaaagcctccttcaaggttaggttcaggttctgttttccatttaacctcatgtgccataaagctgcccaggcacaccagagccacatcctgaacccgaccctccctgacagtgctgctctgccagtagcaagccccagatggaggaagctgggcccatttctggccacttccacccatttggagctttgccagaggagtcgtctatgccaataatatttctgcaacagcatattatattatttgaagattagtagatctttttgggggggtggggcaggggacagtttctatagatgaagaaccagtgttggttgtacagctgttgggggtcatctatcccatgtgaagctattctttttccaaatcttgttgtttctgcatttgtgtcctccaccactcccttcttggctgacatagatatgcctgccagattgtcatcaagggtcatatttcaataaaaggtgctaaggacaaaaaaaaatctcatgtgttttaactcaggtgatggaagtctaaagattctgctgaaaagtactggaaaggaatttggtcacctatccatagtccttcacagataaacatatgaccagacccttacccacatccctaaacccttaccctggcctctgagggatggtattgatgctataccattcatcatccccagttaaatagcaggatctgccatagcctttttaggggaacagcttttagacatctatttcaagaccatcctgagtagggggtacagagtttaagccattggttatttctgttgttatcacagtattgaagcatggtatttttctactcagaaggatctcaggatcacagccctgccctttagctcactgatatatttcttcctctctggttactcagtggcaacatcacatccagtctaaccccatgtttagaatgcagaaaaagtcaacaataggtgtaatctcaggtatagacctaagcagtatacagagtctagttctggagtctagcctgatcgaaggtaagccattctttctagacttcttccaatcttgaattctgtctagtattttcatcttacttctagctgatagtccaatctcacaccttcatgctcagctccctggaaagcaagggccttggtgatctgctctccaaggcaacctcaaagattagactcaaatgtattccaggaagcaactctgacattgaaaagctttcttttttcgtgatccatattctgttcacattccaactatcctccttctactcaagatatccattgtggtagagtagaaagagtccagctttggcattagaatgaactgtgttcaaatcctggttctgccacttattcaatgaacctgggctactagctcaacttctgaggtcattttcttatctgtaaaatgggaacagtattatcttgcttgcagttattgtaacttgaaaataataaataaaagccactaacaatccaagaagttattaggcagaatcccaggcccaccccaaacccagtgatagcagtctgaattttaactagatttccaggagattcatgaacatattacagcatgggaagtactgacttgttgaaaacatattcagtacatggtaaccattattatagtcctgatctactcaattcattttttccttatcccaggcatattcttgctcttctcgtgttgctcacaactacctgcctggatgaatttaggaaagttgcaggatacaaggttaaaacacaagatcaaatgaacaatccgaaaatgttattaagaaaacagttccggccgggcatggtggctcacgcctgaaatcccagcactttgggaggccgaggcaggtggatcacgaggtcaggagatcaagaccatcctggctaacacggtgaaaccctatctctactaaaaatacaaaaaattagccaggtgtggtggcacgcaccagtagtcccagctactcgggaggctgaggcaggagaattgcttgaacctggaaggcagagattgcagtgagctgagaccacaccactgcactccatcctgggcaacagagtgagactttgtctcaaaaagaaagaaagaaagaaagaaagaaagaaagaaagaaaagaaagaaagaaagaaagaaagaaaacagttccatttacaatagcat

SEQ ID NO: 4521 - DNA, 222655 bp, human; identical to SEQ ID NO: 4519

SEQ ID NO: 4522 - DNA, 222397 bp, human; identical to SEQ ID NO: 4520

SEQ ID NO: 4523 - DNA, 39518 bp, human
aaactgcagttgtaatccaggattcacgggcctgtaggggctcagacttcaaattgaaccgcgcctcggcggcagccacaggtgtaatacacgaggcccaggtaccagaaggtgtccagcagggccttggcggcgccctagcagctgaggtccagccgctgcgcgcccaggttcatctcattagtggacgccgcgggcccgcgagttcggagcagcgcgtgtatctgtgggtctttggggctggcctcgctagcctaccagcttcctttcggtgatgctctttgctaccgccaggctcctgaccccagcttggacagcaggccgccgagcgcccctgacgcccgttaccgagatggctgcgcagaaggtacagcaggggtgggggaggggagcaagcagaggagggatccctgggttgctcttggctgcgtggttgggtggcggttctccttcttactcggcccatggcatcctcagccatgaacataaatccggccaagtcgtggccccgcagcgtgggctgcgcggttgggtgtttggggggaggggagtttccggttctaagaacttactgggctgcttcttagtctgcactaccaagattggccacttgttgaaaatgggtccgggagacccttccctttatctcaaaatgacagctttactggtgtaacatgttggtaaactgtatttgcagccccttctcccaagaggtatttttacattgtccacacataggtatggagattgcctatgctgccgtccttgtgtgcgttggcattacataccagggtttccgtgctcatgctgttacatacctgccctgtaaccatggaaatgactccgaagttctctggttcccagtaatctcatattttaaaaaagggaataatatatcccagatgcaatggggagtttatttatttgaaatatttaatacagcagagaggaactggatatattatatatatgtatatatatacatattatttctaaacttttttttcaataagttttcagttttcgttggatgtatttttagtttttgtgccaagattcaggaagtgttctggttgctgggtgggtaaaagccaacataactcgatccttttcctcaagcatctcacagtcttgtgtggtagccagacacacagaaaaattacatgaaagggcttcaagtgaagaattgtaagtcgtttaggagtatgatgagaatgcatagagagacacaaagagaaaagctgcagactgagatggactggggatgaatggttaaagaagaaacaggaaacttgagagagctgtctccttgtaagtgtgaggctcatctgtttttgacaattccactaatctttgggttcacattcttggttctttcagggtaacccagaatgacatctatgcctttcatctgtaaaataacaacaacagtgggctctgggaacacagactaagactccttaaccacagccataggtaggtgggcaggatcagcataggctcctctcagaggacgtgattgtgaagcagatactattattatctcaatttacagaagagtcgtctgagagccagagagtttatgtaacttacccaaggtctcatagcaaggcagaggtggaaaccgttttcaactccaggtctgtctggccccagtgtctcatgcagttttcattaccttgagctcacccttagtgacaatgtcattcatttttattctcaaccgcatcttccaggcattgcttgcctcgggattgttttaaaaaaattgctgaatacagtgaagaaacgtattggaagacatcttccaaggaaaaaccctaaatactgatgctttattggaaacaatgacttaagtgataggaccaggattagaatgcaggtgtgtcgtatctgactccgaagcctatgtcattttcactgcatgtgttagtacataatattaaatcctcttttgttttttcttctctgtagtgatgctgaaaattgactaggattgggcaagatttttttttttgaggcggagtctcactttgttgcccaggctggagtgcagtggcacgatcttggctcattgcaacctccaccttccggattcaagcaatcgatccttgtacctcagcctcccaacttgctgggattacaggaatccaccagcatgccgggctaatttttgtatttttagtagagacggggtttcgccatgttggccaggctggtctcaaactcctgacctcaggtaatctgccggccttggcctcccaaaggagggattacaggtgtgagccaccatgcctggcctaagatttttgttttaagtagagttttagaatgatattttagttctcagaatttatttttcctacctcagctacactctagtttctttgtaaaaatatataaatgttctttatttgacatatataaattaatggtaacaactatcatttactcatccactgtatatgcttatagtacctttgaaataagtagtattatgatccccattttatgtgataataattgctaactttaataacgatttaacatttgcatagtgctattctatcaggtttcatcacaatttaatccttccagaagctctaagagaaatgaattattacaaagcttatttttcaaatgagagaactgaggcatagagagggtcagaaaatttcttatggtcacactagaagttagtaatgaagctgatatgaacccaggcaacctgaccctgaagtcttgtgtttctctctcccatttactgactcatacgtgcactatgagtcaattcactacatggaggaggacataggagcttggccaggcccctctgctatgaaattggcagcagagattcaaatccaggtatgtgtgattctaaatcacacataatctactccccttgttcctttccctcaaaatgattgccccttctattctatttcattgacactgtacagtgagaaggtgtttgttaaacacctacagtacagtgaggcttagagaggaaaatcagagaaatagttctgccctgaaagctctcacaatctggtgggagagacaaacacataggtaattttattagagtgttgtaaatgttatggtaaaggaagactttttggaagagatggcacttcagttatgtgtaaatggataagcagatggtttaagagatacgggggtaattcagacaaaaaagaattgtgtgagcaatggctcagaggttagaaatagaatggtgtatgggtgaagtggagctgcaaacacacgtgttaaatgtgaatggaaatggtgtagggagatgattttaatgagattagcaagagtaagattatgaggaaccttgaatgccatgctaaggactcaaagacatatatcatgtcacctctgttgtaaccttccttcccaattcctattcttggcatctcagaacttccagaggcttgatagaacagaatataagagaattatatttttggttcctagggggtagggtgaggaaggcatccagaaggagtgagccagcagacaggagagggtacaggtagggactacataatggaagggtttatatcagtgtgtcagagaaagaagattcaagaaagagattggtgatttactgaaatcctcattgctggcttcatccttattctgaagatcctacgatgcctggagaaattctaggcctcacatctggtgagtatgaaaggagtatgtgtgtgtacatatgtaagatagaatgaacctgaagctaagtctgatttctagatctagattggtgtagagtgaagaataattggctatagtggcataggaaccagacgatggggtgggggagagctaacttacatttaacatatctatatctatagttttctcattaagagcatgagactaaagataagtccagtgttcagaagggaattgtcagtatttgtttccatccctgaccaaccaaccatcttttgacttatgcattcttttagtagatatagtaagtcttggttgtgctctgatctggaagccagtcttaattttttcaagtaaagatacataaatttatgcaaatcataagtgtacaagctgatggtttttctttttttctttttttaatttttgtgggtacatattaggtatatatatttatggggtacatgaggtattttgatacaggaatacaatgcattgtattcaaatcagggaaaatagggtatccctcaccttaggcatttaccctttatttgtgttccaatcctattatactcttttagttatttaaaaatgtataatagttgactatagtcatcctgtactatcaaatctagatattattcattctgtctatgattttgtccctatttaccatcagcactcactcattcccacccactacccatctcagcctctggtaaccatcattctactctctatttcacaattgtttaagtttttagctcccataaataagcaagaacatgcaaagtttgtctttctgtgcctggcttattttacttcacataatgacctccagttctatccatggtgcaaatgacaggatctcattcttttttatggctgaatagtactccattgtgtatatgtaccacattttctttatccattcatctgttcatggacacttaggttgcttccagatcttggttactgtgaatagtgtagcaataaatatgggagtacagatatctccttgatatactaatttcctttctttggggtatatatctagcagtgggattgctggatcatatgatagttctatttttagtttattgaggaacttccacactgttcattatagtggttgtactaatttacattcccactaacagtgtatggtggttcttttttctccagatcctcgccagcatttgttattggctatcttttggggaaaaaaagccattttaactgagatgagatgatatctcattgtagttttgatttgcatatatctgataatcagtgatgttgggcaacttttcctatgcctgtttgccatttgtatgtgttcttttgagaaatgtctattcagatcttttgcccatttttcattggattattagactttttgccattgaagggtttgagctccttatatattctggttattaagctcttggcagatggatggtttgcaaatattttctcccattctgtgggttgtctcttcactttgttgattgtttcctttgctttgcagaagcttttgaacttgatgtgatcccatgtgtccatttttgctttggttgcctgtgctcgtggggtattattccagaaatctttgccagtccaatgtcctgggcagtttccccaatgttttctttcagtagtttcatagtccaaggtctcagttttaagtctgtgattcacgttgatttgattattgtatatggtgaaagataggggtctagttttattcttctccatatggatagtcagttttcctggcatcacttattgaagagactgtcctttcttcaatgtatactatgacacctttgttgaaaatgagttcactgtagatggatggagttatatctgggttctcccttttgttccatttgtctgtctgtttttatgtcagtaccatgctcttttggctactatatctctgtagtataatttgaagtcaggtaatataattcttcgagttttgttctttttttctcaggatagctttggctaattggggtctttagtgattccacataaattttaggattttttttctgtttctgtgaagaatgtcattggtattttgatagggattgcattgactctatagattgctttgggtactgtgaacattttaacctcattgattttttaatggacattgtccattttatggacatggaagatatttccatttttttgtgttctatttctttcatcaatgttttattgtttttattgtagagctctttcacttctttggtcaagttaattcctatgtatttaattttatttgcagttattgtaaatgcgattacttttaaaatttctttttctgattgtttgctgttggcatatatgagtgctacagatttttgtatattgatactgtttcttacaagtttactgaatttgtcagttttaacaggtcttggaagtctttaggtggagtctttaggtgtgtccaaatataagatcatatcatctgtaaacaaggataatttgatttcttcctttccaatttggatgccctttatttctttctcttgtctgattgcattagataggacttctggcacagtgttgaaagtgggcatcctttatcatgttccagttcttagaagaaaggcttttgctttttctttattcagtgtgatactagctgtgggtctgttgtatatggcttttattgtgttggggtatgttccttctatcctcaattttttgagggtttatatcatgaaggaatgtagaattataccaaatgcgttttcagcatcaaatgaaatgatcatatagattttgtccttcattctgttgatatgatgtatcccattgatttgatttgtgtgtgttgagtcatccttgcatccctgggataaatatcatttagtcatgataaatgatatttttaatgtgttgttgaatttggtttgctagcattttgttgaggatttttatataaatattcatcagagatactggcttatagttttctttcttttgatgagtcattgtctggttttggtatcagggtaatactgacttcatagaatgagtttggaaatattccctgctcctctattttcaggataggttgagtagaattggtattctattcttctttaaatgctttatctcattacttgttattggtctgttccgattttagatttcttcatggttcaatcttgaaaggttgtatgtgtctaggaatttatccatttctgctacatttactaattttttggcatataatttatcatagtagcctataatgatcctctgaatttctgaggtattggttataatgtctcctttttcatctctaattttatttatttgggtcctctctcttttattcttagtctggctgaaagttttttgattttgcttgtcttttcaagaaggcaactttttgttgatctttcatatgttttttatttcaatttcatttatttctgctctgatttttatttcttctaattttgggttttgcttgctcttttttagttctttaagatgcatcattacgttggtgatttgaaatttttctagttttttgatgtaggcacttatagctacaaactttcttcttagtacttctttcactgtatatcacaggttttgctgtgagatatgatctcatcccagttgaaatggctattgtcttttatttttaacttttattttaggttcattggtacctgtgcaggtttgttatataggtgaactcatgtcatgggggttttgtgtacagattatttcatcacccaggtactaagcacagtacctaataattattttttctgatcctctttcctcccaccttcctccctcaagtagggcccagtgtctgttgttcccttttatgtcaatttgttctcattatttagctctcacttataagcaagaacatatggtatttggttttctgttcttgcgttagtttgctaaggataatggcctccagatccatcaattgttcctgcaaagggcatgatatcattctttttgatggctgcatagtattccatggtatatgtgtaccacgctttctttatccagtctactgttgatgggtatttaggttgatttgatgtctttgctattgtgaatagtgctgcagtgaacatacacatacatgtgtcttcatggtagaaaaatttatattcctttgggtatatactcagtaattggattgttgaatcaaatgatagttctgttttagttctttgaggaattgccacactgtctttcacagtggtttcactaatttggactcccaccagcagtgtagaagtgtccctttttctctgcaacttaccagcatctgttattttttgacttttcaataatggccattctgactggtgtgagatgatatctcatgtggttttgatttgcatttctctaacaatcagtgatactgagtgtttttatttatgcttgttggctgcatgaaagtcttcttttgagaactgtctgttcatgtcctttgcccactttttaatgaggtttttttcttataaatttacgttccttatagattctggatattagacctttgtcagatgcatagtttgcaaacatcttgtcctattctgtaggttatttgttcactctgttgatagtttcttttgctgtacataaggtcatcagcttaattagaactcatttgtcaatttttcttttgttgcaattgcttttggtgtcttagtcatgaaatctttgccagttcctatccaggatggtattcctagctattttccagggtttttatagtttggggttttacatttaagtgtttagtccatcttgaattgatttttatatatggtgtaaggaaggggtccagtttcaatcttctgcatatagctagccagttatcccagcaccatgtgttgaataggaagtcctttccccattgcttgtttttgtcagttttactgaagattagatggttgtaggtgtgcagcattatttctggaatctctgttctgttccattggtctatgtgtctgtctgtttttgtaccagtaccatgccgttttgattactgtagccctgtagtatagtttgaagttggataatgtgatgcctccagctttgttctttttggttaggattgccttggctattcaggctctgttttgggttccatatgaattttaaaatagtttattctagttctgttaagaatgttgttgatagtttgataggaatagcattgaatctataaatttctttggacagtatggcctaaagttgctattatgaaaaagatgaaagataatgaatgctggcaaggatgcagataaaaggaaatacccattgatatggtttggctctgtgtccccacccaaatctcacctcgaattgtaatccccataatccccatgtgttaagggcgtgaccaggtggaggtaatcggatcatggggctgtttctgccatgctgttctcatgatagtgagtgaggctcacaagatctgatggtttctgtaagcgtctagcattttccctgcttgcactcactccatcctgctgccctgtgaagaaggtgcctgctgctcctttgccttctgccatgattgtaagtttcctgagcctccccagcaattcagaactgtgagtcaattaaacctctttcctttataaattacccagtctctggcagttccttatagcatcatgggaatggactaatacagtaaattggtaccaaggtagtggggcactgctataaggatacccaaaaatgtggaagtgactttggaactgggtaacaggcagaggttgaaacagtttggagggctcaaaagaagacaggaaaatgtgggaaagtttagaacttcctagagacttgtagggttcagaagacaggaagatgtaggaaaggacaacaaagtccaagctgaggtggtctcagatggagatgaggaacttgttgggaactggagcaaagatgactcttcctatgctttagcaaagagggcggtggcattttgcacctgccctagagatctgtggaactttgagatggatgatttagggtatctggcagaacaaatttctaagttgcaaagcattcaagaggaagcagagcataaaagtttggaaaatttgtagcctaactatgcaatagaaaagaaaaacccattttctggggagaaattcaagctcactgcagaaatttgcataagtaaccaggagccaaaggttaatcaccaagacaatggggaaaatgtctccagggcatatcagagaacttcagggcagcccctcccatcacaggcccagaggcctaggagggaaaatggtttcctgggccggtcccactgcccccctgccctatgcagcttcatgacatggtgtcctgtgtcccagctgcttcagctccaaccatggctaaaagcagccaaggtaaagctcaggtcattgcttcagagggtgcaagccccaagccttggcaggttccacatggtgttgagcccatgggtgcacaaaagtcaagaattaaggtttgggaacctctgcctagacttcagaggatatatggaaacacctggatgtctaggcagaagtttgctggaggagtgaatccctcatggcgaacctctggtagggcagtgcagaaggcaaatgtggggtcagaaccccccccacagagtccccactggggcactgcctagtggatctgtgagaagagggtcactgtcctccagacccctgaatggtagatccaccaacagcttgtactgtgcagttagaaaagtggcagacactcaacatcagcccacaaaagcagctgggagtggggctgtaccctgcagagccacgggcagaactgcccaagaccacaggagccaccttacatcagcttgacctgcatgtgagacatggagtcaaaggagatcattttggaactttaaggtttaatgactgccctgttagattttggacttgcatggggcctgttgcccctttgttttgacctatgtctcccatttggaacaggtgtatttactcaatgcctgtacctccattgtatctaggaagtaactaacatgcttttgattttacagattcataggcagaagagatttgccttgtcttagatgagactttggactgtggacttctgtgttaatgctgaaataagatttttggggagtgttgggaaggcatgattggttttgaaatatgaaaagacatgatatttgggaggtgtcagagggggcggtggaatgatatggtttggctctatgtccccacccaaatctcaccttgaattgtaattatcataatccccacatgtcaagggtgtgatcacacagagataatcggatcatggaggcagtttccccatgctgttgttatgatagtgagtgagtctcatgagatctgatcgttttataagtgtctggcatttcctctgcttgcactcactctgttctgcccccccgtgaagaaagtgcccacttctcctttgccttctgccatgattgtaagtttcctgaaacctccccagcaatgcagaactgtgagtcagttaaacctcttttctttataaattacccagtcttgggcagttctttatagcagcatgagaacggactaaaacactcaaatactgttagtgggaatgtaaatttgtacaaccactgggatgaacaatttggtagttcctcaaaaagatgaaaatagaactatcattttatccagcaatctctccgctgggtatatatcccaaagtagagaaatcagtatatcaaagagatatctggattcccacatttaatgcagcactattcacaatagtcaagatttggaagcaacctaagtgcccctcaacaaatgaatgaataaaaaatatggaatctccatataatgtaatattacttagctaggaaacagaaagaaattctgtcatttgtagcaacataagtgaaacttgaggtcattatgttaagtgaaataagccatgtgcagaaaagcaaatattacatgttctcacttatatatgggaccttaaaaagtagatgtcatagacatagagagtagaatagtgtatactacaggctgggaagggtagaagagagggggatgaagagaagtgggttaatagatacaaacatattgttatatagaaggaatacattctattatttgatagtatagcagagagattatagttaatgatgatttgttatacatttcaaaatagctagaagagaactgtaatgtccctaacacaaggaaaagataaatgttagagatgatggatatcccagttaccctgatttaattatgcatcatatacatatatcaaaatatcacatgtacccctaaaatatgtaatatgtacaactattgtatatcaattccatttattttaatttttaaaacttgtgtacacttttttaaattaaaaaataatttcaacttttattttagattcagagggtacatgtactggtttcttacatggatgtattgtgtgatgctgaggtttggggtatgactgatcccatcacccagatattgagcatagtatgtaatagtctttcatcccttcgcctccttccccccgactacttctccctgagtgcttgccagtgtctattgttgccatctttatgtccgtgtgtattcagtgtttagcttccacttataagtgagaaaatgtggtatttggttttctgttcctgtgttaattcacttaggataatggccaccagctgcatccatgctgctgcaaaatacatgatagtgttcttttgtatggctccctagtattccaggtgtatgtgtaccacattttctttatccagtccactgctgatgggcacctaagctgattccatgtctttgctagtgtgaatagcgctgcaatgaacataccagtgcatgtgtctttctggtagaatgatttattttggatatatactcagcaatgtgattgatgggttgaatggtagttctaagttctttgagaaatctctaaactgccttacacagtggctgaactaatttacattcccactaacagtgtgtaagcattcccttttctccacagcattgctagcatctgttgtttttgactttttagtaatagccattctggctgattgtggttttgatttgcatttccctgatgattagtgatatggagcaatggagttatttatgttttgtttattaaattgtttaagttccttatagattctggagattagacccttgttggatgcacagtttgcaaatattttcataccttctgtaggctgtctctttactctgttgatagtttcttttgctgtgcagaaactctttagtttaattaggtcccacttgtcaatttttgtttttgttcccatggcttttgaggatttagtcataaattctttcccaaggctaatatccagaatgatgtttcctaggttttcttctatgattataatagttttgaggtcttacatttaaatctttaatgcatcttgagttaatttttgtatatggtgaaaggtaggagtccactttcatttttctgcatatagctatacagtatccaagcaccatttattgaatcaggagtcttttcctcattgcttatttttgccaactttgctgaaaatcaaatggctattggtgtgtggctttatttctgggttctttattctgtttcattggtttatgtgctgttcttgtaccagtgccatgctcttttggttactctagccctataacagtttgaagtcagataatgtgatgcccacagctttgctcttttttcttagctttggctatttgggctcttttttttggttccgtatgaattttagaatggtgttttctaattctgtgaaaaaaaatggctttcataacttgacaggaatagcgttgaatctgtagattgctttgagcagtattatggttattttaatgataatgattcttccactccatgagcatcagtgtttttctatttgtttgtgtcacctatgatttctttcagcagcattttgtagttatccttgtagagatcttttgctttcttggtgagctgtattccttggtattttattttttgtggctattgtaaattcaattgtattcttgatttggctcacagcttgaatggtcttgatgtatagaaatgctactgatttttgtgcactgattttgtatctggaaacattactgaagtcacttatcagttctaggagccttttggtggagtctttagggttttctaggtatagaatcatgttatcagtgaagagagatagtttgaattcttcttttcttatttggatggcttttatttctttctcttgcttgtttgctgtggctaggacttccagtactatactgaataggagtggtaagagtgggcatccttgtcttgttcaagttactaaggggaatgcttccagctttagcccattcagtatgatatttggtgtgggtatggcatagatggctcttattattttgcagtatgttgctttgatgtctaatatgttgttttgggtttttatcatgaagggatgttggattttatcaaaagctttttctccatctgttgagatgatcatatgatttttgtttttaattctgtttatgtggtgaatcacatttattgatttgcatatgttgatccaaccttgcatcccaggaatgaagcctagttgatcatggtgaattggatttttgatatgctgctgaatttggtttgctagtattttgttaaggatttttgcatttgtgtttatcagggatattttggtttgtagttttcttttttcattgttttttttttttttgccaggttttggtatcatggtatgctggctttgtagaatgagttaaggaggaagtgaggagcttgagagagatatctctttaaaaatcatgaaaaagaacagagtatagtggctgacacatggcagacatgcaataagaaactgctgtttaaaaatttttaatagtggtgagatacacatgacatctaccatcttaaacattttaaagtgtacagttcaatagttttacgtatatttccattgttatgcaatcagtttccaggaatttttcatcttgcaaaacgtaaactctatacccattaaacaacacctcatttctcatttctccctcagccccgacaaacacctttctactttttgtttctatgagtttgactattctggttgcctcatataagtggaatcatacagtatttcactttttgtgattggcttgtttcatttagcataatatcttcaaatttcatccatgttataacatgtcagaatttctgtccttttaatggctgataatatttccttgaatgtatataccacattttgtttatccattaattcactgaaagaaacttgggttgcttctacctcctgactattgtgaataatgctgctataaacatgggtgtgcaaatctctaagaccatgcttgaaattctttttttcaaaacttatatatatttaaggcatacaacatgttttgatataaatatattgttaagttattactgtgttcaagttgtttaacatatctatcctagtctctcaaagttaccttttgtgtattggggtaagaacacctaaaatctactctcttagcaaattgccagtatgcactacagtattattaactataatcattatgctgtatgttagatctctagacttattcatcctaagtaactgcaactttgtgccctttaaactacatctcccagttcctccctccacccctacccctgcctctggtaaccacttttctactctgtttctatgtattcagtctttaaacaagttttttttaagatgaaagagagattattctgctttacatcctttgggatacatacccagaagtaaaattgcaggatcatatggtaattccgttcttaaaatgaactgccatgttgttttccacagcagcttcaccattttacattcccaccaaaagtgtacaagatttcagatttttaaaaataatcttgtcaacacatattgttttctgtttgttttttgttttgtattagccattctaatgtatgtaaggtgctgtctcatcatggttttgatttacatttttctgatacaaaaagatgttgagcatatttcatgtgtttattgcccatttgtatatcatctttagggaaatgtctattgaagtcctttgcctatttttcacttggattgctttttgttgttgagttgtagaagttctttttaaaccccttatcagatatatgatttgcaaatatattcgcccattctatggattgtcttttaatttattatattttttcatgcacagaagttttaaattttaatgtagtccgatttctctgttttttttttaattttttaattttttttttttttttgagacggagtctcccaggttcacgccattctcctgcctcagcctctggagtagctgggactacaggtaccagccaccacgcccagctaattttttgtatttttagtagagacggggtttcactgtgttagccaggatggtctcgatctcctgacctcgtgatccacctgcctcggcctcccaaagtgctgggattacaggcgtgagccaccgtgcctggccagtttatctgttttttacttttgttgcctgtgcttttgatgtcatatgtaagaagtcattgacaaattcaatgtcataaaattttcccctatgtcttcttctgtgagttttagttgtttttcttgtttagttttttgatatattttcaactaatttttgtatgtgagttaaggcaagggttcaacttcattcttttgcatgtggatatgaagttgtccagacgctatttgttgaagagagaaagttattaagtatttcattatttttgaaataataaacaaatatttatttttgaaacaaataaaattgttttctcaatttccttttcagattattcattgttagtatgtagaaatgcaactggattttgtgtgttgattgtgtgtggattttgtatcctgcaactttgctgaattcgtttattataacagctttttttggtgtggactctatagggttttctacatatgaaatcatgctatctgtgaatagaagtaattttacttctctttttccaatttgtatgccctttatttcttttttgcttaattcttatggccaggacctcaagaattatattgaatagaaatggtgaaactaagaaaccttgttttgtttctgatattagaagaaaagatttcaatcttccaccatttagtatgatgttagctgtgggctttgcatatatggtctttattatgttaggaaatttccttctatttctagtttgttgagagttttttccatgaaaagttactgaattttgtcaaatgctttttctacatcaactgagatgatcatgtggggtttttttccttcagtctgttaatgtgatatattactttgatttttgcatgttgaactatttttgcattccaagaaaaatatccctctgggtcatggtgtataatctttttaatgtactgatgaaatctcttttctagtattttgttgagaatttttgcattaatgttcatccgagatattgtgcagtagttctttctgatggtagtgcctttgtctggctttagtatcaggataatgctggtctcagaatgactgtagaagtgttcctcctttaatttttatggaagagtttcagaaggaatggtactaattcttcttttagctgtttggtagaattcagcagtgaagcattccggtccaggggttttggttatttattactgatgtaatccccttactagttataagtctgttcaaattttctacttcttctggattcagttctggcaatttgtctgtttctaggaatttatccatttcatttaggtcatcatagtggtgtgcaattatactatgtcttaataatgctttttaattctgcaaaatcatttgtaatgtcctttcatttctgcttttagttatttgagttattagttatttagttatttgtctcttttcttcttaatctagctaaatatacgtcagtcacatagatcttttcaaagaaccaactattggcgtcattgtttttccctactttttatattctctatgttaatgatttctgctctaatatttatttttatttatttctgctagctttggttaagcttgttatttttctagttctttaaggtgtaaggttaggttatagatgagatatcttttttcttttttaatgttagcatttacaggtatattttccctcttagcactactaagataaaactgaatttccatacccaacccaccccattctagctctttgattattttaattgatttcaagtttgtagccttaattctgggaatataaatttgagagaccacaagtgctatttggagatttggttgagagagcagctttcccccctccacgggtatgggaatcagtgtctataatttgaaaatgcagattctaggtttttggtagtaataggggttagaagatggagggatttagcttctccaataaaaattcaaatagacccacaaaaacctcatctaaactttaaaaaataccctttaaaaccagaagctttggaaggaataagactcatagttctagactatataaaaaggggtctgattattctctgtacatacccatgtaatactccaattcttcctgtaagaaatgcaaatgatagagcatggaggtttgtacagggtgtgagagcaattaacaatataatcattcctcaccatctggtagttctaaagccccatacatttttgactgctatccttacctaatgtgaatcattactgtgattaagttatatagtgcattatttagtattcctatggataaagacattcaatttctctttgccttcacttgggaagacaaacaacacatttggaaactcatgccttagggatacactgaatgcccaacttacttttaaaaaatattagaagcagatctctcagatattgacttccttaagaaatccattttaatacaatacatagatgatttgcttctcagttcagaggataaagaagcctctatagaagatgggattcacttattacaacaattagccttaaaggaatgcaaggtgtcaaaggaaaaacttcagttttgtcaaaaacaggtaagatatttgggtcatctaatatcaagggaaggtctttttatctaccaggatagaataaaagaaatattggccttcctatcccccaaactaagaaacaaccaagaggatttgggggactggcagtatactgtagaaattggattccaagcttaaaaaaaaacaactcaacatctatatactcttttaaagaaacacaagccagatcccctggaatggactgaggaaaattcgttaactttggaagagattacaaagagccttataaataccccagcatctatattccatttcattgtttgtccataaaaataagggaaatgctttaggtgttatgtcacaaaaacactgagaccaaaatagacttacaggatactgtagtcagcaagtggatgccatggctaaaagattgccacactgcctgaagagagtaactgccactgctcttttagtaaaaaaacaaaaaaaaccctgaaaaaatggcgatgggattcccctcactgtcttcattccatattctgtggaagcacttctaaattcaaaccacactcaacattattctgtcagcagactagctttttatgtagttcttctttttgtacctcaccttacaagctctaggtgcaataatataaaccctgccacccttctgcctctaccttcagatgagatgctgcatgattgcgtaatcttaactgacaagcttatctcttctagaacactcctgcaggagactacccttactaacactgatgttgtttggtttatagatggaccttagttaaaagatgaatctgggacttactgtgcaggctatacaggagtatatttaactgaagaaatggaaagtgcttcccttccagaagccacctcagctcaacaagtagaattgatagcattaatcagggcctgtcaattggtgaaaaaaaatgctaatattcatacaaacagcagatattcttttagagtagctaataattttggaatgctatggaagcaaagaggatttttaacttctagtcagcccataaaaaattgatatcttatttcacaatgattagaagccatattattacccaaatcactggccattattaaaattctaggtcattccaaatcagatactccagaaagcaaaggaaatcagctagctgataaggtaacactaagagatgctctaaatgcatctaaacaagaaaagcaatttatattaactttaaaataagcaccccaaaaaagagaataactttttttaaaagcacctgaatttgacataaaatgaactaaatctagagctccaaaatccaaacaggaaagttggaaaacaaaaggaggaacatactctcccaaagattagatacggtaggggtcaaaaaacttgcctatacttcctgctgaattgtggtcatcatttttacctatgtacgtgatttcactcattggagccctgataaagtggttgcttgtggaaaataatatttttggaaactttctctgactataggtcatgaggcatacaatcgctgccatatctgcccaaaatagaatccaggaaaacttttacacagttcccaaggacattttcctttatttgtaggcccctttgaagtatggcaatgaaattttatttagctgccactatcacaaggatacaattctgttctactgatgatttgcatgttttcttgttgaatagaagcattttccattcagaaaagaaatggacttagtagcaagtaaaattctcttagaaaaaattattccaacgtggggagttcctatggaatttcagagcaacagaggcactcacttcactggacagataattcaatcaatatgtaaaatttgacccatcctcaagcacttttattgtgcatatcatttccaaccatctggactggtggaatgtacaaatggaataattaagactcaattggcaaaaataacagaagttcttaagattccatggctgaatgcactttccttggttttgcttaacctaagatcagccccttttggaaaacaacagttatccctatttgaaataacaactggaagacctatgagtctaccccaggacattgtaactccataattgcaaggggagacatatttattgttctaaccttattaattaactaaaaaattataatctagtgaaagattatttttatagtgggctcctaggaaataaagaattcaagacccacaatttttaaccaggagattttgtctactggaaatggcatctttttaaaaaaattttgtgggtacatagtagatatacatacttatggggtacctgagatgttttgatccagacatgcaatatacaataagcacatcatggagaatggggtatccatcccctcaagcatttatcctttgagtaacaaactatccaagtatactctttaagattttaaaatgtacaattaatattgactatagtcaccctattgtgctatcaaatagtaggtcttctactttctttctattttttgtacccataaaccatccccacccccataccctcactacccttcccggcctccagtaaccatccttctactgtctatctccatgagttcaattgttttgatttttagatcccacaaataagtgagaacatgtgatgttggtctttctgggtctggcttatttaatttatcacaatgatctccagttctatccaggttattgcaaatcactggatctcattcttttttatggctgaatattactccattgagtatatgtaccacatctttatccattcatctgttgacgaacacttgggttgcttccaaatcttagcaattgtaaagtgctgcaacaaatataggagtgcaggtatctcttccatatactgatttcctttcttttgggtatataccagcagtgggattgctggatcatatggtacctcaatttttgtttttgaggtacctccaaaccattgtccatagtggttgtactaatttacattcccaccaacagtgtacaaaggttcccttttctccacatccttgccagcttttgttattgcctgtcttttgtatataagtcattgtaactgtggtgagatgatatctgattgtcgttttgattcgcagttctctgatgatcagtgatgttgggcaccttttcatatgcctgtttgccatttgtatgtcttttgagaagtgtctattcaaatcttttccccattttatgataggattattagttttttttttccattagagttgtttgagctcattatatgttctggttagtaatcccttgtgagatgggtagtttgcaaatattttctcccactcggcaggttgtcttttaacattgttgattgtatcatttgatgtgcagaagctttttaacttgatgtgatcctatttgtccatttttgctttagttgcctgtgcttgtggggtattgttcaagaaatttttgcccagaccaatatcttggagatttttcccaatgttttcttgtagtagtttcacagtttcaggtcttagatttaagtcttcaatccatcttaacttgatttttgtatatggagagagagagagatagggtctagtttcattcttgtgcatatggatatccagttttcccagaaccatttattgaagagactgtgttttccccagtgtatgttcttgacacctttatcaaaactgagttcattgtaggtgtgtggacttgtttctgggttctctattctgttccattggtctatgtgtctgtctttatgctagtaccatgcttttttggttactgtatctctgtagtataatttgaagtaaggtaatgtgcttcctccagttttgttctttttgcttaggatagctttggctattctgggtcttttatggttccacataaattttaggaatgctctttctattcctgtgaagaatgtcatgggtagtttggtagggattgcattgagtctgtagattgctttagtggcatggacaatattaattcttccaataacaatattgatttttccaatctatgaacatgaaatatttttccattttctggtgatttcttcaatttctttcatcagtgttttatacttttctttaaagagatctttcttttctctgtttaattcctagctttttaattttatgtgtggctattgtggctatgggcatatggaaatgctactgattttgcatgttgatattgtatcctacaactttactgaatttgtttatcagttctaatagttttcttgtggagtatttaggtatttccaaatataagctcatataatctgtaaacaaagataatttgattttttttttcttttcaaccatgtgccctttatttctcttgtctgattgctctaggtaggacttccagtactatgctgaataacagcagtgacactgagcatccttgttgtgttccagatcttagaggaaaggctttcagtttttcctcattcagtatgatactagctgtgggtctttcatatatggcttttactatgttgatatatgttccttctataaccagttttttaagggtttttatcatgaagggatgctggattttatcaaatgctttttcagcatcaattgaaatgatcatatggtttttgtccttcattctgttgatatgatggatcgcactgattgatttgcatatgttgaaccatccttgcgtcccaggaataaatcccacttgatcatgatgaatgatctttctaatgtttgttgaattcagtttgctagtattttgttgagatttttgcatcaatattcctcagagatgatgtcctgtagttttctttttttgatgtgtctttgtctggttttggtatcagggtaatactggcttcgtggaatgagtttggaagtgttccttcatcttctattttccagaaaagtttaagtaggatttgtattaatgttggattcagcagtcaagccagcagctcctggatttttcttttctgggagactttttattacagctttgatctcattacttgttatttgtctgttcaggttttggattttttcctggttcaatcttggtaggttgtatgtatctaggaatttgtccatttcttctagattttccaatttattggtatatagttgttcatagtagccactaatgatcctttaatttctgtagtatcagttataatgtcttctttttcatttttcattttatttattagtatattctttctttctttgtctggctaaagatttgctaattttgtttaactttccagaaaaccaacttttgtttcattgatcttttgtcttgttttcttcatttcaatttcatttattgctgctcagaccttttgatttattttcttccattaattttgggcttggtttgctctggctttctagattttctaagatgtatcgttttctcatttgaaggttttcttcttttttgatgtggcccttatagctatgaacttcccttttctactgcttttgctgtatcccataggttttggtatgttgtatttccattaacatttgtttccagatatttttcaatttccttcttaatttctttattgacccattagtcattgaggagcatattgtttaatttccatgtatttgtatagtttccaaaatttctctattattaatttctagttttattcaattgtggtaagatgcttgatatttttcaattttttgaatgttttaagacttgttttgtgacctatcatatggctcattcttgagaatattccatgttctgaggaaaagaaggtgtattccccagctcttggatgaaatgttctataaatatatattagatctgcagctcttggataaaatgtcttgtaaatatatattgtatacatttggtctatagtgcagattaagtctgatgtttctttgttgattttctgtctggaagatctgtttaatgctgaaagtggggtgctgaagactccagctatgattacattggggctgaactctctctttagctctaatagattttcctttatatatctggatgctccagtgttgggggcatatatatttaagactgtcatattctctagctgaactgacccctttatcattacacgctgaccttctttgtcttttctaatagtttttgtcttgaaatctattttgcctgatataaatatagctattcctgctcttgttttccattggcatggaatatctttttctctccctttattttcagtctatatgtgtttttataggtgaagtatgttttttgaggataacagatcaatgggtcttgtttttcatccattcaaccagtctatgtcttttgatgtgagagtttagtccatttatattcaatgttattattgataagtaaagacgtctgccattttgatatttgttttctggccttttcttccttctttccttcctgtcttcctctagtgaaggtgattttctctggtgatacgatttagtttcttgctttttatttttggtgtatccattgtatgttttttggtttgagattaccatgaggcttgcaaatactatcttataacccattattttaacctgataaaaacttaacactatttgcataaacaatcaaacataaactaataaaactttacaccttaactttgttcctctgctgtttaactttttgctgtttctatttatatcttattgtacttcctatgtcttgaaaaactttgttgtagttattttaattggtttattgtttagtctttctacttgggataagagtagtttacacaccatagttacaatgttataatattctgtgtttttctgtgtacttactgttaccaatgagttttgtagcttcaggtgattattgctcattaatattcttttctttctgattcaagtccttgctttagcatttcttataggacatgtctgatgttcatgaaatccctcagcttttgtttgtccaggaaattctttatttctccttcatgtttcaaagatatttttgtcagatatactattctagggtaaaatatttttttcttcagcgctttaaatatggcatgtcactctctcctggcctataaggtttccactgaaaagtctgctgtcagatgtatttgagctctgttgtatgttacttgtttcctttctcttgcttcttttacgattctttcttttttccttgacctttgggattttgattgttaaatgccttaaggtagtcttctttgggttacatctgcttggtgttctataaccttcttgtacttggatattgatatgtttccctaggtttgggaagtttaatctctttgaataaactttctacccctatttctctacctcttctgtagggccaatatctcttagattttcccttttgatgctattttctagattttgtaggcatgcttcattgttttttattcttttttcttttgtctcctctatgtattttcaaacagcctatcttcaagctcattaattctttcttctgcttgatccattctgttaaaggattataatgcatttttcagtatgacaatggcatttttttcagctccagaatttctgcttctttttaattatttcaatgtctttgtcaaatgtatcagatagaattctgaattaattctttgtgttatctgaatttctcgaagtttcctccaaacagccattttgaattatcttcctgaaacgtcacatatctctttttctctaggactggtccctggtgccttatttagttcgtttggtgagatcatgttttcctggatggtgttgatgctagtaaaataaaggttcttcagtgtctgggcattgaagagtaggtatttatcatagtcttcaccgtctgggcttatttgtagccatccttcttgggaaggctttctagatatttgaaaggacttgggattgtgatctaacctgtatctgctttagtggggcatgccaagcccaataacactgtggttcttacagactcatagaagtatcactttgatggttttgcacaagatccaagtgaattctctggattaccaggcagagactcctattctcttctgttaatttctcccaaacatacagagtctctctctgtctgttctgtgccacttaaagctgggggtggagtgacccaggcaccctgtggccactactaccactaggactgtactgggtgagacctgaagccagcaaagttctgggtcttgctcaaggcctgctgtaaccactccctgactactgcctctgttcattcaaggccctggggctctacaatcagcaggtagcaaagccagccaggcgtgtggtgtgtccttcccttcaggacataaaagtcccccaggctttgggagggtccataagtgatgtcagggagtcagagactagagtcaaaaaccttagacatctacctggtattctattatattgcagctgagctggcacttcaaccgcaagacgcaattcttccctttcttccctcagaggagccttaccctgtagccaccaccacccccggccatgaggagtactgccagactaccactgatgtccccctaaggcccgtggtcttgtaagtcagcatgttgtgaatgctgcctggcctggaactcacccttcagggaagtgagctacattctggctcagggcaggtccagaaatgccatttaagcatcaagtcctggaatcagggacatcaagagccgacttggtgctctaccccactgtggctgtgctggtacctggagccagcagatgtcagaggctcacccaaggcctttgatgtggtacctgggtatcactactggttattcatggcccaaggtctcttcagttagtaggtgatgaatgctgccaggactgggtccttttcttcaaggcagtgggttctttactggcccaggttatgtctataaatgttctccaggagctagggtctgcaatgggggcctcacagctctgactggtgccctttactgctgtggctgagctggtatcccagatgtaagacaaagtcctacccacgcttccctctcctcttctcgaatgaagaaaggagtctgttttgtagccatgactgtgcatcttgggggtaggggagggatgatatcagcacttcttggctgccctaactcctcgtgtctcagtaggtcgagtccccccacccctactgactagtccactgtttttgaccctagttcagccctaggactggcctctcccctaagagtttcactccttatggcctagagtgcttgtcacatttacttggagacacagagtggtgtagcccttggtggtgaggtctgtaggcattcaagttcagacttctggaatgggtgattcccctctggctagggctggcttaaatgctccctccgtggagaagcatcagctctatttggtctaattttccattctgctgtaacaggacagtactgaattcaatgcctcaaaactgttgtgttgtttctcttccagcacccagagaagctctgcaccactctgtcattgctggggtaggggaggggtagtgttggcgattcaggactgctttttctatctcttcagtgcctctttcagtgatacgaagttaaaacaaggtactatatgtactcacctgattttcgattcttatgaaggtggtttttttttttttttcctgtgtaaatagttgttagccttgtgtccttgctggtggtggtgggtaaggtgggggagcaatcaggcagctttctatccagccatcttgctccaccttctccccagcattttttttaattacttctaaaaaaaaaaagggatacatgtgcagaacatgcagatttgttacaaaggtatatgtgtgccatggtggtttgctgcaccagttgacccgtcctctaaattccctccctttgccccctgccccccagcaggccctcgtgtgtcccctgtctgtgtccgtatgttctcaatgttcaagtcccacttataagcgagaacatatgctgtttcgttttctgttactgagttagtttgctgaggatgatggcttccagcttcatccatgtccctgcaaaagatatgatctcattcctttttatggctgcagagtattccatggtgtatgtgtaccacattttctttagtctatcattgatgggcatttgggttggttccatgtctttgctattgtaaatagtgctgcaataaacatacgtgtgcatgtgactttatagtagaatgatttttattcctttggatatatacccattaatgggattgttgggtcaaatggtatttccggttctagacccttgaggaattgccatactgtcttccacaatggttgaactaatttacattcccaccaacagtgtaaaagcgttccaatttctccacagccttgcagcatctattgtttcttgactttttaataattgccattctgactggcgtgagatggtatgtcattgtggttttgatttgcatttctctgatgatcagtgaagttgagctttttttcatatgtttcttggccacgtaaatgtcttcttttgagaagtgtctgttcatatcatttgctcactttttgatggggttgtttttttcttgctaatatgtttaagttccttgtaaattctggctattagaactttgtcagatcggtagactgccaaaattttctcattctgtaggttgcctgttcactctgatgataatttcttttgctgtgcagcagctctttagtttaattaaatcccattttcaaatttggcttttgttgccattgcttttggtgtttttgtcatgaagtctttgcacacgcctatgtcctgaatgacattgcctaggttttcttctagggtttttatggttttgggttttacatttaagtctaaatccatcttgagttaatttttgaataaggtgtaaggaaggggtccaggttcagttttctgcatatggctagccagttttcccagcaccatttactgaataggacatcctttccccattgcttgtttttgtcaggtttgttgaagatcagatggttgtagatgtgtggtattatttctgaggtctctgttctgctccattggtctatatgtctgttttgataccagtaccatgccattttggtttccatagccttgtagtatagtttgaagtcaggcagcgtgatgtctccagctttgttctttttgcttaggattgtcttgtctatacagggtcttctttgatttgatatgaaatttaaaatagttttttctaatcctgtgaagaatgtcaatggtagtttgggaataacactgaatctgtaaattactttgggctgtatggccattttcacgatattgattcttcctgtccatgaggatggaatgttttcccatttgtttgtgttctctcttatttccttgagcagtggtttgtagttctccttgaagaggtccttcacatcccttgttagctgtattcttaggtattttattctctttgtagtgattgtgaatcagagttcattcatgatttggcgctctgcttgcctattgttggtataaaggaaggcttgtgatttttccacattgattttgtatcctgtgactttgctcaagttgcttatcagttcaagaagtttttgggccaagatgattgggttttattaatataaaatcatttggattttatattatatatatatataatataaattcatctggaaacagaaacatcttgacttcctctcttcctatttgaataccctttatttctttctcttgcctgattgcccttgccagaacttgcaatatagtgtggaataggagtggtgagagatggcatccttgtcttgtaccagttttcaaagggaatgcttccagcttttgcccattcaatatgatattggctgtgacttgtcataaatggctcttattattttgagatatgttccatcagtacctagtttactgagagtttttaacatgaaggaatgtcgacttttatcaaaggccttttctacatctattgagataatcatgtagtttttctctttggttctatttgtgtgatggattatgtttattgatttgcatatgttgaaccagccttgcatcccaggggtaaagctgacttgatcgtggtggataagctttttgatgtgctgctggattcagtttgccagtgttttattgagtattttcacatcaatgttcatcagggatattgacctgaagttttcattttttgttgtctcttcccagtttttgtatcaggatgaagctggcttcataaaatgagttagggaggagtccctccttttcaattgtttggaataatttcagaaggaatggtaccagcacctttatgtatttctggtagaattcagctgtgaatccgtctatctagtcctgggcttttttttttttcaggttggtaggttattaattactgcctcagtttcagagcttgttattggtctatacagggattcagcttcttcttggtttagtctcagtagggtgtatgcatccaggaatttatccatttcttctagattttctagtttatttgtgtagaagtgtttatagtattctctgatggtagtttatatttctgtggggtcagtggtgatatccccttaatcattttttaatgtatctatttgattcttctctctcttcttattagtctagctagtggtctatctattttgttaattttttcagaaaaccagctcctggattcattgaatttttttttggagggttttttgtgtgtctgtttccttcaattcttctctgctcttagttatttcttgtcttctgctagcttttggattagtttgctcttgcctctctagctcttttaattgtgatgttagggtgctgatttgagatctttctagctttctgatatgggcatttagtgctataaatttccctcttaacactgctttagctgtgccccagagattctggtacattgtctctttgttctcattggtttcaaagaacttcttgatttttgccttaattttattatttacccaggagtcattcaggagcaggttgttcaatctccatgaaattgtgtgattttgagtgagtttcttaatcctgagttctaatttgattgcactgtggtctgagagactgtttgttatgatttccgttcttttgcatttgctgaggagtgtttttcttccaattatgtgggtgattttagaataagtgccatgtggcactgagaataatgtacaatctactgatttggggtggagatttctgtagacatctactaggtccacttgatccagagctgagttcaagtcctgaatatccttgttaattttctgtcttgttgatctgtctaatactgacagtggggtgtcaaagtctcccactattattgtgtgggattcctagtctctttgttggtctccaagaacttgttttatgaatctgggtgctcctgtgttgggtgcatatatattgagaatagttagctcttcttgttgaattgttccctttaccattatgtaatgctgttctttgtcttttttgatctttgctggtttaaagtctgttttgtcagagactaggactgcaacccctgctttttctttttttgctttccatttacttggtaaattttcctccatccctttattttgagcctgtgtgtgtctttgcatgtaagatgggtctcctgaatatagcacacccatgggtcttgactgcatatccaatttttcagtctgtgtattttaattgtggcatttaacccatttacatttaaagttagtattcttatgtgtgaatttgatcctgtcatcatgatgctgtatggttattttgcacacctagttgatgcagtttctttgtagtgtcattggtctttatattttggtatgtttttgcagtggctggtacaggtgtttcctttcaatatttagtgctcctttcaggagcttttgcagggcaggcctggtagtaacaatatccatcagcatttgcttgtctggaaaggattttacttctcctttgcttacaaagcttagcttggctggatatgagattctgggtcggaaattcttttctttaagagtgttgaatattggcccccagtctcttctggcttgtagagtttctggtgagagttctgctgttagtctgatgggctttcctttgtaggtgacctggtctttctctctcgctgcccttaacatttttttcttcatttcaaccttggagaatctgatgattatttgtcttgggttgatcttcttgttgagtatcttaatggtgttctctgtatttcctgaatttgcatgttggcctgtcttgctaggttggggaagttctggatagtatcttgaagtgtattttccagcttgtttacattctccctgtctgtttctggtactccaatcaattgtaggtttggtgttttatgaagtcctatatttcctggaggctttgttcattccttttcattttttttttctcaagtcttgtctgcatggcttatttcagtaaggtggtcttcacactcttatatcctttcttccactctgttgattcagctgttaatacttgtgtatgcttcccgaagttctcatgctgtgtttttcagctccatcaggtcgtttatcttcctctctaaactggttattatagttagcaattcctctaaccttttatttttttttagatggagtctcgctctcacccaggctggagtggggtggcgcgatctcggctcactgcaagctccgcctcccaggttcacgccattctcctgcctcagcctcctgagtagctgggactacaggtgcctgtcaccatgcccagctagtttttttttttttttgtatttttagtggagacggggtttcactgtgttagccaggatggtcttgatctcctgacctcgtgatccgcccgcctcgacctcccagagtgctgggcttacaagcgtgagccaccgtgcccagcctattcctctaaccttttaccaatgttcttagcttctctgcattgggttagaacatgttcctttagctcatctttgttttttgttacccatcttctaaagcctacttctgtcaattcgtccatctgatcctctgtccagttctgtgcccttgatggacagatattgagaccacttggaagagaaaaggcactctggccttttgggctttcagcagtttttcactgattctttctcatgttcatgagtttgtctagctttgctctttgctctgacccttggatggggtttttatgggggctttttgttgctgttgtcgatgctgttgttgttgctttccacttgtttgtttttcggtcaatggtcaggtccctcttctgtagggctgctgccgtttgctgggggttcagttcaggccctattcatctgattcactcccacacctggagatgtcactcaaggaggctggagaacagcacagatggcatgggtgcctgcttctttttctgggacctctgacctcaaggggcaccaacctgatgccggtaggatcactcctgtatagggtgtctgacaacctcgttggagggtctcacccagttgggtggcatgggggacaggacccatgtaatgaagcactttgtcctttggtggaggggggtgtgcctcactgggggaaaatccactcatctgggctgcccatattcctcagaactaccaggaggaaaggctaagtctgttggtccacagagactgggcctacctctccccctagggacttaggcccagggagatctgggttctgtccctgagcctctgactagagttattggagttcctgcagggaagccacacccaatgaggaaggatgggtcagattcaggcctgaagaggtcctctggcctcagactaccacagcctgtgtgttgggctgtgggggacaagtcttgggactaagccatccagcctccctggctccagcaggggaaaagctcagcctggggctacagagatgggtgctgcccttcccctgcccagggagcttagtatgttaggcagttgcgagtcccactgatggctgctgccccacccccaaagagctcaaagggcttagatagcaggcagcagcagccagtgctcgtcgcccctccccccaggagttccgtaggcttaagcagattctagctgagaggctgtaagaatgtgtgtgttctggggttgggatgctaggccctggtggcatggattcatgagtgggatattccgatccatgggttgcacagttacttgggaaaagtacggtttccccggctgggtagcacgctcacctaccacctctcttggctgcggggagggggatccccttccctgtgtggctcttgtggctctcaggtgggccgctgcaccacattgatcttccttctccgtgggtcacaccagccttctagtcagttttgatgatagaacctggataccttggttgccggtaaaggattcacatgcttattatgtgttttgtttgtttgtttgtttttgttgttgttgttgttttccatgggagcctcagaacacactgcttctagtaggcaatcttggccccgccccctccccagcatctttgaaaagactctttccaaccaaaatggagggccccttaccaagtgcttcttagtaacccttgtgctgttaaattagaaggaatagacacaaagatccacatttctcttctaaagaatgttccatctcctgagtagactgttttcccagaaagtgacctccaacttaaaataagttgatgccagttcaagaagagatgacatctgatttagacagctaaaacacaagactctgggttaggcctctatctaaatgaatacttaatatacaattattaatagatggggaacatcttcctttacaaactcccactaaacttctttccttttgtccttgtttctcccatgttggcactactatcaccagctgttgcttatgaagcaaatctctttctgcaatgagcccaggattatgtaatagataacaaaaaggtgcttgacgggtgtgtagtctcatgcccctttccagtatttctagccttctgtggtgagtatctcctcccttcggacaagagtggataaaacgtcagaaatatatccatctttctcaaaaccagtcattggtgcttgacactagtgtaattaagaacaatgttcatcattggcctgttagtactttgcagaaaaagggcatgggaaaagcttctcagtaaaaaatttagttcattagctttaacgctgccactaccccaactgatgtatgaaacagtaacactgccccacttaaaacctaagacaatactatttcaggatggtataacaaatttgggatggttttatctggtttaacccctcctttggtcagctcagccagcctgaccctttatgttgggaacagagaaatcatactaaagacacctggcccagtagcactagagatatggaatggatacccaaagaatattgtatcgacaacattatgttaaaaagtactgattgacgtaacactgaataggcacaatgaccatgtatttattagttagctccaaatagaatgtcttggctatgtggcactaacctatggccatggttacccccaggaaggttaggacaatgttcccttggttatggttgggtgcaaggttaagtagttcataccttgtcaaaaccttcaaattttcctcatttacaatcttgttggatttgttgtgtcctattggtatgaccatttagcttccatcttcacaccacaactaggtattgagcatgtcattttgccatgtagagaccctaaccaattatacacaaaaagcactaaatgatagctgcatgggtattttgttattaaataatgaaattactcttgtgagaaatggtatattatagaactctatggctttaagcatattcagtgctgcccaagggggaacctgcactatcataaaaactgaacgttgtatctatatcccagatgaatcaaataacatcactaaattaaacgatggcatgaaaacccaactaaccaacctttcagatccaaaaccctctccaagcaattggctaagcagcttgtttggattttggggaatttggtggcaaaatctgttatttatcctgggaattataatcatatgttgtgttttgtcctgtttttgtctacactgctgttatggcatttgtttgcaatggagtcaatgcatgactaaaaagattagaataatgattgcccaaagaactgcattaattgaagatatatctgtttagcctaacacaggtcacaaaatcacttttttcatgtttctttaaatttggcctatactccatcaactttatggcttgtccaatttccctttgccatggcacatgacattctaggaaagaaccttcctagtgacatgggactatactcctgaacataaaaggaggcaaagctattgttttgctcatctatgatgctttctttgaaatatctttttttttcacataatcttgctccttctaatctttgaaagatattgattaaaaagggggaaatgtgaaaaatgaatcagatttaaaagccattggaattttaaaaaagccattggaaccctcaaaacattttaagccttgagcgagatgtgactgtaatctgagtcacatagcatgattataactctacttcacagattatagcttaactcttgtcctcattgttattgttctgtaaatgactaggaaagaccagagacaagacctccccctccaatcactgaactttattacagattaactgcttcctttattgtcctgtacctaactcagacaagatggcacctgaataggaaccccatgacagtttcatcttcactgtggaatgttaaatatacctttcatgaaataaaaggacctccttaactaatcagatcattgtaactgtgccttaagctttacatagaaagatactgaaattctgtgaaactttcctgaactttgtttatataaacgatcccaaacttctacactttggaatactgacttccattctttggagcttgtgctttcctgggcagcctgtcctcaacttttgctcatgaataaaactctctttaaactagattctcatgtttttgattattttagattgatgagccctattttcatatttataaaagacaaataaagaaaaggtctctattatctgattcatgttctacccctaagttttcttctttctcatggtctccagtcctcctcctgttaatgtttttagagaccatttattattattattattatactttaagttctagggtacatgtgcacaacgtgcaggttttttacataggtatacatgtgccatgttggtttgctgcacccatcaactcattatttacattagatatttctcctactgctatccctcccctagccccccaccccccgacaggccctggtgtgtgatgttccctgccctgtgtccatgtgttctcattgttcaactcccacttatgagtgagaacatgcagtgtttggttttctgtccttctgatagtttgcttagaatgatggtttacagcttcatccatgtccctgcaaaggacatgaaatcatccttttttatggctgcataatattccatggtgtatatgtgccacattttcttaatccagtctttcattgatggacattcgggttggttccaagtctttgctattgtgaatagtgccacaaaaaacatatgtgtacatgtgtctttatagtagcatgatttataatcctttgggtatatacccagtaatgggattgctgggtcaaatggtatttcaagttctagatccttgaggaatcgccacactgtcttccacaatggttgaactaatttacactcccaccaacagtgtaaaagcattcctatttctccacatcctctccagcatctgttgtttcctgactttttgatgatcgccattgtaactggtgtgagatggtatcttactgtggttttgatttgcatttttctgatgaccagtgaagatgagcattttttcatatgtctgctggctgcataaatgtcttcttttgagaagtgtctgttcatatccttcacccactttttgatggggttgtttttttcttgtaaatttgtttaagttctttgtagattctgaatattagccctttgtcagatgggtagattgcaaaaattttctcccattctgtaggttgcctgttcactctgatgatagtttcttttgctgtgcagaagctctttagtttaattagatcccatttgtctattttggattttgttgctattgcctttcttaaaacctagaaaataatcttggatctatatttcttttgacatatatcctcttggtgttaccactttattattgagggccttgttggggagtttctctggggaatgtgtgggagaggggaagtttggaatttggcagattttcttcagagttgtttgatatgcaggtgcctctttttctaggagtggctgtggggctgtgatctctcctagaacctcagaggcatgaagctagaatatcttccccttcaaggagaataagccaa

SEQ ID NO: 4524 - DNA, 485 bp, human; identical to SEQ ID NO: 3386

SEQ ID NO: 4525 - DNA, 485 bp, human
tggacctgggcgcacagcgggagcgctgggagacgttcaggaagctgcggggcctcagctgcgagggcgccgccaaggtcctgctggacaccttcgagtacccgggcctcgtgcatcacaccgggggctgccactgcggcgcggtccgctttgcggtctgggcccctgcagatctgcgcgtcgtggattgcagctgcaggctgtgcaggaagaagcagcaccgccacttcctcgtcccggcctcgcgcttcacgctgctccagggcgcagaaagcatcgtcacctatcggtccaacacgcacccggcgctgcacagcttctgcagcaggtgcggggtgcagagtttccacgcagctgtctctgacccccgcgtgtacggcgtcgccccgcactgcctggacgagggcaccgtgcgcagcgtggtcatcgaggaggtcggcggtggcgacccgggggaggaggccgccgaggagcacaaggccatc

SEQ ID NO: 4526 - DNA, 99347 bp, human
aagttgcctgaagtgaaggagggggtagcggctgcagaagctaaagcttccgccaaacaaaagaggacagcacttccggtcacgccatcgttgctgccttcttcgtcaaggtgagtgtaaagaaggggacttggtaattctcacaaataaatccccatacactccagggaaacctccttttgtgcctcaacgtggggtggaaaggagaattcatccccgcgtgcgttgtatgaaggatgcttctgacgcctgtggttctgatcgcctcgctatctcctcccttctcctccggagatggggggcccgctcctgcctcacctcctcactctggtggtccctttaaccgcttgactcctggtcatgcttcacctctcctctttatcccgtatcctcttctctggtctgagccagcgtcattccctctaccacaggtcactcctacctcctacctctcacctccgccttctgccccccatcctgttaacctgcgactctttgcgagccccttcctaccctctgttttactccccctgctggcctttggtctttcctgttcccctcccgcggagaccagtaaattacgtactttgcaacagtaggtgtgacttcaaggtcaaggcttttttttttttttttttttggttcttttaaagtataagcaaagaagcagaaaccttagagccctaagaggcataggcacttgtccaaatgatgttcttttttttttttttttttaactctaaacaaaattacacatcatttagatactattgcacaggtttcagtcttctacacattgcatttatttttttatgttgccatagaattgaatcctcagattttggggggcaaacatagtggattatacctgtaacctggtttcagcttcagcgtaagctttcccatcccctgtaaaacttctcttagcagtgaaatggttgacaggaatggcatccagtcacaaatttattactttatatgagttgagtttattatgcaatttcttttctggtctctgatagcaacattaaacagcaagctgacattttgcagacgaagactttttctgagagctttgcaagtattacacaatctatttgttgcaatgtgaaatgtacttttctattacatttgttaccatgtcaaatttatcttgtgagaacattagttattaaataataatcacagtaccgaaatgatcattaaatttatgctgagaatcagagttttccaggctctatcaggatctaacgaggaatttaaccaaagttctctttgaataagcagtggactccttcctgtgtgttatgcttgccagactaaggggtgattatcttttctaggccatgtatagtttttatttaagaataaacaatgaggcagagcttttgtgacaccaaaacacttaggaaagagtattgctgatgtctctttatactctattcaaatcattattacacagcatttaaatatcacacttgtttcaacccactgtgcatccatccattcattcaataattttttattgaataatttttatttgccagacagtgttctcagcactggagatacaacagtggataacaaaaacaaagtcttttaaactatagctgggagacagacaataacttaatatataaacaatatatattggcaagtggcactggtgttaaatgaacgaaacaaaaaaatacatgaagaaataaaaaagaaaaaaacaaaaaaagaaataaatatgtaataggttgtaatgtggacgggttctactattttagataggatgggcaggaaggcttcactggtaaggtgatatttgagcaggaacctgaaggaactgagggcacacactatgcagatattaatgggaaaacaggatttatgtcatagtctttgcatttgttcactctgtttcctaacccgcggccaccttcccattcccctagtggtcacttttctgcatagcattaattcaacgctctgcatactcaaataacctgatccattcacattaatttctcatattctcttcctcctggctagcttcttgctaccatttaggcgacttgtcagcctctttaggaagacatatcactatctccatattcacctcatcctcagtttgttgattgctggtgcattgtgtgctatcctacaggatatttgattatctctctcgctgctcttaccactttgtgttcataatatgttgtccataaatatttggtacggtaaagtgaaatgaattcagtgcttgtttataaaagataaaacttttaaatatggctttccccctaatgttcaacactattctctaaggtcagtattatcattgtcattttactaatgctaaaaccaagactaggaggtatgtagtaacttgctaaactgtggtacagtttatggagttaaggtttttcaggcactcagtcctggtctggttctctctatctgtttcttaatgagaaataaaaaatatacagaatattttattattttataagacaatccgggtatagaaattttattttttgtgcttctttcacaacttagatcatatcaggtgcttgaattactccctaattataaatattaagctctgagaggcatgaataatgcctctttttaccagaatatttttaaataaaaaattaaacaagcagaagttgaaagaagagtacaatgaaaacttttatattctggacctagattcaacaactgttaacctttgccatattagctcactctctctattactcactctctttctccatgcatccatccatccatccatccgtccatccgtccatccatccatttatccatccatctatctatttttttatctattttggctgaaccatttgacacttgcaggcattattttaagtaaatgtaaatacatgcagaaaagtgcacattgtcctaagtgtacagctcaaagcattttcttttcttttcttttttttttttttttttttttttttttgatggagtcttgctctgtcccccaggctggagtgcagtggtgaaatcttggctcactgcaacctccacctcctgggttccaacgactctcctgcctcaggctcccgagtagctgggattacaggcacatgccaccatgcctggctaacttttttacttttagtagagacggggtttcaccatgttggccaagctggtctcgaactcctgacctcgtgatccacccgcctgggcctcccaaagtgctgggattacaggcgtgagccaccgcgcccggccagctcaaagcattctcacaaagtgaactcggctgtgtaaccagcatcaagatcgggaaattttgaaagcccctaaatgtatcccttatttgttactattccaaattaatcacaatcctgtcctctgtcattgtataataataattttgtctgtttttaaactttaaaaagtaacacagtttgtgttaattttttggcttgaggatttgtttttgagattcatccatattattgagtgtagtagtaattcctctattttcattgctattccattgtatgaatgtaccacaatgtagttatccttttattgtagatgacatttttgttgttttcattttcagcttgcaaatagtattgtgagcattctagtacatgtcttttggtgatatattcacacatttctgttggacatatacctaagagtagaattgctgaatcacaggttatgtataagattaattttagtaaatactgccagccagctttccaaggtgattgtacgagaagactcctaacataatttttttttttttttgagacaaagtcttgctctgtcgcccaggttggagtgcagtggcgtgatctcagctcactgcaaccttcgcctcccgggttcaagtgattcttctgcctcagcctcccgagtagctgggattacaggtgaccaccactacgcccagctaattttttgtatttttagtagagatggggtttcaccatgttggccaggctggtctcgaactcctgacctcgtgattctccagcctccacctcccaaagtgctgggattacaggcctgagccactgcacctggccagaaatttttcagagtggaagttgctctagaatatagccaacacttgcctttgtcttggtagctattctaatggttatgaatggtatctcactgtggttttatttcgcatttctctgatgatggacctttccataagtttgttagtcttttggatattttttatgaggtgcctgttcaaatcttttgactactttttctcctgggctaacttttttttattgatttataggagctctttctatattaaggatgtgaatgctttgtcagatatatgtattacaaatctcagtggcttgtatcttcagtctcttcatggtgtcttttgatgaactgaatatctgaattctaatatcattccgttcattattttttttcatttatggttagtgcttctttgtactgattaggaaacttttatatttcccaaggccatgaagatagtttcctaggctgtgttattgtttaacctttcatatttatgtttataatctgtaattgatttttgtgtatattgtcagtatgggtatatgtaaaggccctttttttgttgttgaagtgacattcagtcaaccccaaaccacttattgaaaagatcattctttcccttttgtagtgccatccttttcattaactcaaatatataaatcaataatttgatatagttctgaattctgttcagtttggtttgtctatccttgtatgaataccactgtcttaattaatgtaacttcacaacatgccttatgtatggttatgtgagtcttacacttttgttctttttcttcaataatgccttggttattcctggtctttttccttatacgttttagagctagtcaatttctacaaacattcttcttggcattctgattgagataccatctaacagatcagtttagggagcagatatcatggcacgtcacccttaaatatctcagcattcatctcctaatattagcattactttgtagtaattaattaccattatctcactaaggaaaattaatgattccctaatatcaacaaatacctaatcttttcaaatttattttcctcaataagcctttgtaagctggtatttaaaactatcatccaacctagattaatgtattgttaagtttttggggattttattggtgttattttctctcctttgttgaacttgtgaatatttatatatttagtacttttcaatccattgcagtcattatttcttctgttgttccaactgtccaatcatgtcaagtgggagcccattcacattcacattggcttctgtgtcttttctcttttgttacatacattttcaaatatattcaaagtagaaaatagtaaaataggctgtgcatggtgactcacccctgtaatcccagcactttgggaggccgaggtgggaggacaacttgagcccaggagttttagaccagcctgggcaacaaagtgagaccccatctccacaaaaaatttaaaaattagctggacatggtggcatgtgcttgtagtcccagctacttgggaggctgaggggggaggatcgcttgagctggggagtttgaggctgaagacagctgtgattgcaccagtgcactccagcctgggcgacagagtgagaccctgccttagaaaaaaaaatagtaaaataaacatgaatgtatccattccccagcttcaataattaacaacattttgccaaaactggcaagttttgttttatctattctcacccatttttttccacatcccagatatgtcattacacaggtgaataactcagtatgtatctctaattcataggtgcattaagtaaccaccacgtcattattatacttagtaagataaataataatttctttcttttttctcttttttgagacggagtcttgctctgtgcctggtgaattgtcttaaagttatagttatacagtagctttgttaagtcagtatccaaacaaggaccatttattgccaatggatgtttttctcttaagccttataaagcccttgcatagtcccctttttattttattttattttattttttttttgagacggagtctcgctctgtcgcccaggctagagtgcagtggcgcgatctctgctcactgcaatctccgcctgccgggttcacgccattcttctgcctcaggctcccgagtagctgggactacaggcccctgccaccatgcctggctaattttttgtatttttagtagagacggggtttcactgtgttagccaggatggtctcgacctcctgactttgtgatccacccgcctctgcctcccagagtgctgggattaattacaggcgtgagccaccgcgcccggccccttagtctcctttttgaaagatcgttgattaattcaagaaactacgtcattagttctatagactgtctcatctggatttagatgattgcttccttgaggtggcatttattttgttttctcatcctcgtgtttcctatttactgacatttagagctagaggcttgattagattcaattttgattattttttaagagaaagactcattttaggcagtgctgtttactttctattgtattttatcatgtctaattttatcttttttttaattgatgctgggattgatttgtcatttcagggtgtttgtcgggctgatctctccattgtagcttttcccaccaacctttcttctgttggttttagcagccattgatgataattgcctagattcattatttctgtagaggttgaaaaatggtgatatttaattctttcaatctttctgcattattaactggaattactttataaagaagactttttccttatcagctattttttgtcctgaagtatatttcataataatcaagataaatgatgctgccgctgctgctttttttcatttatcagtgttcatagtaatgagttggtttcttagcaaccgccactgttttctttaatatcattaagaattcatggatttttatgtattttaagtgtatcaacccattgtggtcattttttaatgcttaaacagtgtcatcttataaattaggagccccttctgttttcacttctatgttttttttcacattatctcgttagtctttgttggcgtccttgctttttggcataagctattttaggctcatcatgtacactccctgccccacccctggaattagccattttacaaggaactatgtaatttttcagtgaaccttggtatttagaaactaagatgggaatactcaggggattattattttaaaagtcatgctacctgatctttagttgtgctcttttccctgctattgtgaatacattggaatgactcttgcagcattttattgaaaattcgctaaacatggctttcatttgtttatgtagtcattcattcagccaaaatttatagaatgcttactatcatgtatctggtcttatgctgggcacagggaatgtgagggtaaacctgactggtctcctgtccttggagaagactcattctagtgtggatatgagcaaatacgcagtgtctaaagagcagtgaacagtactgtgttcatactctttagacactgagcatactctgggcataggcaaatgggctataggagcacagagaggacatcccaaaatgctttggaaagggaagataatgcttgatactggtgagtaaatgaggtatgaaggtagaagagtaatgaagagtgttccattcagcaaactggaagaagtaggggggaatcttgatatagtcaaggaaaggcatatatgtagttggttatgatgggaacataattgtgtaagtttttcagttttcagaagattgacaaaatagtctatttaccacagacatgaagatgtaaaatgttgtatgtatgtgttgttgatttttattttaaatctgataatgaaataatccaaattctaattaaaattagtatttaatgtacttcttggacctgatcatattttttagttatttcattaatgttaaagcatagttacagttaggagatgtctatttcgtgttttagttcactgcttctttattttttactattattttgctttatacgtgttaagaatctgaattttcaagatatgacattaaaaatagtggcatatttattgtggctcttcatctcccttcattctttggctgctatttgtgtcaacccgtttaataccataattacagccccttacatactcacaaggcaaagttgttccagaaaacatgtcatctctctttattaccaattggacattatactatacctgttacattttacagcatgttgcacctgaggctatccatctgacagatactgcatgaatagtatgttaaacacaggtttgtggtttaccggagtgctatggtttaccagttgggaattttgggaccgtgagtgtgggagaatcactaggcttaggaaggaaccacatctcatatgtggccaggaggtgaaggggtgttctagaaatcattgaagaatgtggggaagcttattttttaagggggattctagaggtcacaaagaaaagattccaggtgggaaggagagcagtgaaacagtagattaaaggggaagtgggagtagattactacttttcattctctctatttgtcttctttattataagaataatatgttcccagagtcctgaaaggcaagaagtatgagtgaacaagcggggagtcagagaaggtgagaaaggaaaacatacactgtctgagaacgtcagatgtgatgggagagcagtggggggaagatagattgcaagccttaggatggattgataagtcttagaaaagacagatcattaattaattaatcagtcaattaactaaaaacatactgatgactagctggataatgagaacatgtaattgacttaaacatgttttcaactgagtgaggtagacatagacattgcaacagcggtgctatgctagaggagagaccaaggtgtggtgctggcagtagagacatagaggaaggacctctaacctaccttaagggctcagagaaggcttcctagaagagaccatattaagtgcacatgtaccctaaaacttaaagtataataataaaaataaataaataaataaataaataaaaaactgaattttgacaaaaaaaagctgtgagtgggaccagagagcaagtggtcattggtcatttagacgatgtaaagtagctgactggatatgccatttagccttgagcttgaaagtacctaaaataatgggcaatttagaggttactctgtggtctagtaaagctaaggaaaaggggcaaatggaaaggaatagttttataaatggtgtccccattctcccagcccatggcaaccactaatatactctctgtctctctgaatttccctattctgaacatttcatataactagagtcttgaaatatgtggccttctgtgtctcacttcttccagttagcatagtgttttcaaagtttatccatattatagcatgtcttagtatttccattccttttcatggctgaaagatattccattgtatgagtataccaccttttatgtattcattcatcagattgtagatggacagatgagttgtttctactttttggctattatgaataatgctgctgtgaacttctggtatacgtttttgtgcaaacatatgttcttctcatttctctggggtatatgcctaggagtgaaattgatagtaactctatacttaactctttgaagaactgccaaactcttttccaaaatggctctaccacttaaattcccaccaggaatgtataaggttccaatttctccacatccttgctaacacttgttgttttcctttttttttttttttaaattacaaccatcttagtgagtatatataataaagaatctcacttaatttttaaaatataatatttaaccgctgacatctttttttttttttttttttgaggcagactttcactcttgttgcccaggctggagtgcaatggtgccatctcagctcaccacagcctccacctcccgggtttaaccgattctcctgccttagcctcctgagtagctgggattacaggcatgtgccaccatgcctggctaattttgtatttttaatagagacggggtttctccatgttggtcaggctggtctcgaacttccgacctcaggtgacccacccgcctctgcctcccaaagtgctgggattacaggtgtgagccaccatgttctgctaactgctgacatcttttaagcctcacctctccctcttcattttctgctccacaactgggcaagttaattagaaagcatgagtgcttcatcctttggagctagcaagagattcaaaccatgcaagtgtcttcctgaatgtaagaaccctcactcctgcctcatcctttaaccacagtaaaaactcaatttagtttcctttccttgctttttctaacctgcttaggagacttgccttgctgtccccagaaatgcattgtttatgtaagtaagtagtaaacattttcataccctctttgtgtgtgaggtgttatcaatctgaacactggaatcaaaatttgggtggggtccctccttcttctgcaggatggcaagaacaattggcacagtgagcttggtgctcagataatgacagccatcatggggggaagggagtatctttccttaattgctttggctcactaattggttctgatggcaagcataaacattgagcctgcaagggtagctagttttttagttgtactgtgctgtgttgtattgttgactcctgtagaacctctcttacagatttagctaacttggaagtttaggtaatttaatggacattgaggaacagtagtatgggatccttaaagtagccctggatcatgtgtctcagcccagacctatttgtgtgtcttaacgtaaagctgtgactgatgctaggctcaggaggaaaaccatgtctatgactagctggttttgtgtctcaattaggctctgaccctgacagctgactgcccattgggtggtcgctcttgagagcagtcatcagggagtgaaaaaaagagagagaaaagagaaaagaaacagctattatgtggcttgctggggtctggacttcgaagcacaaatgactcactagaacccttaaatacctccgttgttatggctgttgctgctgctgctgccgctgccgctgctgctaccgccgccgccgctgccgctgccactgccgccaccaccacctgtgcttctgttgcaacaaagatcctgatcttcaggattatagggaaaaacattagtggcacccctgtagcatggagaaaggggtaattcaaacccataaagctcctagtcctttaatcttatatgaccaccattgcctttggggaggccccttacagtgacagtgctgatttgagactttctgcaggaagacatttataaatatgagcaggttagggaccccgcagaaatatatccagtaacaacagcaacaaaaaaacaagtacagtcatgtacagcattatgatgttttggtcaatgacagatcacatatgaggacggtggtctcataagactataatggagccgaaaaattcctgtcatctagtgatgtcatagctgttgtaacattgtagtgcaatgcgttactcacgtatttatggtgatgttggtgtaaagaagcctgtagtaccagtcatataaaactagaacaagtaccattatatatggtacataatacttgataatgataaaaaaacagctaggtgtggtggctcacgcctgtaatcccagcactttgggaggccgaggcaggcagatcacttgaagtcaggagtttgagaccagtctggccaacagggtgaaaacctctctcttaaaaaaaaaaaaaaaaaaaaaaagaaattagctgggcgtggtgacgcacgcctgtggtcccaggtactctggaggctgaggcatgagaatcgcttgaacctggggggcagagcttgcagtgacccaagattgtgccactgcactccagcctgggtgacagagtgagaccctgtctcaaaaaaaaaagatgaaaaacaaccatgtttatgtatttactataccataatttttatcagtattttaaaatgtagtctttctacctattaaaaaaaaagttaactataaaagagccacagacaggtccttcaggaggtattccaggagaaggcattgttataggagatgacagctccatgtgtgttattgcccctgaagaacttccggtgggacaagatgtggaggtggaagacagtgatattggtgatcctgactgtgtagggttaggctaatttgtgtgtatcttagtttttaagaaaaaagtttaagaaataaaaaattttaaacaaataagcttatagaataataatataaagaaagtatttctgtatagctgtataatttttttttttttttaagatggagttttgcttttgttgcccaggttggagtgcaacggtgcaatctcggctcactgtaacctccgcctcccgggttcaagcgattctcctgcctcagcctccggagttctgggattttaggcgtgtgccaccatgcccggctaattttgtatttttagtagagacggggtttctccatgttggtcaggctggtgtcgaattcctgacctcaggtgatccgcgcatctcggcttcccaaagtgctgggattacagatgtgagccactgtgcccggccatgtgtttgtgttttaaaagctaaacatcattacaaaagagtcaaaaagctttacaaaattttaaaaagtttataagtaaaaagttatagaaagctaagcttaatttattattgaaagaaatgtttaaaaaatgattttagtgtagcctaagtgtactaaagtgcacattagtgtacagtaatgtcctaggccttcacattcactcaccactcattcactgacccacccagaacaacttccagtcctgcaagctttattcatggtaagtgcccagtacaagtgtaccatattttgtctttttttttttttgagatggagtttgactcttgtagcccaggctggaatgcaatggtgcgatctctgctcactgtaacctcctcctcccaggttcaagtgatttctcctgcctcgccctcccgagtagctgggattacagatgcctgctaccatgcccggctaatttttgtatttttaatagagatggggtttcaccatgttggccaggctggtctcgaactcttggcctcaagtgatctgcctgcctgtgcctcccaaagtgctgggattacaagcgtgagccaccgcgcctggccatatttttgtcttttataccatatttttactgtaccttttctatgtttaggtaggtttagatacacagatacaaaaatacacagatacacaaattgtgttaaaattgcctacagtattcagtacagtaacctgctgtactggtgtgtagtctaggagcaatagtccataccatataacacaggtgtgtagtagtgtataccatctaggtttgtgtaagtacactctgtgatattcgcacaacagtgatgaaatcacctaatgacacatggcatttctcagaatgtatctccattgctaagtgacacgattgtaaaagaaagaaaaaaaaaaaacagatatgagaggcagaggaaacaaacagaaacggagatccacaatttgacccaattagaatccagaatttatggaaaaattttactaaaagagcaaaaagataaaagggtgctgattggtgttgaaatgcagtgggtggcaaaacttcatgaccttaattactactggggctcaaattggttattatgtcaggatcccactatatttaatcaaggtgcctcctgtaatctaaggggagttcctgaacaggaaagagataaacaagtatacctcacattaactatcagaactattgccttgcctgaattcctcacatttgtaccattcattgccttaaaatatcccatagtgggtatgagcactctgatccaatgagtgataaaattaagtatttggcacatgtgaatccgtttgacaatgtgagatcccaaggactatacccccagttaaaataggttaatacagcccactgtaaattagaataagtctacaaatatggaaacccatgatacaaggcctatttggtgaaagggtgattatccccatgtcttctccattaacaacccaatttggcttgttcttaaacttcaaatgaatggcacctaatggtggattaccataacgctaatgttgtggtcccacacattaaggtccccatacccaatattgttgacattactgactccatccggtctgtgactggtaaatattttgctattatagatttggctaatgtgttctattcactgcctatttcaacagcctttcagcctcagtttgccttcacctctgaagggacacaataaacatgtacctggctactcatgggatacctccacagttttgccattgtacactatctttgctggcaagatcttaactgtaccgagctttttctagatgtacaggtgtgatgttacattgatgacatccttccctgaggagatttatttgacacactcattcaggaaatacagatactcacaaaattgctcataaaatggtatggctgttgtgccacacgtagtgcaaggccctaccacttttcaatacctacacattatttgctaaactgaagaccattctgtctctgacactgtcagaaaagcagctattgaccctgtcagcacccacaacttcttttaggttcatttgtgttctggagacaaaacattcctcttttataaattttattgaagcccatttacgctatttcttacaaatcagttcatcttgaatgggggtcccctccaacaagaggttctagaatctgtcaaaattgcaatatgacactaatgacaattagtcactaacgacaatatcgttagtgaccccagatgcgcttcaccatagaggttttagcaacttcctcatttctccctctggaacatccatcattgccataagttgccaagggtttctgaggcaagagactgtcatccttggacctgttttatacaccattagagtgacaattgctagctgcatagtggactgtcttagaaatagaggctatcacaatccctcagcctgtgaccctccatatccagctgcctattgtgccttcggtcatggaagccatggcactacaagctgggcatggctactgaggcctctttgctacaagatggagaaaaacctgggtcttctgtcatataccacttggaggaaggggtagcctcccgtctttagttccttgctaaataccatggtgttgggggacccatcacccctctcccagaccctgtggctacctgcagagccccttgagatcaaatggagtgaaaaacaatggtttgtacaatttatggatgataccacaagcattgtatacaatggagtttgctggagagcttatgcgtttcatcctttaaccatgatgcttctgataaggacaggaacacaggtgtcagtacagttggccaaacttcaggcattcaccttagcactgtatgccctagccaacaattggccccatctgcacatttttacaggttcttgagccactgcctaagagttgccccatttggggaaagaactctgagaatctctaacctcacagatacccaaaatgtaaatcaagttaacacatttatcttcacatagtgaaggtcaaacataaggtctcaccaagagactccttattttccttcagaatttgaggcatcattgatagtgatgaaggcactcatttcatttcttagaatatacagtcctgggcttaatgaaggaatacaacaaaacatttactttctttacagacttcattctgaaggacttacagagcaccatactggcttcattaaacaaatgtatatttgattaaatgaacatggcacatttcagtcattagacaaacatcaggggtgaattgtaagattctgactctattttttcaagtttgctgactttttttttaagcttcaccttcttcccctctgccccacatcgggacaaattgataagaagctctggttgctccctccttgggggtcaggaaaagattcaaaccatggaagctccttcatgtgtataggaagccttacactgggccctaaccacaacgaaaacccaagcttgtctcctttccttgttctgtcaagccgtttcttacctgcttgggaagcctgaccttctccaccaagaaaatcttcatttaggtaagtattaaactttcttgtaccatcttggtgtgtgtaaccagtctcaacgtctaacctaagtttgggatgggggtcccttcttcctcttcacagtgtcaagtagtacctgattgaggttcttatttgcatttccctaatgactaatgatgttgaacgtatttccatgtccttatcggctatttgtatatcttctttagagaaatatctattcaagtcccttctttttaaattacattatttatatttttaattgtttagtcatatgactttttatgtattgtgggtattaggtccctaacagatacatgattttcaattgttgtcttccattttatgggttgtcttttcactttcttgatagtgtcttttgagtacaaaagtttttcattttagtgaagtccaagctgtctaatttttcttttatagcttgtgtttttgtgtcttatataaaaattgttacctaatcaagttcacagtgatttacacctatgctttcttctgtgagttttataattttagcttctacatgtaaatctttgatctcttttgagtttatttttgtatgtggtgtgagataggggtccagtttcatttgcatatagatatccagttgtcctggcaccattgtttgagagactatacttggcactcttgtcaaaagtcaattcaccataaatataagggtttatatctacactctcaattctgttcatcagtctatatgtctacaattattctagtaccttagaatcttagtaactgaagccttgtagtaagttttgatattgggaagtatgactcctccaactttgttccacgttttcaaaaggtgttttgaccattttgagttacttccattttagtattaattttagggtcagcttgtctgtttctgcacagaaggtatttagaatttcaataggaatttcagtgaatctatagatcagtttggagagtattgccatcttaacaatattaaatcttacaattaatgaaaccaagtgttttcccatttttaaaggtcttaaatttctttcagcaatattttgtagttttcagtgtacaagttgtggtcccacacattaaggtccccatacccagtattgttgacaagtctttcacctccttggctaaatttattcctaagtgttgaatttttcttttatgctactgtaaatggacttgttttcttttttaagttttattttatgtttaattgatacacaataattctatttatttatggggtacagtgtgatgtttcaatagatgtatacattgtgcagtgatcaaatcagggtatttagcatattatcacctcaaacatttatcatttccttgtggtaagaacactcaaaatccttcaactagttattttgaaatgtataacgcaatattgttaattatagtcattctactgttcaatagaacaacagaacttgttgctcctatttaactgtaattttgtaccctttaactagtctttctgcctctcttccaccccactttttccctctactctcctcagcctctggtaaccactattctaatctgtacttctatgagatcagcttttttaagattccacaaatgagtgagatcatgtgctgtttgtctttttgtgcctggcttatttcgcttagacttgttttcttaattttatttttggatttttcattgcaaggtagaactacaattgatttttgtttatgatcttgtaacctgcagctgtgctgaactcatttataagttctagtagtttttagtggattccttagaatttttacattcgagatcatgacatccacaaatagagatagttgtacttcttcctttataacttaagtgcctttcattgtgttttcttttaaaattgcccttgttagaatcttcagtacattgttgaagtggagagagtagacatccttgtctttttcgtgattttagagggaaagcttttgatcattaattatttattgatattattattattattagagacagggtctccctctgtcacccaggctggagtacagtggtgcaatctctgctcactgcagcctcgacctcccgggttcaagtgatcctcctgcctcagccccccaagtagctgagactacaggcacatgccaccttgccggatagtttttgtattttttgtagagactgggtttcgccatgttgcccaggctggtctcaaacacctggactcaagcaacctgcccgccttggcctcccaaagtgctaggattacaggcgtgagccactgtgcctgggcctgatctttaattattaagtatggtgtttctgtgactttttcctagatgccattatcaggttgaagaaatttccttctgttcctagtttaagggttttttttatgaaaagttatcgggcttaatcaaaggctttttctatatccattgagatggtcatgtggttttcattttttatgctgttagtatagtgtattacactgcttttcatatatttatccagctttttatttctggaatagatctcagtcatggtgtggagttctttttaatacgtgtcagaatttggtttgcttgtattttgttgaggattattgtgcttatattcataagggatattggtctgtaggtttcttttcttgtaatgcctctgtctggttttgctatcagaacaatactggcctcacagaataagttaggaagtgttccctcgtcttccctccttttaaggagtttgtgtagaatttagcagtgaagccgtcttggccttggcttttatttgtgggtagtgttttgattactaattcaatgtcttcacttgttataggtttctttatcttatctatttcttcctaagtcagattcagtagtttttgtttttctaggagtttgttttatttaagttaatctgattttttgccatacacttatttatagcatttttttataagattggaagtaatattccctctttcatttcttattctagtaatttgagtcttctatcctttttcttgtcattctggttaagggtttgtcaattttgttgatcttttggaagtaccaacttttattttcattgatggctctctattatttttcgattctctatgtcatttatttactccttggtctttgtattatttccttccttctgtttgctttgagtttagttttctttttatagttaattaagatgaaaagctagggtcattgttttagatctttcttgtttttcatatatttatccagctttttatttctagaatagatctcagtcatggtgtggagttctttttatacgtgtctgaatttggtttgctagtattttgttgaggattattgtgtttatattcataagggatattgtaatatagttattacaactataaattttcatcaataaaaaatactgctttcactgcatctcatatgttttggtaggttgtgtttaagttttcattaatttcaaagaactctctcatttcctgtgtagattcttatttgacctttggcttatttagaggtgtgttgtttaatttctacttttgaattactttacaaaatatctttctgttactgatttctaatttaattccattgtggttggtgaagatactttttattatttcagtccgttttatggagacttgttttatgatctaacatatggtctatcttcgatgagaatatttaatatgcatttgagaagaatgtgtattcatctgttactgggttaagtgttctatagtgtctattaggtgcagtcttctttttccttgttgatctcctgtctgattgtttttatctgttattgaaagtgggatattgaggcagccagaatatgttattgaattgttcatttctctcttcagttctgtcagtttttggaatctgttggtagatgaatgtaagtttatcatagttatatttttgtgatggattggcagcttaaagattgcaaaatgttattctttgtctgttttaccaatatttgttttaaagtctattttgtctgctattagtataaccactcctactcttttttgggtaatgtttatatggtatctctttttccattcttttacgttaaacttatttgtgcctttgaatctaaaatcattctcttgaagataatgtatagttgggccataactttttttgtcgatttaactagtctctctctttattggagagttcaatccattcacatttagtgcagttactcttcaggtagaatttacatgtgtgttttgttatctgtcctccttatgtcttatgtcacttttgtttttctattcttacattactgctttcatttgtcttaaatattttccactgtgccatttcaattcccttgttgtttctttgctatatattttggtattttttttttagttcattctttggagattaccattaacatctcaattgatgagaatctagttcagatttatatgaacttactgtcctagaatacaaaagctttgcttctttaatagcactgtaaccttctttatgttgttagtgtcacaaattacgtctttttgcactgtgtgtccatcaacgtagatttataattattgtggtagtcatgttttaagtcagactggaaaacataggaattgcaaattttaaaaaagcaacaactatatttatactgtttttaatatttacctatgtagttacctttaccagtgtactttatttcatcttatgatttcacgttactatctagtgtcctttcctttcagactgaaggacttcctttagtattgctcatagggcatctgccagctacttgatatctctttcagttttgtttatctgataatgtcccattttctccttcacttttgaaggatagttttacttcctttattagatatagaattcttgattgcagttttttttctttctgtaacttgaatatgtcttcccactgctttttggccatgacttctgaggagaagtcaactgttaaacttctgttttcttgtttgtgaagagttgtttttctcttattgctctttgggattttctccttgtttttggctttcagtatttttattatgatgtgcctatgtgtatatacttctcatttttcctacttggtgtttgtttgctttttagaatgtgtatgtaaacattttttcatcaaatttgtgatgctttcagctgtaatttgttcaaatatcttcttcctcttttctattttcttctctgattcccattatatgtattttggttgctagatgatttcttacaagtttctgaggctgtgtttatattgtctctgtgtgtgtgtgtgtgtgtgtgtgtgtgtctgtatatatatatatacacatacatatatacacgtatgtatatatacacatatatatacgtatatatacgtacatatatgtatatatacatatatatatatgcacagacacacacagtctcagaaacctgtgtgtgtgtgtgtgtgtgtgtgtgtgtgtgtgtgtgtaaaatttctgttcctcagactggatgatctgaattggactatcttgctgactatttttttctatcagtgtaaatctgctcttgagcccctctaatgaatttttcgtatctgttactttatatttgtagggggcttgaaggatttaggggcttatcaaagaaagacatatgtctatgaggtggcagtatcacacacaagctttattgggagatgtgttgacaggcttgcatgttggggaagtctctcacagtaggagcctgtccagaggccatggcttgggagttgctactctgaaggggaagaggccatggaatttccagagagggagattgtagaggggacttgacttacatgtttaggtgatggctactcagcagcacagtggggagtctctgggtcagagagagctctaaagggcaacaatgtgtcaaaagacaaaattacaacaaatttagtttaaagatctcacttggccgtatttgtgattctagaatcaggcaacactattccacaaaatagaatacttgttcaaatgagctgagagcagaagaggttgacttcgtagaggagaagggctgaagaagcaaagaacaaagtgtatttattgtatgtgtaaccactaaagtatctactcagtagcttagccatcattggataaagatttccttaaatgcctgggaccaataaattgcatcatctttaacaaagggatctgtatacatcttggggcatgcaacacttagccaggcagtttacaaccgtacattagccttcacttcctgattgcaaagagccgaaaagtcagttagaagtgagagtttatggccttctcaggtgtttcctgagcatgcacacagccctatacatgcagatggtcttctatattccctagaaaatatcagaactcttcaaatcccctattgatagcttattcctcagcttttcctttcattctttttatttagtttattgtttgctccaagtgttatcatttgtggaggggcttttagtatgggttttgcactgaatcaaacataaaccttttaagtagcgtcttctggggaaccaacagacaggacaaataatgacagttctttagaactgaagctttgggagttgatgccactgctaaacagctgagccagctaatgtagttctttgacagcacagaaatgtagggagaaatgagcagcccctggctgaaatgccgcagactctccttgttcttacttagttctgtagattttgttgccgttgatcaatccccagagactttaggtgattggctttgcttgttttgaccagttttattagatgtctctttggggaggagatttcactgagctcctcacatagccattccagaattcccataagtttggtgttgtatctaaaacctcattgctaaagcctaaggtcatgcaagttttctgttttcttctagaagttttataattttctgttttatatttagattcgtgatccattttgaattaattttcatgtgaagtgtgaggtttgtgtcataattttattttgcacatggattccagttgtttcagcaccattttttttggcaaagattgtccttctccattgaattacctttatgcttatgtaaaaaaaaatcagttgactaaatgaaataaactgattaaaaaataggcaaaagacctgaacaaagacacctcaccaaagaaaatatacagataatatataagcatgtgcaaagatgctcaacagcatatgttattaggaaattgtaagttaaaaaagataccactacacatttattagaatgttccaaatccaaaacactaagaacatcacatactggtggaaagatgaagcgacaggagctctcattctttcctggtgggaatacaaaatggtatagccactttggaaaacagtttgacagtttcttacaaaactaaatgtagtcttaccatatgatccagcgattgcgttccttgatatttactcaaatgggttgaaaacttatgtctacacaaaactctgcacataaatgtttatagtagctttattcctaattgccaaaatgtagaaacaatcaagatgtcctttagtaggtgaatggataaattgtagtgcgtccagacgatggagtttagtgccaaaaaagggctatgaaaagccttttcaagccatgaaaagatatggtggaatcatatgtgcatattactgagttttaaaataagccagtctgaaaaggctgcatatcccagctactcagaggctgaggtgggaggatggctttagcctgggaggcagaggttgcagtgagctgagattgcacagcaccccagcctggacaacagagcgagtccctgtctcaaaaaaacaaagaaaaaaaaaagaaagaaaaggctacatactgtatgattccaagtatttgacattctggaaaaggcaaaactatggagacagtaaaaagatcagtggcttccagggtttgggggttgggaatggatgaatagacggagcacatgggatttttagggcagtgaatctactctgtatggtactataatagtggatacatgtgtttatacatttgtgaaaacctatagaatgtacaacactgagagtaaaccccaatgtaaactatgaactttaggtgagaacgatatgtcaatataggtccatcaattataacaaatatacatacccttctggtgggagattttcatagtgagggtggttgtgcatatacgggagcagagagtatgtgaggaatctctaccttggactcagtttttatgtgaacctaaagcttatctaaaaactaaagtcaattttttaaaagtcaactgaaaaaaagaaatgcttctctctcccacaccttgccccaatcctcaggcaataataaatggttttgcggtatcaaaaaaaatctgtgattgtatttgtgtggatctatttatggcctccctattctgttctgttgatctatgtgtcatttcttttgctaatactatggcaccttgattactatagacttacactgcgacttgaaatcggataacatgagtcctctaacttggttttcctttttcagagttgtgatagctgttaggtcatttgccttttcatgtatattttttagattcagtttagctatgtctacaaaatgcttgctaaaattttgattggaattgtgtttatatggctttaattgagcattttatctctctctttgcatatcatttatacttgtttttcttaactttttagtggttaccctagttttcacagtacacatttttaatctaagtctttcaaatactattgtattgcttcctgtgtagtgtaggtaccttataagagttatcccccgtttctcccttgctttctttttgacattgctgtcatccctttcacttacttatatgctacagtcatttcatacattgtagtgtttttactttatacacagttacctcctagattgattaagaaaaataaaaagttttatattacttatatttatttttctctgactttctttatgaagattcaagtttctgacatgttgttttttttttgtgcctggagaacttcttttgacatttcttgcaggacatgtcagcttatggtatccagcagtttctctaccatgtaaacaaatcataagtgctagatcttcctgtctctccaaatgttcaagtggtgatttcccatgtggcctcagttctctgatgatttttaaaaagttattgattttcattttgtctagcttttcggtcttgtaagggcaggagtgacatcttcccagttctttacaatttggagctacaattagaggtgctcacatatgtatttttaaatttttcttgtggatatgttgccaaaaacagtaaaaagaaaacaggtgaaattaattttaataaagtattttattaaacccaaacaacaaaaataacattttaacatgtagtctgtataaaaatacttaagagctattccacattaaaaaaaaaactcttctaaatatcatatggattttttctacttgtatcacatctcactttgaactattgcatttcacgttatcagtaacccaatgcggtttgtggctattgcattgggcagcacatgtccaaagagaatatgtagaaagagaaggaaggagagttgaggatgaacttttggggatacagttaggtattaagcagaggaagagaggcctaaagacagagaaagaaaagtcagagaaaaattgaagacagcaaaagtataactgaaacaaagggaagaatatgtttcaaggaaaaataagtattcaaatagtgtcaaatgtggcgaggagctcagggtagatatggagtagatatgggaattgacaaatggaaaagaatagagaatacagaaatagaccagtgtgtttgtgtatgtgtgtgtgtgtgtgtgtatatgtatatatatgtgaaattagtaaatgaaagaggtgtcaacataaattaatagagcagagtatatcattcaatacatggtgatgggacaattgattatccatatagaataaaataaaataccaacaccaaaaacaaaccattaattttttatagattataaacccaattatgaaaagcaaaactttaatttttaaaaaaaaaaattaggggactgtttattatctcagggaagggaagggttgttgaaacagaatgtataaagaatgcctataaatcaatgataaaccatccaatccgaaaaatgggcaaagttatgaacaggtaatttataaaaaaggaaatacagaagtccaataaatacattgaaatgtggtcaattgcactaataacaaggacaagggactgaaaatcaaaataatgaaatgtcacttttaacatatcaggtaaaaattttattgtttgacaatacctggtattggcgtggttgtagggaaacagtagtcttcatatatggctgatgtgggtggaaagaaatacaatcacattcaaatgaaattaattgtcaaggatctagtaaaattgtagatgggcatttccttctgttgcaacatttccaattctaggagacatggaagaaaacattgcggtattacgtgatattgtgaaaaactggaaataaactaaattccccaactgttccaaattaataggggaatgatcaataactcatcagtcatcatctattcatacagtgcaatttaatatggcagtgaaaatgaagaaatcacatcaatatatatcagtgtcatcttaaaaacataatgctgattgagaaaagtgagttacagaacaatcacataatataccatttatataaacttaaaacatacaaaaatactatatattgctcatagatacagatgtgtttgaaaatgtatgtataaagaaggaatagaaatgatgcacaccatatcaaatttggttgcctctggggagaggaaaggataatggctaggggtgggtttaaagagtacttcatctttatctagaatgtttagtttatttcataaaatagatgaagcaagtgtgactacatttttaaaaatgttagcaattgttaattctgggtggatattctatattattctatatttttgagatatttccaaaataacaccaataccaattaaagtttataggagatgaggaaagaggaaaaaaaaaaaaggtagtacctggagaaagatgcagaaatctggaggagaaattactttcaaggtggtaaaaactcaaatagatttaactactggtgggaaggagcctagggagagggagtggttcaaagtacaggtgtaaggagagatgattaaagtaccaggacccagcttgtgaggagtgaagcacagccattttccccaactgatctatcatgtatttgtcacctaaggcaaaaatgtatttcttaactgatacagctatttgtaataaggtttcatatgctgtctcctttgtgttttatatatttatttatttatttactgagacagagtctcactctgtcaccaggctggagtgcagtggcacgatctcagctcactacaacctctgcttccctggttcaagagattctcctgcctcagcttcccaagtagccgggactacaggcgcgtgccaccacgcccagctaatttttgtatttttagtagagacagggtttcaccatgttggccagggtcttgatctcttgacctcatgatccaccttcctcggccttccaaagtgctgggattacaggcgtgagccactgcacccggccttcttggtgttttatatatgataactacatatcaagcaactgttattcccaatcttgacttgaaaaagtaacaaaatgttcctaacaaagttacactgagatgcaagtacagtgttttctgacatagctcttgcaaaaaatattggcaataaatgtatttaaaaataattttaggctggaggcagtggcttaagcctataatcccagcacttggggaggccaaggcaggtggattacctgagcccaggagttcaagaccagcctgggcaacacagggagaccccatctctacaaaaaaataaaagaattagtcaggcatggtggtgtgcacctgtggtcctagctactcaggaggctgaggtgggaggatcacttgagcccaggaagtgaaggctgcagtgagctgtgatctcaccactggactccagcctgggcgacagagtcagttgctgcctcagaaattaaattaaattataaataaataaatacataataattttaatgattaagaaaatttcaggaattagtaagttcccaatattgttgtttgggcattggaagcaatgtactatgaatctttaaattttccaaatacagagtttccaaaagataaatggacatcctcactgggctctatgggtaacttccttttcatcttctcccactttgcaggctaaacaggcactctgcacttttttcctttttaaagaaattatttttatttctaattattatggctatataatagttgtatatatttatggcatacatgggatgttttgatacaagcatataatgtgtcatgatgaagttagtgtttatcatttgtgttaggaacattccaattccactctgttagttattttatttttattttattattcttacttttttgaaagaagatctcactctgtcacccaggctggagtgcagtggtgcgcaggcggttcactgcagctccgccttccgggctcaggttcctcccacctcagcctcctgagtagctgggactataggcgcgcaccaccacacctggctaatttttgtatttttagtagggatggggtttcaccatgttgcccaggctggtctcgaactcctacgctcaagggatctgcccaccttggcctcccaaagtcctgggattacaggcatgagccactgcactcgatctcctttagttatttttaaatatgcgataaattattgttaactatagtcaccctattgtgctactgaatactagatcttattcattctatctaactgtatttttgtacccattaaccactcccactttatctctccctctctgctactcttagcctctggtaaccatcattctactctctccatgagttcagttttttttttagcttccacatatgaatgcaaacatgtgatatttatctttttgactccacttcttttttcccatccaggctccatggaggggaaagagaagggaaaaggtagacaagaaagattggaaacttggtcttgaccctgctactcacgagccttaatgtgtcttcttacctcttcttttcctcacctgccaaaacctctgcagccctacttctgcatgcctccccaccttcactcttcaggaattactaggaagttctactcatactgggagtcaaatgggatatcaaggagataggtaggagaatcagcagtactaccagggatatagcactggaagataggttcttagcatctcagtgttagcccccttttattaatttctcataaaagcacattgttttattagtggtctttatctacaatagtattggaaaatttcagcaccaacataggtcaagcaatcttatgtagtccaacgtaagtacctaactaccatttatggcattttctttttttaaatggaaaactgttttgtaatgcaattttcttataaatggtagtttggggctacatttaattcatgaaagttagtaagaaagtagaagaagaataaaagtttgagttgacaaatcccatatgtgaatcctttgaaatgtttattaaactaaagcattatattgtggttagatttcaggaggtaaaaagtggtagaaattactttatttagttttttttttttctacaggaataaggtagtggaattgctctctgataccctaagtcagtcaaccagtctctcccaccccacacacatacatttagttttttctatatttctcaaatgtgaggtacctttaatttcttaaaaaatcttagtaagtgtgctgttgctgaatcaattttttttacattaagtactacagggtttcatctgtcattactttttgtgctaatcattttgtaacttttatctgaataattcaatacttgtaactaaattatgtttgaagattcttaatctatataggataaaacttgttttattacatttcatttattagtgttactcatattagtaaagtgtctactttttctctatggttgtcagaagctggagaacaccaagtaatttaagatttatttgatttgagactttaccatcgtcaggatatttaaagatatttaactagggacagtatatgtgttaaaagctgacttctactttataaaatcacgaaatattaaaatatgcagaaaagtgtaaataataaaacaatgaacacttttgcatttattgcctaactcaatacatttagaaaatcgcaatgcaattgaagccccctgtatgaacccccaatcacatcctactcctttccctctacatgttgccattatcttcaattcagtatttatcattcctctgcatgtcttttgattttcctacttatataaatatcacttgaaatatatgaaattattttgcttttttgaacattatatggtagaaatatatgcattcttctacaaacttgcttttttattgttcatcatggtatttgtaagactcattgatgaatgtaaaactcatgcatctatttataatcccgtataaaatcataattaaaagtctcactccattttttaatgtttgactgctgacagctttgaagtcttatctctccctcttctccctctgtcccacatctgggcaagataagaaagccaagatgctgcattccttaccaccagtgtaaagttcaaaccacaggtgagaatcctcattccagccccacccctaaccaccataaaaacccaagccaatcttctgtccttgctctatcaagccatttttggatgtgtctgagagccacccctgctctctgcagaaagcctcattatgtgagtaatcagcttttttatgaatattggtgtgtgtttgtttggtatcattggtgttgacatttaaaccaaattttgaactggagtccatcctgtccttgtggagtattcaaaaaattatttcagtgttcttttgttaatggatattaggttgtttccttttttttatagttgaaaacactgtttctatggatactttttattttttcttattgatttgtagaagttacatttatattctggatatggattccttgttagtgttgcaaatatctgctctcagtccgtagttagtctttttaccttaatggtttcttttgtagtacagaggtgatgaattttgatataaattttgatcaaatctaccagtctatttatgattgatctttgtatctttaagaaatatttctctgatttggagactataaaaatgctcttctaaatgttctaaaacctttaaagttgatttttcccatttaggactttgatctatttattttttgttgtataaattatttcctttcttgtaatgtctgtctggttttcgtatcaggatcatgctggcctcatagaatgagttaggaagtatttgctattcttgaattttctggaaaagtttgtgtagaactggtattatttcttttttaaatgttggtagaatttgcttgtgaagtcgtctgactctttaaaatttcgttgtgggaaggttatacagatgctccttgatttacaatggtgttaaatcccaataaagctgtttaagttgaaaatactgtaagttgaaagtgcatttaatacacttatcctagcaaacattgtagcttagcttagcctaccttaaacatgcttagaacacttaatattagcctacagttcggcaaaatcatctaacacggagcttcttttataataaattacatgaatatctcatgtaatttattgaatactgtgctgaaagtgaaaagcagaatggttgtattggtactcaaagtatattttttatggaatgtatattgcttttgtgtcatcgtaaagttgaaagatcataagttgaaccatcataagttgggaattgtctgtactactaatttagtttctttgttcctttgttactaatgtgtctttttgtttttcctggattgtttccagagtttttaaaaaaatctcttaatcagattgattgtgatgagccttgtagtttccttcatgtttcttttgcaccaaatttgttgatattttttgatttggaagttaaaattatcgctaaaataatggcaaaacccacaattaatagtaacatttgaagaaacagtggctaagaattttagctgccttcctctcccgggactctgagcttcatctccttacctcaggggatctgccaggtgaaaagtattaatacttctctcatccgctttggggactttacctgtgtattaagttgcttgccattgttcaacagtccactgatatttttcatacttcaaaaaaattcttttctgtttcattttggatgatttttatttccattttttcaaattctttaatctttccttttccatagtttaatatgtcatttatccaatttgtcgtatttttaagctcagatattattatttacatctctaaaattttaatttgggcgtctttgttacagttttccatgcctctacttaactttgtaaatgaatagattatgtcataactttttaaatgtccttgtctggtaactctaacatctgcatcaattcttggttggtttcaatttattgatttttttttttttttattttgtaatttcaagcttctttgcattgctggtgatgtttgtttacattcaagccttgtggattttaccttgttggatgctagatatttttatataactaaaaatttcttgagctttattctggaatgtgataaaactacatggaaacagtttgatccttttatgtcttgcttttaagattgattaggtggaaccagggtggtgctcagtctacggaaaattattccttgctggctgttggtaacaggtgctgttcctgtctcagtgtaagtgatgaaaactgttctttctagtgatttcaaatggttctttcccctgccttgggtagttgcctctgtatacactaatgtgtactctgttttttttttttttgagatggagtctcgctctgtctcccaggctggagtgcagtggcacgatctcagctcactgcaacctctgcctcccgggttttacgccattctcctgcctcagcctcccgagtagctgggactacaggcatgcaccacctacgcccggctagttttttttgtatttttagtagagatgggggtttcaccatgttagccaggatggtctcgaactcctgatcttgtgatccgcccgcctcggcctcccaaagtgctgggattacaagtatgagccaccgcgcctggcaatgtatacgctgttgaatactcaatggagcctttgcagatctcaggagttctttttctgcactgtttccccattctgctaactattacctgcagattttagctgccttcttctcactggactctgagctttgtctccttacctcaggggatctgccaggttctgactcagttattacccttgcctgtggcatgatctgaaaattctctcagggaagtacgctggggcatttatagggtcaccttgtttctttaccatttctcaaggattattggccctcactacctgatatctattgttgtgagaataatttgctttttaatttttcaacaagttgggtaaatggtccctgttattccatcttgcccagaagtgcaagttcagctgagagtttaaaaagtgttaagattctcataagttttttatgtagggaatcttatcaactctaaatattaacaattccctttattcatttctaatccttactctcttctgctttctccttttccttcttcctcttacttcctcccacacctctggatagggccttcagtataatgaatgaaagggatgatagcagtgattcctgactcccattattaaagggggaacacatttctaatgtcattatttgttttttacaatgaagcctttgtgctcttctttcacatcagtttacaagtgctgtttgacaagaatttcctgtaagcccttaagttattgagtaacagtttagtgcttaagttaactgtcaaacaacatttattatatgccatctttcaaagtacttacctatattaacgcatgagaggcccaaaacaaacataagaggtaggtactgttattatccccacttcacatatgagagacggtgaggttaaatacatttcctaaggttgcacataataaatggtgaagctgagattcgagtctaagaaacctggcactagagcccaggctgcttctgcactgtatttctctgctcttaactaatatgagagtattaaatgcaattgtcagttggttcatttaaatgaccacaaagacatttctagcacttagtgttcacatttcaattatttatgccagccaagtaaccactatcaacaaaagttacaaacagtagatatttcactataggaaaagatgggagtaaaattgtagccctcttagcaggttggttttgaggaatttaacttactagattcaagttacgtgattcctgctatcccatgagttttgttggctgcaggccagggattggctgtttactactttccgctgtctcagtgctgtaataccctggcctaatggctctaattaactccatatatttgttccagaaagatgaagaggttctgtatagttaagaatcaataaaatacaaattgttgcttaggaaaccccgtgtactcttagtgtcagtaattaactttttttctggagaagtttaagaaacaggcccaagccattcaatagccatttgtgaagctgatatttaaagaaatgtagatgctgcattagaatctttaggcatctacaccaagaatgcagtgattccatcacaaaaatttcttttctttcctattggcagattataggaataaagtatttctgatttaactaactcaggtaccagggaatatttgggcaaattagtacatctcttgttttgttttttaaaattttttcataaaatccagatcctgcacaataataaatctcttaatttattagtagctgctttcttaaaaggatttatgaacataactttctgctttactaatacagagctgaagcagacttaggaccgatgagaagaatgtaaactaaaaatcatgtctttatgaaaataggaatttcttcctaagatctgggtgaggtttctcagtggcatacattgacctcagtggtcaggatacaaaactcacacagacgataaagctgacgaagtggaggaaattggcttgcaaacacttggagaaatcacttcaaagtaaaaccactttcaaattgctttttttttctgactatggaatagtgtttagcatgtttcagcaaaagtctgcacaacaatacactagatataaattttaaaagacaaatagcatcacagagcgacactcagggagagatctatttctgtagagtataagtggcttaagaacctaaatgtggatattttaaaattaaaaaaatcaaacctcttccactttggagattatttatgtgaaggtttcttatggccattcctctgccagagctctctagaagagcagagtgtttcttaattttattccagtcagattcactactattcgaacatttatcccaaatacttatactctcaatacttaaatttatctcaatctatcaagtctcactgcttctccttttctttttattctccacatatttaaagttactagtgtgtccacattagcagaattccttgtgtccaggaagatgtgtcttctgtgtactaaaaagcaatatcctcctgtcctatgtgtacagaaatggatccaggcagaaacctttgagtagtcaactgcatgagcagcttcagatccatgacaagtccttcccttcctgttccatacctgctcttttgttctaagagaaaactgttttataagaaaatatgtatgcttctgtctctattattatataaaattcagccttcctccatttctgccagaaaaaaatatgttctttaagcttgcatttttttctataatcttaataaaattttagaacttagccttaaaaattcaaggctcataattgacaaaatgagtcttcatgcctatagctgcaaagggatacatgccatcttgtattataaaaccaattccatgaatcttatttgatatagaaatcaatatgtctgcaaatatttttatctggttttcttttgctgcatggagatttgtgtgaatatacagaactgttaccaacctgtggtcttcttggttaatagaaatctgtccttcaaatttttcatgtcaacaaatggagtcctgtaagacaatggttctcaaaatgtggtccagggagccctgggtgtccatgtgaccctttcaaggccttttcaagattgaaactattttcaataacgctaatacattcgctttcaaaatttcattatcttgcagtgttacagtggattttaaaaagagactttctgttgtgagatatcataacagattgggtgaggaatcagatatgagaatttagttgtcagctattaagtcaaacattaaagagatttgcagaattgtaaatcagtgccactcttcccactatttgttttattttggaaaatacagttattcttcataagataggttatttatattaacatgtaatgagttttgttattatttaaaagtaagtgaataaatatttaaatttctaatacactaaatatggatagatagaacccacatgaaccaaggccttttggggtcctcaaaaaaattttttcggagtataaaaggctctgcaaaacaaaaagtttgagaaccgctgctcaagattccaaagacttttttttttaaattttattattattatattttaagttttagggtacatgtgcacaacgtgtagattagttacatatgtatacatgtgccatgttggtgtgctgcacccattaactcgtcatttagcattaggtatatctcctaatgctatccctccccccttcccccaccccacaacggtccccagagtgtgatgttccccttcctgtgtccatgtgttctcattgttcaattcccacctatgagtgagaacatgtggtgtttggttttttgtccttgcgatagtttactgagaatgatgatttccaatttcatccatgtccctacaaaggacatgagctcatcattttttatggctgcatagtattccatggtgtatatgtgccacattttcttaatccagtctatcattgttggacatttgggttggttccaagtctttgctattgtgaatagtgctgcaataaacatacatgtgcatgtgtctttatagcagcatgatttatagtcctttgagtatatacccagtaatgggatggctgggtcaaatggtatttctagttctagatccctgaggaattgccacactgacttccacaatggttgaactagtttacagtgccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatttcttcatgtgtgttttggctgcataaatgtcttcttttgagaagtgtctgttcatatccttcgcccactttttgatggggttgtttgtttttttcttgtaaatttgtttgagttcattgtagattctggatattagccctttgtcagatgagtaggttgcaaaaattttctcccattctgtagggtgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaagttttcttctagggtttttatggttttaggtctaacatgtaagtctttaatccatcttgaattagtttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtggcattatttctgagggctctgttctgttccattggtctatatctctgttttggtaccagtaccgtgctgttttggttactgtagccttgtagtatagtttaaagtcaggtagcgtgatgcctccagctttattcttttggcttaggattgaattggcaatgcgggctcttttttggttccatatgaacttgaaagtagttttttccaattctgtgaagaaagtcaagattccaaagactttagaaactgttgccatgtcctctgagaaaagcttcagaagaaaaacctatagttctcattggttgtcttaattgatgatttgttaccctagtaataatgttgtaatgaacttacatgtattctcaaacagtgcagatacttttggtgttttcttctctacctcattcatggaggagcaaataaaaacttacaagcctgttagttttgtaatatatttgaagagcctttgtttatttagtttaacactgtactatgtgacacattaatagaagagtttccggtttgttggtgaggtagtcagtttttagtagtaggaaaagctttattttcaacattgtgatttggggactttgttgtttgaatgctttggtttgctccactttctcatgtcttttttctcaccttctacatgtagtatacttgctatagctttaagttccaattgcatatcttctttatgtaaaatgatataatcttgagtcctgctaagttaggtgggccaagggagaaaaggcaatgagcagaggccccaaaatgttaatggtgttcctatgagatgaggtcaggctatcagaagctcatacagctgtagacactttaaagacatcacttctctttattcttagtggattttatattttgagtatgatttgacgttcttttaatgtgccaacaatattagataccactttattaattaattatttataagatggggtatcactctgacacccaggctggggtgcagtggagtggtcttggctcactgcatcctccacctccgaggctcaagcgatcctcccacctcaactccctgagtagctgggaccacaggtgcgcaccaccatggctggctaattttttttttttttttatgtttggtaaaaatggggtttcaccatgttgcccaggctggtctctaactcctgagttcaagtgatccacccgcctcagcctcccagagttctgggattataggcatgtgccactacacccagctaggtgtcacattattaaacatgcttgaagtaataacttctggccttataaagagtttttataagtctccttttgagggctttattttcttggagaaggctttgttgccaatgtttgttgtcaattgaacacattaactgttgcttctcctttcttagacatgagccagggtgtgacttctcattctgcccctttccaggttcccagattgtttttgtggtaagctcaataatgtcccctaaaggtgttcacattctgaaccccagaacttgtcagtatgttaatttacatgttacaagggacttgcagatatgattaagactttgaaatgaggggattatcctggattattaggatgggcccaatgtgatacaagggtccttataagatggagacaggggaattagagttatagagtgaagatgtaagactgacaagtggtcagagaggagagaagatgctatcttgatggctttgaagatggaggaagggactgtgatcccaggaatggaaacagcctctagaaaatggaaaggaccagtaaatagcatctcacctagagcctccagaagaaacgaacctcactaacagcttaattttaaaccagggaagtaaatttttagactttttacctccagaattataagatgataaattcatattgttttagctactaagtttttggtaatttttttatattagcagtaagaaaccaacacagattttggtacctggaagtagagtgctgctgtaccaagcacctaaaaatgtggaagtggctttggaattgggtaatggttgagaatggaaaaattttgagaatacgtggaagaattttgagaatgattgaggatggagaattttgagaagtgtgatagaaaaagcctatatttctttgaattctttgaattgttagtagaaacatagatgttaaacattctaatagtgagggcccagaaggaagtgaggcacatatcagagaaaacctatattatcctaaagaaaatctgtatcagcttgttaaaaatacagacattaaaaaagcttcatgtgaaggcagatatgtagactttaaaggtattgctggtgacagcacagaaggaaataaggaacattttattgctcctctcttagatatgagccagcatgtgacttctccctctgcccctttccaggttcccaaattgtttctatggtaagttgaataatggccccctaaagatgttcacattctaatccccagaactgaagaaaagaagatccttactatatagtggcagaaagcttagctgaatgtggcttacagttttgtagtaagcagacattgtaagcaataagcttggatatttagctgagatttccaagcaaagtgttaaaagtatggctagcttcttctcgatgctcattaaaatgtgacaagaatgagagaaattgaaggaagaactgttaagcaaaaatgaactaggacttgatagtttgggaaattctcagcctatccagactgcaaatgatgttaaaatttggagattcacagtcaggaaagcttactatggagagaaagccaaagcaggcagtgtggcatcttctcttctctctgatctctgcagcatcttctcttctctctgatctcagtcacacacaaaggtgtgactggacagccttttgctactgccttggaagagggctttgtgaagagattaggcatgcatctcataaatcctctaagccaggaatagagatggaattatccaggatagatatctggaggaagtccttgtctaatggagtgaatactgagacatacacaagagacccacaaggcattttagaaggttgtagcagcagaaacactaccagcttggactgaaagggacagagagagaatggaatgaaagaaggctgttggacttctaaaattctacaggcagaagacaggctgataaaaatatttagcagtaggctgggcgtggtggcacatgcctgtaatcccagcgctttgggaggttgaggcaggaggaacacgaggtcaagagatcgagaccatcctggccaacacagtgaaaccccgtctctaccaaaaatacaaaaattagttgggcatggtggtgcgtgcctgtagtcccagctactcaggaggctgaggcaggagaatcgcttgaacgcaggagaatcgcttgaacccaggaggcggaggttgcagtgagcaaagatcacaccactgcactccagcctggcgacagagtgagactctgtctcaaaaacaagcaacaaaacaaaacaaacaaacaaaaaatttagctgtaaatacatgctaccttttatgaaaaagaatgactctgaaggtggaatgagcctgggtccagagggtagacccttgagccacagaggatatttttaggcctttagcctaatggagtatgactggttagattttaaaattgcttgggactggtagctctttttttctctttcgtttttctcccattttggatgggaatgcctgtaactatcaaactatgcctgtttcacctttgtattttgggagcagataattcgttttgcagtttaacaggtccactgatggaggtgaatttttccccaggatcctttatatctagagcctcacccatacctaaatgagatgacttacatgatgagatttgagacttttgagctgatgagacttacatgagattttggacttgatcctgtaatgggttgagacttttcagatcttggtatgaaatgaatatattttctatgtggatctgatgtgaatgttttgttttgttttgttttggagacagggtctcactctgtcacccaggctggagtgcagtggcgtgaccatggctcactgcagcctctatctcccaagttcaggtgatcttcccatctcagcctcccgagtagctggtactacaggtgcataccaccacgcccgggtaatttttgtactttttgtagagatgggtttttgtcatgttgcccaggctggtcttgaattcctgagctcaagtgatccacacacctcagcctctcaaagcgctgggattacaggcatgagccaccgtgcccggcccgatgtgaatctttgggggccagagagtggactatcataggctgaataatggcctccaaagatgtccacattctaatccctgaaacttgtgaatatatgaccttacacgatgaaaagagactttgcagatatgattaagttaaggatagatattaaggtggggagattatcctgtattacccaatgtagtcgcaaagttccttataagggaggcaggagatttggagtcagaaagggaagatacaaggttggaagcagagatcagagagaagagaagatgctgcagtgcctactttgaagatggaagatggagccacgagccaaggaatgtaggtagactgtggaagctagaaactgcagggaactggattttccccaaaagcctccagaagtaatgctctgtattgacaccttaattttagcccagtgaaacagattttgcatttctgactatattagttcattctcgcactggtatagagaaatgcctgagactgggtaatttacaaagaaaagaggtttaattggctcacagttctgcaggctgtacaggaaacatagcagcttctgcttctggggaggcctcagaaaacttaacaatcatggcagaaggcatgtcttacgtggccggagcaggtggaagagagagagggggaaggtactatacacttttaaaacaaccagatcttgtgataactcattcactcattatcacaagaacagcaccaagtggatggtgctaaaccattcatgagaactccactctatgatccaaccacctcccatcaggccccacctccaacattggggattataattgaacatgagatttgggtgggaacagagatccaaaccgtatcagtgactttcacaactataagaaaatacatttgtattgttttaagcaactaagtttgtcataatttgttatagcagcaacaggatgattacaacttcttaaacaaacaaatatgtatctgtttaaaatgttgattatcaaatacatcaaacctatagaaaagaatcagaaaataacagggattcactatccagattaaaataaacattttaccacactttatttcaatgtcttgttaaaaagaaataaagtgtacaaatacaccttcagctcactctcatcccatttcccttgtttcctctgtaaaagtaaccattattctgagattggtatgtatccttttgggtcacgtttttggacatatacccctaaaatacatatagtattgttttctacgttctaaaatattgtataaatgctatcatactgtacctgttatttaactccttattcatcaacatgtttttagatttattgagttcatttttaactgctatatagtattgttgcagaattttgctccttagttcagctagaactgggttcttgtcacaagaccaggaaggattaggaacatggatacattgaagggtgaggggaatggaatttattgggtgaaaaggaaaaaaaaaaatcagcaaggggatcctgccagcagcaggctcccatctcacagattgaatgccaggccaccacacaggaaccgaagatgaagaggccaggctcctccccactgcaaagagtgaacttcccatggctccaccccattctcccagtgggcaaactagtcggagattctccgggggaccctcctcctatctctttctcctgcatttatcagtattacattttgtggtgtttatctttccattcctgatatgtcatataccaaatatggacatttacttgttgccagttttttcaatattacaatgctgaaatgagcattcttgtacaaatttcctgtgtacgtgtgcaagattttctctagaataggtatctagaagaggaattactgtatagtaagttatgtacatcttcagttagctagatgttgaaaaattgtggctgtgacactttaatttcaatttgtctccctatattttcagcactttgtattgttggacttttaaatttttgtcagtattatgggtgtgaaatggtatctaactttaatgtctcagataaactagggggatttgacatcttttcatatattgactggccattcttttttcatcttctgtgatttgccactttacatcctcttcctattgtgttgggtcttttttatatacctgcaagacttgttgttatatatttatatacaatggatatttatgttgattttacagtttataatatcttctagtctgcggcctgtcttttccatctgcttattgtgtattttaaccaagaccaccctcaggcttgatgatttgctagaaggattcacagaacttacaaaagctgttatactcatggttacaatttattaggatgtgtgacggtgcatgtgaagtgttgtcagccagggaagcatacctgaaccttggtgtcccgggcttttaaaattgggaatcagtcacataagaatgcagcacttgcatgactagccttagttactgagactacagcctcccctcacccataaagcacaaaaacaggcacttaccacaaatcacagcatttgcacaaactatctgatcataatggtactgtatggcccaaggcctcaggcatatgaaaacaacgtgaagcaaaatatgccggtggcttgagaactcatctcccaggaattgggcaagggccagccactcctggagacaggactttcctgagaatttgcagggtttgggggtttttgagttaaccctttcctgcacaggaggtatatattttaatagtcacatttatcttccttttccttcatgttgtactttttctgttttttatttcttttttttctctttttttttcttgcttccagtgggattaagatcttttctgttttttttttcatctcgtttaaggaattcttccttaccttgatgtcataaagatattctactataaattctcatgtaaaattttatagtttccttttcacaatttagctctgtggtccacttggaatttctttttgtagaaaagaaattctattagaagaatgtagggatgtaaggatcttacttaatttttttctgaatgattaatgagtggttccaggactattaattattctgttatttctgcacagatttataatgttatctcagtcgtataccaatttcctatatatatgtgtgtctgcttctaggctttctattctgttccattggttcgtttgtctatttctgtagctttataatgcatcttaatatttggtagggaaaggcctcttattcctctccctcaaaaatatgttcttttcatatgagtttaaggtcagcttactttaaatcttaaggtctgtaagaaacattgagatttgattagagctgcattttgtttatagattagagacagaactggcatctttacaaaaatgaaggtggttcatctctccctttatataggtgtttttcattattttgagaaagttttataagtttttttataagtatctaattcatagtttgctagatatatttttgtgtgcctattgctctcatgaatatttctaaattacattttgttattggttgtgccaggtgtataggaatgcttgattctggtatattgttgttaaatccatccaccttgctgacctctctctctaagtccaattatttgtttatatattttgctagggttttatataaatattatataaaacatgcttaaaagtacatgaaccataactatagagctaaatgaaatgtcacaaagtgtttttggtttatttatgtaatttgtgaataatttttttcccttttccttataccgccagaatttgatgtctttctatgtaaaataaaatagaatttcttttctgaaataatctctttttttttagacagagtcttgctctgtcgcccaggctggagtgcagtggcatgatctcggctcactgcaacctctgcctctgaggttcaagcaattcccctgcctagctgggactacaggtgcgcaacaccacgcctgtttaactttttatatttttagtagagatggggttttgccatgttggccaggctggtctcaaactcctggcctcaagtgatctgcccacctcgacctcccaaagtgctgggattacagacgtgaggcactgcgcccggcctgaaacaattttatttaagcacctgaggaggctcacgctctagtgagctgtgttggatgtgtcaatgcttttcaacttatcaaagaaaggaaattaccagtatttggaaattccaacagaacttaacaaaagggcctacagagtggtgatttcagttagttgaccacagtccaggatttggttctgagcatttgtgaaatgttgaaacaagacttggtggtaaacaaatacaaattaatttactgagactaacatagatacgggtacagagagaaaaacacacacatcatactaatgtattatttccactggtcaacacactcaggccttttatccagggcatgtcagtttcagtattgaggtacatgggaagtcaaactaagaaaacaaaatgctggctgggcgcagtggctcacacctttaataccagcactttgggaggccaaggcaggcacatcacctgaggtcaggagtttgagaccagcctggccaacatgatgaaaccctgtctctaccaaaaatacaaaaaattagccaggcatggtggcaggtgcctgtaatcccagctactcgggaggctgaggtaggagatttgcttgaacccgggaggtggaggttgcagtgagctgagatggtgccattgcactccagcctgggcgacaagagtgaaactccatctcaaaaacaaacaaacaaaaaaaagagaaagcaaaattctgtttactgtgacctagcactaaagcaaaggaaagtaaggaatcttgtaaacgtggaatcctttgtattaaggaatatattcagttactctgccttctctttatcacaccccaagcagtttgagaggcagcaagatgcagtggaaaagtactgggtttgataactgattgacagggatttgaatcctagctctttgtggatggaccttaggcaagttactgcacttaacttctcagagtttccattttctcactgttgaaatagaaatcatgacattgttaatttaaaagaaatacagcatctcaaagtaattattatagagtaaatccagcagaatcacaggcttgcatttgcttatccaggcctgtgagtaaagaagaaagtgccagtcaatgattatgcctaatttgccggaataaatcctagtaccagtctgtttccaagtacaagtagtccccgcttatcctccagggatacattccaagaccttcagtggatgcctgaaactgttgacagtactgaaccctatacatacactgtttttttcctatacataatgtacctgtaaattaggcacagttaacaacaataactaataatgaaatagaaagattataacaatagactgtaataacagttatggtaatgtggtctctttctctcttttctctcaaaatatcttattgcaccatacttaccttcttgtgatgttgagagatgataacctagccagctactagatgactcatagacagggagcatctatagcacagatacgctagacaaagggaggattcatggcccaggtggtacagccagagatttcatcatgctattcaggacagtgtgcaatttagaatatatgaattgtttatttctggaatttcccatttaatatttttggactgtagtttactgcaggtaactgaaactgcagaaagtgaaaccacagataagggggtactgctgtatagagatggcaactacaactttactaccagatgtattagtttcctattactgctgtagtaaattatgacaaacgtagtttaaaccacacacttttaatgttacaattctggaggttagtggtcctaaaatcaaggtgttggcagggctacccttcccttagggaccgctagaaaataatctgtcttcttgctttttccagtttctaaaggccacctaccttccttggctcctgctccctttctccatcttcagacataacagcaaagcattttcagctctctgactctgacctgctcccgttgccatctctcctctgactctgatcctcctgcctccttataaggatcccagtaattacactgggctcaccaagataatccaggataatctcttcatctcagaatcttaactcagtcacatctgcaaagcccatttgccatgtaaggtaacatcttcacaagggttgggatttgaacatcttgggaggaccattattctgcttaccacaccaggttaatgaattaccaagtaaaatacctaattagaattacacatctcttttgtaggttattttcactgaaacaggcattaatttctaaagttgtaggagtcataaaatggctttatttagacaatacttccaaggaaagatttgtattaacagagaatagaactagttggtaacagttacaaatattctcaaatcaccatattgcaaaggggaacaagatttacattcttgttaaagttctcaatttaatgcctttttaaattcagattatttgaaattattgtgcagcaaaatggtttccacgcctccacagcagcaggggagcgggcacagagccttcatatctttctgagtttccttttgttaattctgaagatttgcatttgtaaagctaggctctggaatttcttagctagttttaaataaaaaacatgtctgggtcctcgttatgctggcagaaatggagaaaaagctgaaaggattttattaccaatgaaattctatattttgtgccttgtaaagtagttgtgaagatttaatgtgaccacttacaagccctgactactgcttgatgaatgagagcagtttgagtctcttaccttcttttttgtactttccgcccttttgtatcttcctgctgagctcagataatttcgtcttacctgtctttaaatttaaattctctacttaatcttctaattaaagctatcccttgagtttttaattttgagtactgtattttttttctaaatgtttgattaggttcaattatggtctgccatttgttatggcttcctgttgcttggtaagatcttcaagttttttatttatctctttatgcatagtaaacatagtcgtcttatagtttgtgtttgataatcctattgtttaaagtctttttgtgaacatttctgttgtcagctgatcctgctgatttgcttctttatctaattcaaggctcaaggttcccagggcaagttatgtgatccaaatctgagctgcaaaactggcctgcttccattcaccctcccctttagggggtagccctttgaggtcccagctcattgttgggaatgtctcctcttagttttcccacttagtgtagctctgggttttaatctcttatctcttttgcctttcaaggcagccaaaatgaaagctgaaatttttggaatagacaaatgcccttaggacagaagttgcttcactgctctatttacctctaggttccccatttcccaggaatgttgccctagtgtttccatactgccattttattgtttttaagtaggtgttactacttttctttcatcaagatttttaaaatttgttttcaacctgatgattggtccaaataatgtggcaggcaatcatcagaactagaaacatttcttataactccttgctacattttctttgagattagatttaggctcagaacttcattatcttttgggttttgtttcttctgttttatagaggacacatctgatgctcagaaaagtacaaatacttgctcaaggtcacatagcaagtaagtggtaatattgggctttgaacccagctctgtccaaccctgaaacctacactgtgtcagtttttgttcctgggttctggaacttctttcttttaggaagcaggtaaatgactcgtgattttcttccttgagttttatctctcaaggtcaagaccatctatctccctgtctcttggaagcacacacagttctgtgcttttttcacaaggtccttgtcctgtttctaagacgtcctgataaataagtatccctttctaccacccaccttgtacctttcagaactgaattcagggacattcagtatccaactgtaaccataaagtttgatttccttttcaactgcagtattttcctcaaaagacctagatgaattccctgctgaatttggaaagagctaaggacaaagtgacccgggaagcaatccttttagatgaaaggaggagggagaatgatacaagtaggggttagagaacttacagtttagttgtatagtggtgggatagttgaagattttggattggtgaatgcccacaaggcaccttgtcatggtgacaaatacaggagctttggagccagacccacttcagctgaatatcagttcacctacatattaactctaaaatgttgggcaagtcagcttccctctcttgaccatcagtttcttcatccacaaacttggaataataatagcaaactttcaaggtttccgtgtgaaataccaatgatgtatttcagtgaagtgtttgtgtttggtgcatgcttactaaatggttgtggtagttattattattgttgtccccctcaaacttttcatctggtgggtgccctaagaccaggcaggagagttcatttttcatttgtgtgtatgcccagttactcctctctcctctgttgcatcatcttcttcagtctcctgaagatctcttaccgtctacgttcttcccaatccttgctttcctctcctagttctacacagtcaacacctcctttgttcagataatcttcccatttccctactcaatttaatctcttttcattgcctctgcattgtcctccagataaaccagtcatcctcatatcactttgtttcttcatgtccctctctccctgatttgggaggccaccccaaagtgagacatatcactgggtctcagcaggccttaatttctcagctgattctctgtcttattttgtcagcttcttttcattaagtaaaagttatgtttttctgtgtattattttttaagctgtttagttatggatatcttccttttttacgtattttacattataaaagtagagacatgctcattttgaagattttagagaacaacaaaactttattaggaaggaaataaaagtgacccacagttttattaactagagataaatactattcagtaattgatatatttcttttcagtatatacagttttgtatcatttgctaggactgtgtaccacagtctgggtggcttaaacaatagaaatttattttttcccaattctggaggctagacgtctgagatcaaggtgctggcagggttggtttcttctcaggcctctctccttggcatgtagatggccgtcttctccttcctgtgtcctcacatggttttccttctctgtatatctctgtctttatctcctcttctttttattttatttttgcaattctcctgcctcagtctcctgagtagctgggattgcaggtgcccaccaccatgcccggctaatttttgtgtttttagtagagacgggttttcaccatgttggccaggctggtctcaaactcctgacctcaaatgatctgcccgcctcggcctcccaaagtgctaggattacaggcatgagcccccgcaccgggcttatctcctcttcttataaggacaccaggcatgttggattagaactctaatgatgtcattttaatttaactacctaactagacactaatgatgtcatttttaatttaactacctttttaaagatcttgtctccagtgtagtcacgttctgaggtactaggggttgggacttcaccgtatgaattttgaggggacacagttcagcccataacacctgctttcttctctaaaagttatcttttaagaattcccacttgtcgataacaattctttgacaatagttctgatgactacataatatcccatcattaaaatataccacaatttacttaatcaatttcatattcttggacctttcaggtgttttcattttttcactaatataaatgcttccataagtagttttgtacatggatgtttggatatctgactatttgtttggaatagattgcttgaagagtgattattgggtcaaaaggtatgactattctctggtttttaattacatactgcaaaattgttttccagaaaattgtactaatttacattcataccaggaaggagaatagtcagttaggcattcatataagctgctggtgggaatgagaaaggaaaaataaactctcatggttgtttcactttacattaattgatgactaacaaaatggaatatttcatgtatttattaatctgtttgcatttccttttttgtgaactgttactcatgttctttgcccatttatgtatgtgagtctatcattttaggtgataagattatgatttagagtgagttctactctaaagagggaaatttcagaaaaagtgaaattccaaagaatgttatggatccagaatccaaggactattggtctgagtctcttctttggagaagacttggcatgtgatgacatataggtaaaggaatggctgcaggaaagcttggcagggaagagttgaatgtattccttacgcagggaaatttgttacaggcacagtactgccacttatactactgaagagaaaggctgtgagtgaattaactgaggaaaggcaagctagatgcatattatatatgggaatcttctaggaaaaaaagcacagagatatgattcacatgaccataactcttgcaaaggttttagaatttgtgagacactggggaggttctcatggggaaaagtcttatgtatgtgattaatgtcaaaaagccctttgtcagtgttcaagggaggtacctcagagtactcatgataaagagaaaccctatgaatgctgtgaatgtagtgaatataaagaaatttttaatcatgatgccagtcttacttaccatctgaggactcacacctgagaattcattgatttgttatggccataagaatgtggaaaggcaggacatgattctctttcaacaccagaaatttcatagggtagaaaaactttcccaatgctggacaaattgcagtgggtgatgaagctttttgaatcatgcaaaagtttatactggacagaatccctatgagtgtactgactgtgggaaaggcctcaagacaaactcagactgttttttttaacatgagagaattcatagtggagaacaaccctatgctcataatgcatgtggaaaggctttcagatccagctcagactttactaaacatgagagaattcatagtggaaagtaaccttatgcaatgatgaatgtgggaaagggtatctggagataacagaccttcaaaaacattagaaaatttatagcggagatggaaagagatcctttcagtgtaatgaatatggaaatgtttttaatctagagctcaaattttatttgtcatcaaagataatcttttacaatgaatatacaaaaacctccaaacagaaatcaatccttgttcatcatctgcagattcatagtggacagacactctgtacctgtaatgaataagccttcaattagaggctaagtcttattcattatcagaggattcataaaggcatcaccttctatgtacgtaaaaaattatgggtatgctttcagcaggatatcagccttatttgatattggcaagtctatagcgagttcgcttaaatgcagtgagtgtggaaaggccttcaatctgaagtttaatcttactcagcatcagaaaatacagagtggcaggaatcttattaatgtaatgtgtgtgggaaagtctttatgagaaaatcacgtcttggtaaaaatgaaaaaaagattctttgtaaaagttaaaatagttaccacataattacacgcctgccagtgtgccaagcactacaagaactttacattgtttaatcatttttttacaataatcatacaatgtagaaatcctcgttgttttacacacacatgaagaaaccaaagaaatgaggtggaaaaacttccccaagatcacatactagtcactggaagagccagggtttgagtcctagagagtttaattgttctgggtttatagtggcaatatgtaaatcttcaaggatgtgttagtctttattcattattaagaaattccttcagaaatcaggattcactcttcagtgagtattgggagccttcagtcagttttggaattagagactctacattgggttctatcaaatttagtaaggactataaagactttatcatatttatattatccctttgaatagggattacttccaatcttgaaagatttcattaataacaaaattctgttctcaaatgctcaccctaaccactttctgtggtgtagacaacgtggagtgggatggaaagcacaggctctgggattggccaggatagcttcaccatcaggaacaaggtagagttacccagttcttaaaaagattgagtaggaatggagaggacagatgtggtgagagcttcaggaacagagtcaggtcattctaggaattataaccaaacaagccaaaataaagtagaattcagcctataaggaagtggagaagctagggtatgtggcatgattttctccccagatggatttagctataggttgcttgtgtatcacccagtattcagaggaacttgaatttgaaattgcttcaggaatatgcagtactctagcactgagtcaaaaataagcgtgactttcagaaactcaaggtataagaaatattaataaattgattttctaccttctcacttcaaggaggcagtgtgctacaccagaaagtattcaggatctaccttcaggtataactgggtttatttgccagcttaaccaccttctagctgtgtgactttagttatattaataaatctctttgagtctcaccttgctcattttttttttaggtcaggatataatactgtaccaagttgtaaggattctagataaagggtataaagtgtctagtatggcgcctggcatgtagtacatacctaataaatatgttattgaaatatattattgttggttctgcaaggatcttaacactctataatagacctctccaaccccagttggggaatgaatgtgttacacttgtgttgtgatagtattaatcactttagattatggggcttctgctggcttatatggtacctttgtgtgaattgtaaaataatacctcttcctcaaaagactttcttaccacttgctagaaaattgtcataataaacacagatatctttgatggtcataatgtgaatggtattctgcagaatcatgcggcccacaatttgcaaaacctgaagttggtaggctgaataaatggccccccaaaactgtctgcattttaatctctagaacctgtgaatatatattacctgaaatggtaaaagggacttcggcagatgtgatcaaattaaggattttgagatgcagggataatactggattattagggtgggcccaatgtaatcacaaggatccttataagagagaggcaggaggaccagacttatagagagagaatgtgaggactaaaggagaggtcagagagggaagaagatgctatgctgctggctttgaatttggagaaaggagccatgaacaaagaactgcctgggaggcagaggttgcagtgagctgagatcatgcaactgcactccaacctgggcaacagagtgagattctgtctcaaaaaagaaagaaagaaagaaagatcctgtgggtaggagtgtgatggatagccgggtgcattggctcacatctgtaatcccagcactttggaaggccgaggcgggcagatcatttgaggtcaggagttccagaccatcctggccaacactgtgaaaccctgtctctactacaaatacaaaattagccaggcatggtggtgcacatctgtagtcccagctacttgggaggctgaggcaggagaatcgcttgaacctgggagggggaggttgcagtgagctgagatcacgccactgcactccagcctgagtgacagagtgagactccgtctcaaaaagaaaagaaaaaaaggagtgtgatggatagattggaaaagagaactgggtgcagggagaccagttaggaggctatttataaagtagatactgaaatctgggttaaggcagtgggaatgaaatgagaataccatatatgcaataaatttggaacttggtcactgactagatatagggggactgacggagaagaaggaatcaaggatgatgcccagttgtctttctgccttggatggttaacaagttgcaaaaaccattcatggagaactcagaataaggagcaggtttgtggggaaagaatgacctttgcagtgtccaagaggaattattcagtaggtagtccggaattcattctgctgctgtgaagcaagtagggttacagatagaaatcagatagaaatttggtagtcatcaaatacagaagtggtggttttaattgaagtatcaatgagattgccccgggagagggtggtgtggagtgagaaaaaaaaaagacccaaggcagaatctcagaaacctaggcattttgagggaagacaaagctgagaatcagcagaagaaaggtaggagggggaccagaggagatacagcattcttgttctgccctcttgtggcaagctgagtgtgtcccagcataaatcttccctctcttgtcttcagtcttccaggtctctgactcataattccattcccaccctacctgggagaatggagctgccaggtcttctcatggtcatttctcaaatgtaaagctcctcttcgattatttctacaattcaagagcaatttggaccccacccccatgttgcaaaagaataaaaagcaaacagtggggcggggcttcagtttccacatttatatgctccaccatcttttgatctattctattggcctcattaattttagtacatctcaactctcatcatatcccttcgctccctttataattaaaagacattttattttgaatttttttattatagtaaatatactgtatattatagcaagacctatgtatggcttaaaaaagaaataacaaaaaatagcagtattagcttcactttttttcaccaccagacttgaacacttgaaggctagaatgcaaattagccaactttgaaatctacttcttttggtttttatctaaataccattatttcatgagttacctatttcagatattagctgttgacttcccattatggtagatgaagatttaattcactttttctccctcaattaccttctctattcttttagtatagctatagcatactttctggttaatgatgtttatactattgtgattgtgcaaacattgttcactaaagagacaggtagtgaattgtgtctatgtttctgttttgaacacatttgtatcatttctagagttataattcccttttatctgtgtatttttatatatttatatttgaggcagagtcttgccctgtcacccaggctatagtgcaatagtgcgatcttggctcactgcaacctctgcctcctgggttcaagcaattttcctgcctcagcctccaggcagctgggattacaggcgcccaccatatctggctaatttttttgtatttttagtagagatgggggttcaccatgttggccaggctggtttcgaactcctgacctcaagtgatctgctcgccttggcctcccaaaatatccttattttttctgttagctctatcatatgtctatttttgtgtaactgctaaaaaacgtcagagtattcagaatatttattttctagaaatcccctttgtagagccttctctcttgatccagtctgggctgttttcaatcctgaaagcttttgggatttccactttatccctaatattctaaactttcatgatgatgtgtggatatttgtatatctgttgtcctagatacctggtaggtagactctttcagtttgtatgtttttgtacttggactctggaaagttttattatttcttggatactttgtgagctccataaggacacatttttatctattttatttatttctgtttttccagtgcctaaaatagtgcctgatacatgatagacatttatttgttgaatgaattactatttacatttaaaataataaaaatgaaataatgcctccagacccaccgaccaggacaagaaatagaacattatcagtactttagtgccctatccaatcacaccttcctgtccgcctccacctagagataatactaccctgatttttgtattaacaatttctttggttttcgtatatttttatcacttgtatatatgtttttaaacaacatattgtttagttttgaaaaaatggaaaagcgaacacaaacctagttgtacgagaaaagggtactgttgcccctgttagatagtctcccaggaaaacagaggttctgcgtcaaaaactgattttagcttctctgagaactgtaaagccatttctgggataattagtgaatgaggtcatgaaatttactgttactgatgaaagtcctatctgtctaatttaatttttctattgcaggtgacattttctctcttttcagctctcagagttatagttgacaaaaattatacgtattcaaggtgtatacatattcaaagtgatattttgatataaatatacattgggaaatgatttctacagtcaagctaattaacatatccatcaactcacagttaccttttttgtgggaatacttaagatctactctcttaatgaatttcaagtatgtaatacattattactaactatattcaccatgctgtacattagatctccagaacttactcatcttacaaccacaagtttgtatcctttgaccatctctccacttcccccacacactggctgaccttgggtaaccacccatccactctctgtttctatgagttcaactttttaaagattcagcatataagtgagatgatgcagtatttgtctttccgtgtttggcttatatcacttagcatagtgtcctccaggttcatctgtgttgttgcaaatggcaggatttcctttatcaagggtgaacaatattccattgtgtgtgtgtatgtatgtgtgtgtgtgtatacacacaatttcttaatgcatctgttgcagacacttagattgttttcatattgtaactattgctaaaaatgcagcaatgaacaggggagttcagatgcttctttaagatagtgattttatctcctttggatatacacccagaagtggaattgctggatcatatgttcaattcttaattttgggggggaacctccatactgtttctgctagtgactgtaccactttatactctcaccaacaatgtataaaggttcactttttgccactttttgccaacacttgttatcatttgactttttgataataactatcataacaagtgtgagatgttatctcattgtggttttaatttgcatttccttgaagattagaaatgtttaacactttcaatatacctgttgggcatttgtatgtcttccttggaaaaaatgtctattcaggtcctttgcccatttttaaattgggttatttgtgtgtgtttttttttaactactgagttaactatgtgagttccttatatattttgtatattaaccccttatcagatatatggtttgtgtatattttctcctaatctgtgggttgccttttcattttgttgattgtttcccttgctgtgtagaaactttgtagtttgatgtagtcccacttgtttatgtttgcttttgttacctgcctttttggtgtaataacaaaaaaatcattgtcatgttcaatgtgaaggaccttttccgatgttttcttctagaagttgtatgttttaggacttgcatttaaatctctaatccaatttccaatttgagttgaggggtgtgagagagagagagagagagtgtgtgtgtgtgtgtgtgtgtgtgtaagataatgatccaatttcatttttttctgcaatggacattcagtttttccaacaccatttgttgaagaaactatcctttccacattatgtattcttgatgcctttgtcaaagattagttgactgtatatgcatggatttgtttctgggctattttatttatttgtctatgtgtctgtttttatgccagtaccatgttgttttgattactatagctttgtaacgtaatgtgaaatcaggaagtatgatgcctctgactttgttcttcttattcaagattgcttttagttattaataggggttttattgaatctgcagattgctttagttagtacggacattttgacaatattgattcttccaatccatgaacacagaatacttttcaatttatttgtgtctttttcaatttcttccattattgttttgtagttttcagtgtacagatcttttacctccttggttaaatttattcctaagtattttattggttttgatgttattataaatgggattattttcttaatttcccttttggattatttattgttagtacatagaaatattattgatttttctatgctgatagtatattatgtaacttaattcatttattagttctaatagtttgttttatggagtccttaggtttttctgtatatacgattatgtcatctgcaaacagatataatttcacttcttcctttccaatttggatgcattttatttccttttcttgactaattgctctggttagggcctccagtactatgatgaatagaaatggtgagagtgggcatccttgtcttgttcatgatcttagaggaaaagcttacaacttttcaacattgagtatgttgttagccatgggcttgtgatatacggcctttactgcctttgggtacattcctcttatacctaatttgttgagagtttttatcattgaagatttctaaattttgtttctctttctctttaagattgtaattttttttcttgtttccttgaattcaagaatttaatcagggtatcctgagtatatcttagaatgtaagctccacaaagacagggatttttgtctgttttgttcactgatatatcccaagtgcctagaataatgctggctatgtaataagtcctcattagatgagttgattaaattaatgtatgaatgcataaattgatgaatggatggatgaacaggtactcaatcttgtctggaattcaggtagccctttctttagctcagggaaattttcttctatcatttagttaaatattgcctttcttccttctatttcttttctcctttaactccccatccatctcccatattcacattttaggttcattgacactatcctctagataccttgtcttgtatctcattgtatctattgctttttgggtttttttgctcagtgccttgatataaatcttgcacttaattttctagtcaagtaattcagggctcatcattgacatcatttttcattttattgtttaattggaatttgatacagtttggatttgtgtccccacctaaatctcatgttgaattgtgatccctaatttgggagagaggcctggtgggaggtaattggatcaagagggcagatttcccccttgctgttctcatgatagtgagttctcacgagatctggttgtttaaaagtgtgtagcacctccacccttctctctcttcctcctgctctggccatgtaagatgtgcctgcttcactttcaccttctgccatgattgtgagtttcctgaggcctccccagccaagcttcctatacagcctgtggaaccataaactaattaaacctcttttctttataaattatgcagtctcaggaatttccttatagcagtgtgagaacagactaatatagaatttgtttttaaagctttgagctctagaaagtttttgtgtgtatatgctgcattttcctcaggtgttcttattactttttagtcagtttttacatatcttgtctaatagctttgttttatttctctctgactgctgaaactttttaatgtttgtttttatgaatgatcactttgtgggccttgatgtagattggaatgtatttgagtcagtactgctagaatatcaactatgtgcagatatgaatggtgttactatggaaacgaggtcacatgtgagttctgatcttcacactgccttatttccagcgaaaagttgccatttctttagaacactgattgtccccggataaaactgtgaacattccaatatttaggcctagtcaccttggacacaaattgcactctgaaatattgttctttcactgagagcagacaagcacagtatttaagtttatatgcaaggtctcaaaagctaacacaaagctagctagcaaaaagaaaaaagaaagagctaaaatgactgttagatgtaattctacataacctgtttttaacaagagcattctataagactaaattctaaattttttcatcaaagggtgtttttctactcctgattaattttcacctactgtaccatggtaactctacccattcagaatttgaattcctagttcagggaaaggaggaatctggggtagtggcaatgcaatatccttgtttagacttgatgttaatttgtatcagtgtttgctggtaatgctaatcaaaaacaaactccacctagaaacctgttagtggtaaaacatggataacaccagtaaagagaatttatatgatttcattgatccattgtgtggagctgtgagggatcaataaataacattcatctttcctgactaggttcagaaccaattgaaattgaaagatgtaggaatccgataaatggaactcaaaacatcatctttattactgataacacttcagagaatatggctttaatgtggacttcctaatattggaccccagaattaagcagatttacctaaaccaccataagcaatggtgaaaaaccacaagactctgggccaaaagtgggccacttgatgcatgatatgttttctgtaagcatgtagatgaagggcagagagcaagagcctaagccaagctgtattagtcagggttctctagagggacagaactatatatacacataaaaataaaggggagcttattaagtattaacttacacgatcacaaggtctcacaataggctatcggcaagctgaggagcaagaagagccaatccgagtcccaaaactgaagaacttggagtctgatgttcaagggcaggaagcatccagcacgagagaaagatgtaggctgggaggctaggtcagtctctccttctcacgtttttctgcctgctttatattcgctggcagctgattagattgtgcccaccagttgaagggtatatctgccttccccagcccgctgactcaaatgttaatctcttttggcaacaccctcacagacacacccaggatcaatactttgtatccttcaattcaatcaagttgatactcagtattaaccatcacacaagcatactcagatgtttcttccaaacatactagtcacataactcattccttcttctgtggacagaaaagcaggagtgttagtctatttgaagttcttccacttagaaacatgagaagtaaagattaagtgttccctctaacatagctcagtgatgtattcagtattgccatgtgcttgaacttgtctatctcttcaggaccaaaaatatcataattttgctgtgacacgaaaggtattaggatattttaggaagactgtagtacaaatagctcaattacagaatatcatgttaatgacatatcaatagaatatttaaaactccatctaaatgctataacaaaacatgaagaaatgcttcttaaaggcagatgtaccaaaaggaatccattcaccactctctaccaatgggaacatcaaacattgtacctttagagcatggtatatttctccacttaacacctactagaactctgcagtgaggcttcaagtgagaaacttctctgttatatctgggttgatgtaagatccacatatcaggaaagtaagtgtgtgtgtgtgtttgtgtgtgtgtgtgtatgagagaataagataggagtgggggacaagaagggagaggagaggaaataaaagaaggaaaatgagatatcagggaatgagcaccacaagtgtaaaatcctaagtgatgtgggtcatgtgtttgatggagagatagggagagagtattgtgtggtagtggggtagtggaggtatgtggccaaggtatgtgtgataatggtgtcaatggggacagtgtaaggatggtatgaaatcactgtgatcatgaagacagaggcaatgtgagtgacagtaacaggaagagatcagaatgtatgtgacagttgtagttatggtcacagtgtatgtgaaagacaagaattgtgcatgtgtgtgaatatggttgtgtgagaaagtggggagggagaggacaggataatgggacactgggatcattgtgtgtgtgaaaatgtggatgggacatgttgatgtagagggaggttggaatggggcaggtgtaatgtcattatggaagataggtacatgatggaagtgagaaggctggtgtatgtctgtgtgtctatgtgtgctggggaaaatgagaagtgtgtctctttgtgaggacagatggatacagtgagcatgggtaatcacagtcaatgaaaatgtgataatttggagtgggaaaatcatgagtgtctgaatagggttgttgaataaagtatatgatgggaaaatgcaaagagtttctgagtgccagtgaggaatggggaatatatgtgagtgagagcagagttgatgtggttattggttgtgagtatgtatgaaatggaggtggtatgagaatgtgtggaaggagatttggaggatgatacaagtttgataatggagatgtggactgtgtgtatgatagtgggtgtggctagacactgcgtaatggtgtagtgtagggattgagtaattggggtgtgactatatgaatgatggggatggtgtgtatgataatggggattgatttaagttagtggtatttgacagtgggtgtcgtgggtaccatatctgttctggtctaaagacattttatttatgatagtacaggataggacagagtatgtgtggaaatgggagtgatagagacagtgtacatgttagtgggcatattaatccattttcacactgctataaagagatacctgagactggacaatttattaaaaagaaagagggtttagggtgctggtattgcaggtgtgaaccactgcccttggcctggaagatctccatttttatgattttttttcatttttaatttttttttaagagacagggtatccgccgggtgcggtggcttatgcctgtgattccagcagtttgggaggccgaggcaggcgaatcgcttgagctcaggagtttgagatcagcctgggcaacatggtaaaaccctgtctctacaaaaataatgcaaaaattagaccggtgtggtggcgggtacctgtggtcccagtgcctgggaggctgaggcgggagaattgcttgaacccaggaggcggagattgcagtgagccgagatcgtgccactgaactccagcctgggtgacagagtgagaccctgtctcaaaatgaaacaaaacaaaaagagacggagtcttgccctggcgcccaggctggggtgcagtggtgctatcatagctcactgcagcctaaactcctggggtcaggggatccttctgcctcagcctcctgagtagctgagactaggagggtgagccaccgtgctgggctaggatctccatttttagacactttatctcagtgtattcaaaatatggttcttggacaagtgtgggttggtgatctggtctgccatgaactgagcctaagtgtttggcaaattttactgcaattttagagtgattttatttatgttgaatcaataatttaaaaagtgaggcttgtattttgtattctataatttactgtaatatcattttttctagaaacagactcttatttcacaaaagtattggttgaaacgaattaaagtgaacaaaaaaccaactggttttgcacaagtagtttgaaatatattgctctatcttactcaaaattgatgcgtatgtgatttctttttctataatgtgaagttttttttgttgttgttctttggggatcttgtgctctactcctaaaatattaatgtcatgcaggattccagaattgttttgttttgttccagatatttgccttgcgtatataaagatgtggtcattctttgcatgctctttccccagagacacatgtaaatggagttgtaatttcctgttggtaaacagcaagtatttaaatttagaatcaggtggtaaggttgatatgtagaagggtaatacattggattgccttcaaagtgatatcttttccagttaactgttaactcactaatttactgtttttcttttctttcttatgcttcatgaatttatgtgtcatctgtacaggggccatgtgctaatctctgcacggttccaattttagtgtttgtgctgccaaagcaagcacggcttttcttaatcctatcaaatattacatggtatgttaaaacagtatagatctggcttaaggtatttcatggatgacaaatggacctcatgttatagaggaatgaaagatataaattaataaaacatgatcatgataagaataaaaccaaactaaatctcctctccagtgcttggcagcacactcccggagagggttcaggctgtatgtggccccccagcaggtgctcagagatggcttaatggcctcggtgacaacaggagcccagactgcataagactctgcctctgcagatgcagaacagtaggggcctctgatgtgcttgaacatctgttttggatctccatttctcctcaagaagagactcctttttaaaaattattttttttgaagctgcattacttactgatttccagagtcgttttacacctgcccttctcaagggaatattttgggcataatcttttttttttttttaattatactaagttatagggtacatgtgcacaacgtgcaggtttgttacttatgtatacatgtgccatgttggtgtgctgcacccattaactcgtcatttacattaggtatatctcctaatgctatccctccccccttcccccaccccacaacaggccctggtgtgtgatgttccccttcctgtgtccaagtgttctcattgttcagttcccacctatgagtgagaatatgcggtgtttggttttttgtccttgcaatagtttgctgagaatgatggtgtccagcttcatccatgtccctacaaaggacatgaactcatcattttttatggctgcatagtattccatggtgtatatgtgccacattgtcttaatccagtctatcattgatggacatttgggttggttccaagtctttgctattgtgaatagtgccacaataaacatacatgtgcatgtgtctttatagcagcatgatttatggaatcctttgagtatatacctagtaatgggatggctgggtcaaatggtatttctagttctagatccctgaggaatcgccacaccgacttctacagtggttgaactagtttccagtgccaccaacagtgtaaaagtgttcctatttctccacatcctctccagcatctgttgtttcctgactttttaatgattgccattctaactggtgtgagatggtatctcattgtggttttgatttgcatttctctgatggccagtgatgatgagcatttttttaatgtgttttttggctgcataaatgtcttcctttgaaaagtgtctgttcatatccttcgcccactttttgatggggttgtttgtttttttcttgtaaatttgtttgagttcattgtagattctggatattagccctttgtcagatgagtaggttgcaaaaattttctcccattctgtaggttgcctgttcactctggtggtagtttcttttgctgtgcagaagctctttagtttaattagatcccatttgtcaattttggcttttgttgccattgcttttggtgttttagacatgaagtccttgttgggcataatcttttaatctttctggaaagctaacaaaacattatctatgccaggctttccaccaggcacaccccattctttccatcacagtgctttttaaaggactttatcatttgttctctgggttcatttaactcttaacttacaccgatttagcatctttgctatatttcctttcttatttcattctttatatgttatgttacatttctgtttgagtctttacagtatcttctttcttaccaacttgtctttctagaatattttcacaattaatgttttggtttgctttgaggtaggcgatcagcaggacttgttttctgagcactggtcaggaccctgtctatctaaatgatatgtagcaaagaaactggccaaagccatgtaggaccagcaattataatgcacttgcgtaagacacttctaccactaccatgacagtttacaaatgccatggcaatgacctggaagttaccttatataattctgggaactctcttccctttttccataaagtttgtgaataacccatcccttatttagcaaataattaagaatgggtataaatataggtagccagcaatccacaagtgctactctggaccaatctgcctctggggtggccctgctctgtctatggagcagtcacttggctgtacactgttgctcaaataaacttgctttctttcattgtcaaaaaaaaaaaaataaataaaaaaataaaaagaaagagggtttaattgactcacagttctgcatggcttgggagggctcaggaaacttacaatcttggtggaaggggaagaggcacatcttgcatggcagcaggtgaaagagagtgagcaagagtagggaaaactgccttataaaaccatcagatctcatgagcactcactatcatgagaacagggtaagggaaaatgactccatgatccagtcacctcccaccgggtccctcccttgacatgtggggattatgaggattacaatttgagatgggatttgggtggggacacagagccaaaccatatcagcaggattgaaaggtaaagtgtgaatatgatagtttggagaactgggacaatatgtggagataatacttataagtcatagtcatgatcatgagtcagagagagtcatgtgaatgagatagtgtgttagactgtgtgtgtgtgtgtgtgtgtgagagagagagagagagagagagagaagttggggtaggggcatgtcatgttttaggatgggtatttggaatatcatttggatatgagtaacaaggacctaaaaatgagttgcttaaaataattaggggatatcttttccttacctgaaacaagcccaggacctccacaattttatcaatgtctcagtccccttatatatttttttgttccttggtccttggtatatagctctcatcttccaggtaccttctggttgaaggatgcctgctgcaactctggccatcatttctatgtttcaggtagaaagaatgaggaagaggagagggcaaaaataccttgtcagtggaattagtctccttatacagagctttcccaaaaatcctatccagttactgccaaatacatctcatgggaaagaactgtgacacatagccaccactatctgtagctgagagaacatggtaagaaaaaacagtttcttagtaaggaaaaggagatgttggtaggatatcaccagtagagaaggagaggttgaagatttgcgagagggagtataattaatagatgaaaatcacgatggtgctagatacagatgggatatgactggcagagtttgagatgctggaggatatcatggtaagcaaaaatagacatattgtctctgccctcatgaagctactgtcttgtgaagaagacagtaatcgcagactcaaatatttgtgaagttgtcactctggtaagtgctatggaggggaagtacatggttctgtgaataggttaaaagagggctttacctaatcagggaagtaaaagcagggaggaagtaatgatggagatgaaaccagaagacagattcagaattgattggttgaaggatctgtggatgggatggggtaaaagtgtttccagaagaggaaacagcatgaacaaagggacttatgctctgttgtcttttaaaatgtattttatttcacttagaatcttttccattatgtcttcaagttcactaatctttagtaattaatatcatctagcatttttttcttctcaaatattacagtttttatatctagatatatgacttggaccttattaaatagatctcatgtttttacttaacatgaccattctttcctctaagtttttggacacatggaaatagttataatggcttttaatgtgcttatctgctaattataacatctattaaatatttaagttctgggtaagtttggattgattgatttttctcctcaagatgggtcctatttttctgcttcttggtatgcctggtttttttttaattcgatgccaggcaatgtaaattttacctttcggtaaaattttggtgaaattttttcttttggtgctagatatttttatattcctacaaagctacctgagctttgttctgaaatgcacttctttggaaacagttagatctttttgagtcttgcttttatgatttgttaggcaggaccacagcagttttttgcataaagctaattatccctgactgatgaggcaagacccctctgagtatcccatgccaatgaattaggaagttttccactttagctggtgagaacagcatggtccccagacctgttggagcttctggcacttgttccctttaatcctttcaggtgactctttccccagcctcaggcaatttccttttatgaattcactgatcagtactctgtcaaatacttaatggcaatccttcaaagatctccagtgttctccctgtgtaactctctctttttgggtactctgctctgtgaactctagctaccttggtctttctggtctctcatctctgtcactccaattcaaggaatcccctggattctgactacattctcccttgttgctccacaaactggaacctctcaagcagtaagtgctcacttcttttttcctcatctctcagggattactcttcttcattgcctaatgttcagtgtcttcaaaaaccattatttcatattttatgtccatttttaagtgttttttgtcaggttggagggcaaaatcctgtctccagcttgcctcttaggaagttatatggtggagacctgttagataattattttcttttcttttacagttgtttgaccttctcactactgccaagtatcacaaatgagtgacagttataatttttttatcaaatgagaaaagcctgagaataagaaatgtattcaaaatcagggatttgaggaacaatttgggtcacaggggaatgtggccatatattacaaggataactcctcatgactctaaccacaaggaacttctgagcataaagacaagttagaaaaggagattaaccttctttcaaaggatagatgtttaaggcttggggtagatattcacaggattggttcccagccagggggcttccaagactatagtaagtgttagagtaattgtgctctaatctcagacatcctacgggaggatgaaaccatacataggacaaacccacacccacacccatagtgtgggtcacatgaccatagcttcagaccaatttcagagactataaatcagcacgaaaaggccatgatggtgagaaaatgtgtgaagagcattgaagagcctttggccaagcttcagatcttattaacatcaaataattcattagcagagataaactctatgaatgtagtgatcatggatggtctttctttctttttttttttttcttttcacattcagttgactttgtggatggtctttcaaccagagttcaaatgtcattcattattgttaaacacatactgaagccatagaaatgcagtcagtggaaaaaagccttcaggaacaaatcaaacctgagtaatcatgagaaatttcaacctggagagaaactgttgaatatacaaaatgtgatactccactctgttcttatcccatgcagactcccccaatctgtgtaagtgattcctttggatccctcctcacatggctttggtgagggagttgcatgcccctctccttcctcaagaaaaaggaaaacactcttccccaagccaaggactcacaacactgtaaattcttatctaattctttctagctttctgagtacatatgggctgaaaaggaatggaatgaataccagtagcatgactagtatgctctccccatgtaaggcccgtaggattgtgttcagatctcctgggatgttctttttagaatgtggaggcactgggtacctttttcttttcttttcttttcttttctttttaaaggctatatggctttaaccaaaattctgaggaaagtgtgaaagttccattcaataacctgctaaatttatattatcttttctcatttaatattacaatagaagcatgcttctgccattaaaaacatctgaatcggattttttatcactttcaatttaaagcatagtcttcaaaggtaaattactaagaaagtatagatattttttaggctctaaatatacgtttctgaattgttttctagtaaaaggaatatttgtttggcttttcaatagcaaaggacatcctcagcattttttttaatggagaaaatgatagtggaaaagaaagtcatagattgcattttttcctagatcaggaattcataaataagactaagaggcaagacaccaaccaaaaaaagcatttgcaacaagtgtgacagatacaaggttaataaccttaatgtacaaagaattctcacagcaaaatacaaatgattaagaaacgctgagagtatcttcccatcattaataataataataaatacagtttgaatcaattaaatgtcattttgtctgtcaaaatggcaaagatattttcaaagcaaatgttcagcactgttaagggtatgtgagaagtcttctgcattgctagtgttgacaaaaacctttctagaaagcaatttggtattattgaataacggccttaaaatagttcatacccgtttgaactagtaattccatttctaataatataccataaagaaataattggaggtatgcacagaggtttgttgggggaaaatcaccacaatgataatctagtgaacaaaaataaatggaaacaagatttttgttatttggtcaagtaggtaagttcatatgatgggatattacacgttatcataaagaattttgcaaagactttttaatgtcatagaaaatgttatgccaagataattgtgataaaacattatatacaaaaagaatctcagatgtagtatattaattacaactgtgcatgtatgtgtgtgatgttagacttggtatggaccattttcccaatgtttttcagatgatttttcttttataaaatgaaatcaggaaatgtcatactatgtagctgaactcatatgacttttctgagtccagctatatatctattttaattgttgttaatgttccatgattcccaaattaagtggtttatgaggtttatattgatgctgaacattgaggacacatatggcactaaatcatatcccaggtgtctgagagcattcagatatgtcttgaaattttccagtgcaaatcaaagagggactctatgtcacaagataccagaagctcacatggtaaggtcatctgatgcagtatcaaacaaatatccccaaactgtgcattgaggttctacttgcaggcttcctccccttgtctcttctgataaccttctgcttattaatggaatgtgagttgctgtggtgatgggggtgaggaattaactggaagggaattgtgcaatatgaaggaaggtgtaatctatttaagtctgtaagagattacaagtcaccaagaaagcctgcgatggtgagaaaatgtgtgaagagcattgaagagcctttagccaagcttcagatcttattaacatcaaaattcattagcagtgatgaactctatgaatgtagtaatcatggatggtcgttcaagcagagtttggatgttattcattattgttaaatacatactgaagccataggaacgcatttgatataatcctaagatgtcactttgcctgctcttatgatgcaaattggcaccagaaatccagccaactttattaaaattgtggaaatctgactggactcagatccattaatccttgaaagcaggtaatacatgtatttttgccatcattatttctccagcacttatcacaatgtgtagcactttactaggtatacttttaaaatgttttaaaattcttatacatatataaataaagaagataaaatcaagttgactcaagtctagaaaacatggatgagggatttaagaattctaaagtgtttattctgaggcaccatattgctttatgtttggaggctcagtgtatattatcaatgtagaggcttcaagagggacccattatttcatatggttattctatcctttacttaggggtgttataatctcatgctatgattttgtttttattatattttgctttaaagtactatgtctgatattaatacatcatctttttattatttgcatgtaataacttattccatccatttattttcatctttgctgtatctttatgtttaagatatttctcttgttaattgcatgtagctgcctttataatggaaagatacataaatttcctttaattacagcatcctcaaatattctgtaattggagatttgatttcctctttgaaggaaagcttcatttattccttctccagtgctctccctttctttatgtacttccaagtttctgccctatatcattttctttctgcccgaagaaaatcttctaatatttcttgcagggcaggtctgttggtgatcaattcattctgtttttgttcatctgagaatgtctttatttctcctttactttttttttcttctcctttacttttgaaagatcttttcctatatgtagaaatctagggtggtagtcatttttcttttaacactttaaatatttcactttactcttgttgcttgcatggtttctgatgaaagctgctagaattattattcttattctattataagtaagatatttggtgttctctgagcttcctggatctgtaatttggtgtctgtcattaattttggaaaattcttagccattattacttgatatttcttctgctgtattctctttctcttctccatctgatgttccagttatgcatatgtgactccagatttgcctatccatcaagattttagggtgatgatttgccctgaaatttcatttctctgacaggtccaaaaaagtgattgatttttagtttgtccaggttttttttctggttgttggtgcctccagcctcacattgattctgtggtggaagaaaagcatggggaagcaaagagtcagtagatattgtgggttccttaaaaaggaggaaccataagccccatattttagggatgggaagaaatgccaggtaggtttgcaagatccttaagcaatgtgttcttttgtctcaccttctggctaaggccagagaggacaagactacaaaatagaattgtctgcgtggtgtctataattatttggagcctcttcatgtggtttccctcagctcagggtatttacaggagtatatgtgagacaaagacagcctcacggaggttaatagacctcagcatatcataggaacagtagaatgttttccatgtatatgagtgatatatgatacccaaagagatagttggacccaaagcagctttacagtaaagaaggaagctcactcaacagctacctgcttggacagacattgatgaacaaatatgacatgtatgccagcatggatacatgatacccaacatatgttacccatcctgatgttttgacactatttaacatccctagaacttaaatacaaccccaaagcagagagtgagagggggactccatactgctggagattaagtttccaccactcagtagaatgggaacttgacatataatttatgttgagttgcagagaaaataacttacatttcctgcataccggagtttgtcagataatacccatacctgcagaataatcattaacagaaagtgggtgataaacactgagtatctcaaacaaatttatctactcaaaacatggggtatgtggctcttatagtagaaaaccacggtggtcttatctcaaggccagagtgagatgtgagaaatgacctctggcattttggtgggtaccaacataaagagaacagggaatctgaggagagcaaaggacaacttctctgcagaacgaaatcactgtcattggtgaggtgtgattctacttcatttcttcatcttcctgtccctgtccctcttacttcaaatacttctcttttctccctggttatttcctctactccctccttcctcttttttatccctctccttgtttatttttcatccctccttatctattccttaacctcttgtcttagtcagttcgggctgctgtaactgactaccatagactgggtggcttaaacaatagaaatatacttctcaccattctggaggctgggaagtccaagacaaaggcactggcagatctgctgtctgttgagggccctctttttcctggtttgcagatagccatcttctcgttgtgtcctcacaaggtggagagcagaccgaggaagcaagctttctcccttctcttcttataaggtcattaatctcattatgagggctctacccatatgaccttattacctcccaaagtccccatctccaatacagtcacactgaggatttaggtttcaacatctgaatttggtggggccacaaacattttgtccataccacccctctatctactcctgcctccctctcatgctcttccaccttacatcctcttctctttcctcttgctttttctttttcttttcttttctttttttttttgagatggagtttcgctctcgttgcccaggctggagtgcaatggtaagatcttggctcactgcaacctccgcctcctgggtagaagcgatattcctgcctcagcctcctgagtagctgggattacaggcacttgccaccatgaccagctaattttttgtattttcagtagagacggggtttcaccatgttggccaggctggtctcgaactcctgacctcaggtgatctacctgcctcagcctcccaaagtgctgggattacaggcatgaaccattgcacctggcctcctcttgctttttctacttcaacttagtatctgttctttctccattatcttatttttccttatcttcctaattccatttacttccagctgctattttcattcatcttttcttattcctattatattctttcttcttttcttcttccctctcttcctcctcaattcctttctttcctacttgaccttctttctcatttctcccactcttcatgctcccatctaacaagatagtggaaaagagagaaaaaggtaatagaatgcaataaaaatgtacttaaaatggtaacaggaataggtgatgggtttgactggggaataaggcagagagaggcattatgaataacccaaagtaaaatagggagaaaaagaggctattaaatatgattttttaaaactacttatcaaaaagccataattattctgataggcaaaatggtaaagtcacttcaggaaaaagaaagggatgttacttatttagattattactcagtattgctcttgatgttttagcaactcagagaagaccaccaaataagtgctattcatattgtaaaagaagtgatcaaattatttctttttcttatagtgtgattgtacattaagaaatcacaatagatttttaaaaaaataaaatactagaattgaggacttctacttccagaaagaagtagtaaacagggtagatgtattttccctattcatctctggaaaaaatatataaacaaaacataagaagacccagaaagttgaaaagaagatgatgtattctctagggaacttggaaccaaggaatcaacatggaggtaagttccctgtgttttctttttgctgcatacatcctagaccagatgctagagaaactggcaaactggaaacaccaaagggcacagacaaaaaaaaaaaaaaaagcttcaatgtaaatccactctttcttcacctaaagaacagacagcttagtaaggcaattattttttacttttatttttttttgagacggagtctcactcttgttgtccaggctggagtgcagtggtgcgatcttggctcactgcaacctccgcctcccgggttcaagcgattctcctgcctcagcctcctgagtagctggaattacaggcacgtgccaccacgcccggctaatttttgtatttttagtagagacgggattttgccatgttgtccaggctggtctctaactcgtgacctcaggtgatccgcctgcctcagcctcccaaagtgctgggattacaggcgtgagccactgcacctggctgacaaaattttttaaacaatgaccgctctattgtagctaaataccagagaagactatacctctacccctactagcaaaggccaactagagagacttccacccttgccagcctgtaataagacctctagttccctgatagagtggtaagatgaatggggagtgggaacattctagtcccctcagttagtagagactatgtggggagcctagatttccacccctaatgagtgataatgaggtgcctctcccctaacaaatggtgtggtatcaagaggaagcctaatgaagagtcaggtttttatcaccacccaacagtaacaatgatacctgtctatcagtggtctcaatggaggccatttggagagaagtaactgggcacccagtctctcccaagcagagtggtactggtaaaagctggaactgtcacttagcccatggtgacaggaagctcctcaaccccaggtatcagtggaatctgagtatggaacctggacttccacctacatgtggtaaaacagaagatttaaataagacccagatcttcataacataatatgcaaaaatatccaggattcaactgaaaatcacttgtcatagtgagaactgtaataatcacaacttgagtgacaaaagacggtcaacacacatcaacatcaagatggcacagttattagaatcatctgacaaagatttttaaacagccgtcctaaaaatgtttcagtgagcaattgtgaacatgcttagaacaaatgaaaaaaaggatgtcttagcaaagaaattggaaatctctaaaagaaatcagagatataaagaaaaattaataggaaattttaaaactgaaaattttaatacatggactttaaaaaacaaacctcagtagatgaactcaacagcaaaataaaaataacagaagaattaatcagggaacttgaagatagaacaatagaaattattcagtctgaatgacagagaaaaatatactgaaaaacaaaacaacaacaacaaaaaacagagccttaggcacttgttggactattacaaaagatttaaatatgtgtcattgtaatcacagaagagagagagaagaggtactgaaaaagtgttgagagatacaatggctgaaaatgtcccaaatttgggggtgggggagacaatcccacagattgagtgattcaagaagctgagcaaccccccaagaagatacggtcaaagaaaccactttcaaacttctgaaagcttaagacagaacaaaaaatcttgaaacccaccagagcaaaatgacaccttacctatagagaataccaaagcaatgacagacagaagctctctcattagataccatagaggccacaatatttttcaagtgctgcaagaaaagactcattaacctggaattaaatacccaatgaaaataaaatacccaatgaaaataaaatatcctttagtaatgaagagtaaatcaagacatttccagaagaaggaaaactaagaatttgtttctagcctacctatcctaaaataatggccaaaggaagttcttataaaagaaattaagaattctaacaattgttcaaagaaggatgaacagcatttctacacaatctcatccagaaaataagaggaaacaacttccattaattctatgaagtcagtcttaccctcatcccgaaaccaaagtacacgaaagaaacttacacattaatatgtctcacgaacatagacgcaaaagtctttaacagaatattagtaagtcaaatccagtgttgtagaaaacgttatacaccatgaccaagtggaatttattccatgtacggttcagcatccataaatccagcaatgtaatccattatatcaacaggctaaagaataaaagccattatcatattgattgacaaagaaaaagcattttagaaaatccaacagttcatttttgctaaaaactgtcagcaacccactaatagagagtaacttcctcaatttgattttttaagatatgcactaaaccttcacctggcatcagacttaatggtgagagactgaatttctccttgccatcaggaacaaggtaagtatttgcactcaccactgctatcaaaatagtattgggttgctggatcatatgacagttctgtttttagttttttgaggaacctctatactgtttctaaagtggctgtattaatttacattccaaaaaaaatgtatgagtgttcctctttctccacatccttgccaacatccattactttttgtctttttggtaatagccattattaactggagagaaattatatctctttgtggttttgatttatatttctctaatgactagtgatggtgagcattttaaaaatatattcccttggtcatttgtatgccttttgagaattatctattcaggtcatttacccatttttaaattggagtatttgcggagtgtgtatgtgtgtgtgtgtttctattgagttattggagttccttatatattctggttattaaattccttgtcagttgaatagtttgcaaatattttctcccatcctgtaggttttctcttcactttgttgattgtttcctttgctgtgcagaagctttttagcttgatgtgatcccatttgttcattttttctttgtttgaggtgcttttgaggtcttactaaaaaaatctttgcccaaaccaatcccggggcacttccctaatgttttcttccagtactttaatagttataggtcttatatttaagtctttaacccattctgacttgatttttgtatatggtgagagataggtccaaaagaaagaaaaatcaatatatcaaagagataactggattcttgtgtttattgtagcactattcacaatgccgagatagggaatcaacctaagggtccatcagtggatgaatggataaagaaaatatggtatatatgcacaatgaaatattattcagccataaaaataaggagagcctgtcatttgcagcaacatggatggaactggaggacattatattaagtgaaataagctagacacagaaagacaaatattacatattctcacttatatgcaggagctaaggaaaatttgatttcatggaagtagagagtagagtgatgattaccagaggctgagaagggtggggggtggggagcttaaagaggggttgtttaaggggtacaaaaatacagttagatagtaggaataagacttagtagtcagtagcacaatacagtgactatagttaacaatcatttattgtatgtttcaaaataactaggggagtggatttggaacgttcccaatacaaagaaatgataaatgtttgaggtgatggatatctcagttaccctgatgagatcattatacaagatcataccctgatgagatcattatacatcatatacatgtatcaaagtatcacatgtaacccatgaatatatacaacaaatatgtatccataaaaattaaaaattaaaggtaaatctaagcatgcttcttaaaaaacaaagcacaacaaaaagcaaaataataatggaaattctagccagctcagtaaagaaagaaaagcaatacagatcagaaaggaagaaataaaactcactatttccagatgtcatgatagtatatgtagaaattcccaaaatctacaaaaaaaaagaaaaaatctcctagaactaataagtgagtttagcaggtcacagggtacaaggtcaacttaccaatatcaattttatttctatatcctagcaatgagcacgtggaaattaaaaatagaatactgggctgggcacagtggctcacacttgtaatcccagcactttgggaggctgaggcgggagcaatcacttcagctcaggagttcgaaaccagcctaggcaacatagggagaccacatctctacaaaaattcaaataattaactgggcatggtgtcacgcacctgtggtcccagctacttgggaggctgaagtgggaggatcgcttgagcccaagagttgaaggctgcagtaagccatgatcgcaccattgcactccagcctcagcaacagaacaaggccctgtctcaaaacaaagaagaaaaaaaagagaatacaatgactcaaaaaaaaaaaaaaaaggtgaaatacgtgtaaattgacaaaacatatgcaatatttctatactaaaaactacaacgttagtgaagaaattaaagaagagcaaaataaatggagaagcacatatcgtcacattcatggattgtaagaatcaatgtaaaaaatgatattaattttccctaaattgatacacagtttaagtgcagttcctatcaaaatccctgcaagatgttttgtagctataaataagattatcccaaaatatatggaaagacaaaagaaccagaataatacataaaataattttgaaaaagaaagataaagtgggagaaatcattctattcaaatttgagactactgactattataatcaagactgtaggatttgatagatgaacagacacagaaaatagaatagaacagagaactcagaaattgcctcacaaatatgccagctgattttcgacaaaggtacaaaaacaattcaaaggaagaaggatcaccctttaatcaccctgtactggcctgactggatatccatagctctgacacccgcccccctgccccctccccgctgccaaatgaacttcagcttaaacttcacacctcattaaaacttaatctcaaatggatgacagacatcaatgtaaaaattaaaaccataaaacttttagaagatattgtaggagaaaattgtgaggtactagggcttgttgaagagttcttagaaatgaaataaaacccacaatccataaaaggaaaaaaaaaaaccaataaattgaatttcttcaaaatttcccctgcaaaagtctctgcaatctgggagaaagtatttgcaaaccatatatctgacaaaagactcatacataaaatacatgaactctcaatattcaacagtaaaagagaaaagaaagaaaacaatgcaattaagggtaatgggggctgggaaggaggtggggatggttaatgggtacaaaaaatacttagaaacaatggataagacctactacttgatagcacaatagggtgactatagttaattgtacattttaaagtaacatagtgtaattgggttgtttgtaactcaaaggataaatgcttgaggggatggattctcagtgatgtgcttattttacattgcattcctgtatcaaaacgtctcatgtaccccatgaatatatatacctactatgtacccacaaaatttttttaattaaaaaataggtaaaaggcatgaagaggcatttaatcaaagaggatatatggatggcagaaaagcacatgtaaagatgttcaacatcattagccattagggaaatgcaaattaaaaccacagtaagatattactacacacctatggccaaaatatactgacaccagcagatgctagcaaggatttggagaaactgtatccttcacacatagctggtgggaatgtcaaatggtatgatcactctaggaaagtttggtaatttcttgtaaaactaacatgcacttactatataccccaacaattgcactcttgggtacttatcccagagaattgggaacttaggttcacacagatacttgtacacaaatgtgtgtagcagcttcattcacagtagcccaaaactggaaatgacccagatgtctttcagtgggtgaatggttaaaccaactgttgtagcacctctataccatgtaatagtactcaacaataaaacaagaaactctgatacacaagacaactgggatgcatctcacaggcattatgctgagtgtgaaaaaagccaatctcaaaatgtgacatattgtatgattacattttcatgacctcttgaaatgataaaattatagagatggagaacacattagtggctgccaggggttagggatgggggcggtggaggagggttggttgtgactataatggggtagtaagagggaaatctttgtggtgatgaaatagttctgtgtcttgattgctgtggtgtttgtagagacttccacatgtgataaggtgatatagaactatatacacatattgtaccaatgtcagtgtcttggttttgattttgtactgcagttacacagatgtaaccattggggaagcagataaagggtacatagaacctcactgtactatcctcgcaattccctgtgtatctgtaattatttcaaaataaaaagtttaaaaagttttttaaaagcagaattaataaaatattacctaaaagcagtagggcatcagttatatttcaaaaatcatgtcatagggccgggcatggtggctcatgcctgtaatcctaacactttgggaggctgaggtgggtggatcacctgaggtcaggagttctacaccagcctggccaacatggtgaaaccccatctctcctgaaaatagaaaaattatccgggcgtggtggtgggtgcctgtaatcccagttactcgggaggctctagcaggagaatcacttgaacctgggaggtggaggttgtagtgagctgagatcatgccactgcactccagcctgagtgaaagagtgagactctgtctcaaaaaaaaaaaaaaaaaaaaaaaaagccatatgtattagctggttggataccattgctgccgctactgaacagtggacaccggatgttagccctgccactaatgctgcccctagaaactggattttcttgtggctgctgctcccaccaccacaactatggtggtgaattccatcactgcatatttgaatcactcctttgaaacaaagtgttaggtctaagttgtaactgcagtgaaagggttgtactcagcaggtctgcaatgttcaaaccctatgctttccaaaaaaaggtcttttgcaaagaatgctttggctcttgaccagctcttgggagataatctgtaagcccttggaagtatcctgcctgatcagagtgtctttgtttactgtggccttggcccacactggatagtttgtgctaacagtgtgatttgtggtgtgagccttgggctgagagatactagtttaacctctgcatggactagagactgaataactaaggtcaaccacacaggtgctccatgcctatctgactgaaccccaaaaacaactctgggcaccaaggcttgggtgaacttccctggttgacagtatttcatacatgttttcacacatcattgttgggggaattaagcactggccatacaactccattgggagagtacaactgaaaagtcgtgcctggtctctcctgaatttttccctatgcactttttacttttgctgattttaatctgtatcctttcactgtaataaacaatagccataacactttttctgagttctccgaatccttctagcaaatcattgaatctgaggatggtcttcaggagcttgccacactggtaaatcctagatcacattctcttagctgccaagggcatgtgaagaagtgaatatctggcctttgtggcttttgcacttggaactgttaagtaagaatatatatgaccttactaaaatgttaaaaatcgaaatacatctggccccaagggttttcagtaaggatctataacgctatataaagaactcctaaaagtcagtaagacagacaacccaaatgaaaaacaggtaaaatatacaagcatattacaaaataaatctaatatgttcattaatgtataaaaatgtgttctaccacattgcttatcagaaatataaattaaaaccataaggagataccaataaatacacataagattggcaaaaaaaaaaaaaaaaaggaaaagtcttgtagagtatgtcagtcttactcctgggcttctggtgtcacggaaataaagacaaacattaattattaaagtataagaatacatgtacaagtatttttattgcaatgttgttgtattgccacgctccccacaaaaatcctgaaactaaaatggattccatccatgggggaatggttaaatacattgtggtacattcttaccatggaatattatgcagtcatttaaaagaacgaatcacaggtagactgttgtcaaataagataattcagacacataaaagttcatgtaatcttaaatttgtaaaaataaaaaacaacttttgagtatggaaggatatcaaatggtgttaaaaacaagtgtttggcaggtgaaggtagaattgaaaggaagtgggaagcagtaaggaaaagaatgcaatttaaggtctggcatatataacacatcatttatgtaacaacatatatgtgtgtaaagtatgaaaaggtagcaccaaatctaagcaattgtccaaggtgatgagatttagtgatgtttatttaatttctaaaatatttaggcagtgtttgaatgtatagtgatgagtgtgcattatttgtataatgaggaaaaataagtgaattgatcacaggaaaaattgcctctcaggtttcttgctttagcaatgggatggagagtgcgattcattcatttaacaaatatttattgaggatataaaaatgtgccaggcatggttctaggtgctggggaaacaacaatgaataaaacaaaaatctgtctccctaagaggtttacactctaaatgggggagaaaggcataactagaggagaaacactgtgttggtgggaaggaggaggcgtatgaaggaatcggtttgggacctgttaatttagagaatactgagagatatccatttggagaagtgaggtaggtagttactatggatctagaattcataggccaagtcatgaccgaagatacagatatggaaacagatagcatagaaaatggtgtttctgacctcctttcctgagtctgatcacgtctcactgcagacactttacagaggaagtgctgaggaaaaacaggcagctgacagaggaggttgctatgcaacagatgaggaaagtcatccagccaggcagaactgatgttggcccttggggaccaaatgctgcagtccttcctagcattagcttcctttcatgttcaggcttctggcatgagttgatgccagaacaaatgtgaactgcacaaagatctgtcttgaattttggaactgtaccagtttaatttgagtcacctcacatctgtatttaattttctgcctttttgagtttctccagttatcctggaagcatagcagcgtgtgtgtccttgggtaggacccacttgctgtgcattccactttgcacattgagaaaccaggcccagagaattgagtgacccgtgcgggctcacacagctcgagacagacaggctgggcactccattcctggaattctgaagcccagcccagtttctctccataaaaccacagctgccccaggccccagccctgaaaggaaccagggcttgccatggctcagacacacaggtctgattgtcctggctgctccagtgggcaccaggaaggcctcagggacagtgtgattgtatccctgataaggaagaggcctgatgttctgagcacagagtggaccccaaggagcaattcccacgcctggatggacccacacagggcagggggagggtgggggcctctgcttgtgtcctcctgaatgcagagcatgagcttgggcctcctagaacacaaactttgcttgtttggtacaaatggggtgccgtggtctgttgctcaaatggaggagggaggggtacccttagtccccaggccagcatgagcagaatgtgggctttggagtcaggaagacccagacccaaattttgcattttgtttcctggctctgtggccttgtctagttcatgcaatgtatctgtgcctcagcttcctgatctgcaaaataggggtgctgacatccacttcccagggctgctgtgacaggaagacaagccccagcacaaatcctgctgtgatgtacaagctgtgcccttccctcctttcctcccccaacacacacaaaatgagtccatcaccggagctgcagaaagaaagggaagaaactaacgttctttctgcgtctgggagcttgtgggggcgggcagggggtgagggagaaatcatggagtcacgtggcagccacagacttactactactactttgttagctccaatagtgtatcctctcaggccattccgtttcctcagcagaggtctaacacttgttgcaattagagaccccaaacagagacctaagcatgctggacaagggggtggagatgcaagccggcctgacaggaggggccttgaataggggagggacggaatagagacgcattgcggaaaaggtagggggccggtgtgtggggcaaggggtgggaccaagaggcacagcgcatctgtgggggagggggcgtagaggaaggggaggtgctgttgtatagtgtcgacctggttggtggtggggtggtgtgttggcaaagggggcgggaccgccttccagcgcacatgcgcatcatggtctccaggacgaagcttttgttgggaaagcaggcgggactgactttggctcttcagtgtttgcgcatgcgcgtaacgtcctgaggcggtgggtggtatattaggcgaagaggcggggtcgcccaagctgccgcgctggcattttctcctggacaaggagagagtgcggctgctgagagccgagcccagcaatcccgatcctctgagtcgtgaagaagggaggcagcgagggggttggggttggggcctgaggcaaggtgagaattagcccccagactgggcatctgccccctggtgcgggcccccatttttttttatcccgatcccttcaccctggattctgaatccccttccaccccccaaaccccaattcaatgcccctcccgatccttcctgattcaaaacccctgtccgatccctcccatcgttcgaaatcctcagattccttgacctcgatctgtactgttagatgattcctcctgactcaaaacctccatgcaacttcccaaatgcgaatcccaacccaaccgcacccccgctccgaattcagaactcatctgcttcccgatccccatttgaagcttcgccctgtcagtagcttctcggggttcagaacctccatctggacgcccattcacttttaccgctccgatccgttcctcctcacattcaccttatccgcccgcacagtcagaccacagtcacccccctcccaattaggtccttcgtatttgccctctgtagtataacgccctgcccctctcccacagcccccaggctccgctcttgccagagggacaggagccatggctcagaaaatggactgtggtgcgggcctcctcggcttccaggtgagatctccactccccaccccaccatttccccagccgacagtcacccctccccgcgggcctctttggtctcccaaacgccgggatccggtttgaccctatttagtgactagactccgtgggcttttcgaattcccatcgtttatcgaagggggggaggggcgtctcttttcagccatcagtccctgctcagagagaggggagaccctgttagtagtcagggcaatctgcccagagaatgcggggtgggtaaggaaccatttttttttttttccagaatcctgacgcttgtagagcagtctgtcaccccctcccccagcctcctgcctccaccctccctctttctgcattccccactctgtgcgaccccccttattctcaactccgcgatccgcctgccgtcctgagctgctactgcacgcctcttggagcgtccccggctcctgttcgtgcccactttccgcataccgccccacccctcattttgcccttgccctacttcacccctgccacatgtttagtacccgcctggtcccccatcgcccctcgcgggccccctagatctctgcctcagcccccctgtttttgcacccaccgcccgcctgcagctccgctgctgcgctgccacccgggctccctattcccaccccacctcctgcctcagaggcccagagatttaattttttcccccctgtgtttgcaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaaggtgagatctctgctaacttcattttgctttggggctgtctcctttcttctctgagggtgttcatttgttctaaacaaaacaatgtatgtaactgtattcagctaggctatagggcatttgaagagaatgtttattcctgtcctccggatgttcacaaactgatggggagataatacatggacacaaataatatatacaacctgtatgtaattcagtttacattttgttatgttagtaaccaccatgtgttaagccttgagctaggcacattcacacaggttgtctcattaaaccttaaaggcacctcctaccaggtagggatcatagtgccaattttacaaagaaggaaattaagtgccagagaggtgaagtgacttgagtgatttgttcagggtggtacaggcagaaccagtggtggacataggaagaggagaagcctcaggccccatctttgggttgctcctggcctggctcggagatgaaactcctgcctggaagacagtgaaagacaaacccaggactcagggtgaccaatggctagtgggtcaggctgtcactacaggtgagggtttagagggcattcctggaatagataaggtgaggacacagaacccactggtgattctgaacttctctctgatgatgcagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagtaagagctgtaactccccagtcacttttcccctctcttgctcttttctttgtcatcctctcatctgtaattcaaccaagtttttttgtaaatattttataagtttaatgatttcctttttccctcccaggcaaataagttggtcaagtacttgatgcttaaggactacacaaaggtgcccatcaagcgctcaggtatgcatccagtgtcccctccccaagctctgcccttcccttcactccatgctctgtcagcattcttctgcttgtagctctgcccttcccttcactccatgctctgtcggcattcttctgcttgtatgacccttccccttctatcccctcctttccatggttggctctttccacccttgaggaccttgactgtgctacccccagcagggctggcaaagggactgctgctctgtggcccccgctcggctcagatggctccctcctctctcctacagaaatgctgagagatatcatccgtgaatacactgatgtttatccagaaatcattgaacgtgcatgctttgtcctagagaaggtgagaaggcagccctggggtacaggaataatggggaaagtcttgatttcaaagattcatggggttcctactgggagtttagggcaagtctcagggagatgagtgtctgcctatgggtagcttatgctagatgttgtaatttcatagtctgttttcttgcccctgtagaaatttgggattcaactgaaagaaattgacaaagaagaacacctgtatattctcatcagtacccccgagtccctggctggcatactgggaacgtaagatgggaaagaaggtggaacatggcctttctcagtggtgctttttttctaggagtttcacgtagatcagggtccagggttcagggtcacatagcaggtcatgggcagagctggggtataattctcccctagctgaggaatattggggaggctagatgggcaagctggttggggtctctcatgcaaatggctactgaaaatatattctttctatattcccttaggaccaaagacacacccaagctcggtctcctcttggtgattctgggtgtcatcttcatgaatggcaaccgtgccagtgagggtgagtggctggacctgcagctgggggttggccacagcctgatttccatgcttattttccgtcccttgtctccccttgcctcccattgcagctgtcctctgggaggcactacgcaagatgggactgcgtcctgggtatgattgggctctctcatctcttgcctgtttgtgccatcctttggcaacagtggatggtcccaggattgcattaacctgggggtctggagggtttggtttggggatgttcagagcccaaagatgtgacctgggtggatggggaaacagttctgaactctctgcctcttttctcatctctgacctctgttctggaaagctctttgggcatggtaatagcctctgattgtgggtttcctttttttaccttcagggtgagacatcccctccttggagatctaaggaaacttctcacctatgagtttgtaaagcagaagtaagtgatgcctaaggggcttttcctgcttcttatgattctgcctgtgtgctggtcagctttagaaagcccttcctggctggatacaatggctcatgcctgtaatcccagtactttgggaggctcaggtgggcagatcgcttgagcccaggagttcaagaccagcctgggcaacataacgaaaccccatctctacaaaaaaatacaaaaattagccaggcgtggtgacatgcacctgtagtcccagctacttgggaggctgaggtaggggagaatcatctgagcccaggaagttgaggctgcagtgagctgtgatcatgccactgcactccaacctgggcaacagagtgagaccctgtctcaaaaaaaataaaagaaagcccttctcaagctcgtttcttacactatacttgtgcatatgtgtttctgtgcatacagaaacacttatgtcctcaggagtatttattgcatatactcctcatggttaaattctttattttttatttttttattttttgagacggagtttcgctcttgttgcccaggctggagtgcaatggcgtgatctcggctcaccgcaacctctgcctcctgggttcaagctattctcctgcctcagcctcttgagtagctgggattacaggcatgtgccaccacgcccacctaattttgtcttcttagtagagacggtgtttctccatgttaggctggtctcaaactcccgacttcaggtgatctgcctgccttggcctccagaagtgctgagattacaggcgtgagcgaccgtaccgggcgaattcttttgtttgtttttttcgagactgagtctcactctgttgcccatgctggagtgcagtggtgcaatcttggctcgcttgaacttccacctcccaggttcaagcaattcttgtgcctcagcctcccgagtaactggaacttcaggtgcgtgccaccgtgcccggctgtttttgtatttttagtagagatggggcttcaccacgttggccaggctggtctcaaactcctgacctgaagcaatccacccacctctgcctcccaaagtgctgggattacaggtgtgagccaccacacccggccagaatttttctaatttttctacttttctaagcagttgtcttgcaagtgaagcccatccaccatccccacagtagacattcccaaggctgggccaggctgacacttttgcactgcattgtactcatttcaatggacctctgtggctcactgacaagattacaagaatctggagctagagctcaggcagaaggagtgaaaggaaatgttgtcctttctgtgaccctatacaagcctcgcctgcatctctagtgagtgcttagcgttctagtgcaggaatttaaggcttgatgattaaggggtaaataccctgatggtgttcaggaatgagcccaagggggagttgctatctgaaatctgttaaaaaatgtaagattatttttcattagtggactaccattctgcctgggtaggtagacacaaagactgttttgctctttcagatacctggactacagacgagtgcccaacagcaaccccccggagtatgagttcctctggggcctccgttcctaccatgagactagcaagatgaaagtgctgagattcattgcagaggtaatggaggaactgttccagcattgataggtcaagggatgaagtatagctggctgggaaaggcccagggtaggaatgagatcctaggtgtggcaggtggtaggtgccgcattgctggtggtatttgttgttgctgttaggtaaacttaacatgtattaggtgctaacatatgttaatatattagctaatacaattatgagtttgttttgggtttttttttaggtttttaaagtatttttattttttcccaactttactaaattataattgacaaaaattgtatatatttgtggtgtacaatgtaatttttaagtattttgttttatttatttatttatttgttttctcccgagatggagttttgctgtgttgcccaggctagagtgcagtggcgcaatcttggctcactgcaacctctgcctcccaggttaaagcgattcttgtgcctcagcctcccaagtatctgggattacaggcacgtgccaccaccatgcctggctaaatttttatttttctattagagacagggttttgccatgttagccaggctggtctcaaactcctgacctcaagtgatctgcctgcctcagcctcccaaagtgttgggattacaggcgtgagccaccgtacccggcccattcatttatttttaactgactaataaaaaatatacatatttatggggtacagtatgatgttttgataatacatgtacattgcagaatgattacatcaagctagttaactctccatagcctcatatacttgacattttttttgtgatgagaacatttaaaatgtactcttttagcaattttaaataaacgacacattattattaactatagtcgtcatgctatacggttgatctccagaacatattcttcctatctaaatgaaactttgtaccttttaaccgatatctccctatccctcctgaccccaggccctggaaactaccattctactctctgcttctatgagttagacgtttttagattccatgtataagtgaggtcatgcagtatttgtctttctgtgtctggcttatttcacttagcataatgtcatccagcatcatctatgttgttgcaaatggcagaatttccttctttttaaaggctgaatagtattccattgtgtgtgtgtgtatcacattgtccttatccattcatccactgatggacaggtaggttgattccatatcttggctattgtaaatggattttgttttgttttctattcctcatctcaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttgggtaggtacatcactttggattgggcagttagggtctctgggggatatagggtccatggggttgtatttatgtgcatgagctagaagtattaggaaactcattgtagggagatgaggaaagtatggggcagcactctttggtatgtatattccttattatttgatatatatcattgatttttttacttcttctttcttatgttcacagatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaa

SEQ ID NO: 4527 - DNA, 127 bp, human
ggggtgtgctcagagcagggggcctgaagaatggctcctctgtttacaacacacccaacaggaagctggggtcatcgtgatgaggggcacaaacttgtggcctccctacagacaaatgccctacatg

SEQ ID NO: 4528 - DNA, 612 bp, human
tttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtct

SEQ ID NO: 4529 - DNA, 2162 bp, human
gttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggt

SEQ ID NO: 4530 - DNA, 603 bp, human
gcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggag

SEQ ID NO: 4531 - DNA, 7378 bp, human
gtgctggcagcagtaggcgagggcgcggctgcggggttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaaggtgagatccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccagggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaat

SEQ ID NO: 4532 - DNA, 7355 bp, human
cggctgcggggttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaaggtgagatccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccagggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaatta

SEQ ID NO: 4533 - DNA, 2238 bp, human
agctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccagggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaa

SEQ ID NO: 4534 - DNA, 7355 bp, human; identical to SEQ ID NO: 4532

SEQ ID NO: 4535 - DNA, 2736 bp, human
gtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccag

SEQ ID NO: 4536 - DNA, 2716 bp, human
ctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccagggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaatta

SEQ ID NO: 4537 - DNA, 7421 bp, human
gggggtgcacggagaaaaggggcggggtggtccgggctgctgtgctggcagcagtaggcgagggcgcggctgcggggttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaaggtgagatccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccagggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaatta

SEQ ID NO: 4538 - DNA, 7371 bp, human
gcagtaggcgagggcgcggctgcggggttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaaggtgagatccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccagggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaatta

SEQ ID NO: 4539 - DNA, 7445 bp, human
gcatgcgcaggctacccagccgcggggggtgcacggagaaaaggggcggggtggtccgggctgctgtgctggcagcagtaggcgagggcgcggctgcggggttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaaggtgagatccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccagggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaatta

SEQ ID NO: 4540 - DNA, 4850 bp, human
cacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccagggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaatta

SEQ ID NO: 4541 - DNA, 7392 bp, human
gtccgggctgctgtgctggcagcagtaggcgagggcgcggctgcggggttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaaggtgagatccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccagggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaatta

SEQ ID NO: 4542 - DNA, 7356 bp, human; identical to SEQ ID NO: 3387

SEQ ID NO: 4543 - DNA, 7445 bp, human; identical to SEQ ID NO: 3389

SEQ ID NO: 4544 - DNA, 590 bp, human
cccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagact

SEQ ID NO: 4545 - DNA, 7381 bp, human; identical to SEQ ID NO: 3391

SEQ ID NO: 4546 - DNA, 7392 bp, human; identical to SEQ ID NO: 3392

SEQ ID NO: 4547 - DNA, 7421 bp, human; identical to SEQ ID NO: 3393

SEQ ID NO: 4548 - DNA, 2171 bp, human
ttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcc

SEQ ID NO: 4549 - DNA, 4635 bp, human; identical to SEQ ID NO: 3394

SEQ ID NO: 4550 - DNA, 7356 bp, human; identical to SEQ ID NO: 3387

SEQ ID NO: 4551 - DNA, 7356 bp, human; identical to SEQ ID NO: 3387

SEQ ID NO: 4552 - DNA, 7356 bp, human; identical to SEQ ID NO: 3387

SEQ ID NO: 4553 - DNA, 2238 bp, human; identical to SEQ ID NO: 3388

SEQ ID NO: 4554 - DNA, 7445 bp, human; identical to SEQ ID NO: 3389

SEQ ID NO: 4555 - DNA, 1142 bp, human; identical to SEQ ID NO: 3390

SEQ ID NO: 4556 - DNA, 7381 bp, human; identical to SEQ ID NO: 3391

SEQ ID NO: 4557 - DNA, 7392 bp, human; identical to SEQ ID NO: 3392

SEQ ID NO: 4558 - DNA, 7421 bp, human; identical to SEQ ID NO: 3393

SEQ ID NO: 4559 - DNA, 4635 bp, human; identical to SEQ ID NO: 3394

SEQ ID NO: 4560 - DNA, 7356 bp, human; identical to SEQ ID NO: 3387

SEQ ID NO: 4561 - DNA, 7356 bp, human; identical to SEQ ID NO: 3387

SEQ ID NO: 4562 - DNA, 8723 bp, human
ctagactaaccagtttgtgttggtcctccgctgagctgttaatccagggaagagttgcccttctgaagaatatgtggatttaatggagaccaaggcaggtttgaatcgctcagaaacaacagccagaataacttttgaagggctgtaaatgaagatgattcaaatcctctgatttatgttacttttcactcaagtttctaaaagtgccttcccatcaagagctgtttggctagggacagaaacgtttgttcagccctatttttctcttccttccttccttccttccttccttcctgcctcccttcctgcctccctccctccctcctttacttctttccaccctccctccctcgctccatttgtccttattttctcccttcctccctggctcccttcatgcctcactcccttccttctttcctaccttttataaaaagaagtgaactgatatttgtaaagtagaaagatcagaagagttcacaattattttcgagttttcttttaacttttattttgggttcagggtgcatgtgcaggtttgtaatataggtaaactcatgtcatggggtttgttgtacagattatttcatcacccaggtagtaaggccagtgcccattagttattttgttgatcctctccctcctcccagcctctaccctctgataagccccagcgtgttggccctctctgggtgtccatgtgttctcagcaattagctcccatttataagtgacttcatgtggtattgggttttctgctcctgcattagtttgctaaggataatggcctccagctccatccgtgttcctggaaaggacatgatctcactgttttttatggctgcatagtactccatggtgtatatgtaccacattttaaaaagtgcagtctgttattgatgggcatttaggttgatcccatgtctttgctattgtgagtagtgctacaatgatcatacatgtgcatgcgtctttataatagaaaggtttatgtacctttgggtatagtcccagcaatgggattgcagggccaaatggtatttctgttcttaagtccgtgaggaattgccacactcctttccacaatggttgaactaatttatactccaaccaacagggtataagcgttgccttttctgcacaaactcaccagcgtctgttatttttgttcttgctttttatccagccttatagactctgactctgttttttgagacaggatgtctttctgtctgtgaacgtgaattccgctggtgtctgagacttgccaggattccagctctctcaaatgcctgtgttcgaactttatgaatttgctacattttcactggttttcttcttaccccctgttatggctgtcacttcttccacacatgctctgccacaggtgatgcagtttgtttgtctcatccctcctcagagggactaagtcaccattttggatcagttcccatggctgccttgttacctcaggtctctcatgatctaaaaacaaagcaaaacaaaagataacgttatagattattaggctgtttttcattttcaaggctaaagtgactttctcttgaggctttctaaatcttacctggtggtagaactctcctttgttaatcttttgactactggtacaaaaatacagcattcaaatatgtgaagtaaaagataatccaggggctagctgactatggcttgagatctaaatacagcccatggcttgttttgcatagccattgagataaggatttttttccatttaaaagtattattgctaaaaaacacaacactacgccacagaaactacatgacccacaaagactgaaataattacgatcagatctgttaaagcaaaatttggtgatgccgtattaatcaaatacctgttattctgctttgcattattgcatacatcttttcatccattaattaatttatttacacacggattgaaaatatggatgttactctatcccctcaagaaagcgtccagctttatgataccatgatttcagtctgggaaacttgtcccagggatcaggtcaatacacaaacatacatttgaggtaggagactggcaggacttgttttctggtcataactgagcctagagcctacagtcagaatctatggctatttctgaaacatatactgtctgaatgacctacaggtatattcagggaaatcagttaccagtccagagatttaaatgtgaagtaacacaacctaaaaagaaaagagtaaacaggtgtgaatgtatttattctacagaagaatttattcaattacgtttattggaagcatggcagaaaacccagaaccagagaacaaagtgattaataaaagcatttataaaactggccaaggtgggaggatcacttgagcccaggaaattgagaccagcatgggcaacacagtgagaccactatctaaaaaataaataaataataaataaaccaattacccaggtgtggtgtctgcacctgtagtagcagggactggggaggctacatcgggaggattgtttgagcccaggagatggaggcttcagtgaggtatggtcatgccactgccctccagcctgagcaacagagtgacactctgtctggaaaaaaaaataaataaaaacggctttataaataaagatatgaaaataatttatttcttccacaaaaggtcttcctgagacacatcctccagtaagggactgtctgttcccaacgtttctgaatgcatgagattggacaaagagagacgaaagctctcaagtccctttttctactacaaacgccatggggatgcgggtctgggaacagcggaaaaccctaccctgccctgaaaagtccctggctcaatgtgcatgtccctttctatgaaagttccttgctgcctatgcgccttgctctctaacttctgtccctccacaactgtgaaaggagacgtcgtgacttccttctttcgtgctgactatgacttagccagtaggtctgcagatcagtcctcccagaaagtgaagtgtgagtgagtgtgagggggagcgtggggggcttcctgtgggttgtgccacttggtccatggcctctgaggtcgtcatctttctactaaaactcagcgatactgccatggccttgctgttgtggggtcccgggcatgggacgaaggagggccatagcggggaggagggtcaggtgagcatggagtgagtttttttttttttttcacggagtcttgctctgtcaccaggctggagtgcagtggcgcaatctcggctcactgtaacctccgcctcccgggttcaagtgattctcctgcctcagcctcccgagtagctgggagtacaggcgcgcacaaccacacccagctaatttttgtatttttcagtagagacgggttttaaccatgttggcgaggatggtctcgatctcttggccacatgatccacccgcctccgccccccaaagtgctgggattacaggcgtgagccaccgcgcccggtcatggagtgagttttgaaggctgactttatttgaggtatttgagtcctggtgggggggaacccacacacagagaggagggattccaaagtcgttaatggggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcggtatggaagggtcctggagacggggcatgctgcgggctagtgaccgcagccccgaggtctgtagagtgcctggcataggggtcctgtgaggagtgcccactgctgtgtagcaaattctcaactccactgtggagattccaatgggcggggccctgagttcctaaaaatgtgactttggggtgggggggaagtgggcctagcaaatcattatgtgacaaaattggtggtcactgcagtttcagttctgtagctgtaatttcctacttgtctccctgatggagtgtccagttgtgaaaccaacctcatgggaaatgccctgtgttttttgccaggagccttaagacatcgctcagctagctagacctacttaagtggctttgcaagcattcgattcaaaaggtgcatacacttatacttgcccggggactttcagagtatttctaaattaaaaaaaaaaaaaatgtccaagttaacatttgaccatgaaagcggtcaaatctagttgtcctgtcaagtgcattttcccaatcgcagtattctgcttgcagagtgaagtatgtgttgatgaggacgatcaacatataggcctatgccaagaagttcacaacctcctgagctcattgtgcctctgcttgtgaatgtcttaacattcgatgttttctcttagcagaaagttatttttctgatagtgttgatggactagtatggatacactgataatggtctcccatgctgataaaaaatgatcatggcatcccatgaaggaaagattagtccagagggttatatttgggttttgtgtgggtggatgatcgtgtgtgcccagattttgtccataacttcctcctcatgcttattcagaacagattacacacattcatcccaacattgattaaaacggcttccaaagtccctgaggatatctgtctttgagtaacctctctgagggaagaatagtgttatgaagattaggtatacggggtagtgttggagaaatgtctctagacatacttataataagacatacctgtgtattctgtatatttatattattgacatgtattaataacaaaactttttatctagacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcctgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcacc

SEQ ID NO: 4563 - DNA, 4935 bp, human
tggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcggtatggaagggtcctggagacggggcatgctgcgggctagtgaccgcagccccgaggtctgtagagtgcctggcataggggtcctgtgaggagtgcccactgctgtgtagcaaattctcaactccactgtggagattccaatgggcggggccctgagttcctaaaaatgtgactttggggtgggggggaagtgggcctagcaaatcattatgtgacaaaattggtggtcactgcagtttcagttctgtagctgtaatttcctacttgtctccctgatggagtgtccagttgtgaaaccaacctcatgggaaatgccctgtgttttttgccaggagccttaagacatcgctcagctagctagacctacttaagtggctttgcaagcattcgattcaaaaggtgcatacacttatacttgcccggggactttcagagtatttctaaattaaaaaaaaaaaaaatgtccaagttaacatttgaccatgaaagcggtcaaatctagttgtcctgtcaagtgcattttcccaatcgcagtattctgcttgcagagtgaagtatgtgttgatgaggacgatcaacatataggcctatgccaagaagttcacaacctcctgagctcattgtgcctctgcttgtgaatgtcttaacattcgatgttttctcttagcagaaagttatttttctgatagtgttgatggactagtatggatacactgataatggtctcccatgctgataaaaaatgatcatggcatcccatgaaggaaagattagtccagagggttatatttgggttttgtgtgggtggatgatcgtgtgtgcccagattttgtccataacttcctcctcatgcttattcagaacagattacacacattcatcccaacattgattaaaacggcttccaaagtccctgaggatatctgtctttgagtaacctctctgagggaagaatagtgttatgaagattaggtatacggggtagtgttggagaaatgtctctagacatacttataataagacatacctgtgtattctgtatatttatattattgacatgtattaataacaaaactttttatctagacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcctgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcaccaaa

SEQ ID NO: 4564 - DNA, 5136 bp, human
gacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcggtatggaagggtcctggagacggggcatgctgcgggctagtgaccgcagccccgaggtctgtagagtgcctggcataggggtcctgtgaggagtgcccactgctgtgtagcaaattctcaactccactgtggagattccaatgggcggggccctgagttcctaaaaatgtgactttggggtgggggggaagtgggcctagcaaatcattatgtgacaaaattggtggtcactgcagtttcagttctgtagctgtaatttcctacttgtctccctgatggagtgtccagttgtgaaaccaacctcatgggaaatgccctgtgttttttgccaggagccttaagacatcgctcagctagctagacctacttaagtggctttgcaagcattcgattcaaaaggtgcatacacttatacttgcccggggactttcagagtatttctaaattaaaaaaaaaaaaaatgtccaagttaacatttgaccatgaaagcggtcaaatctagttgtcctgtcaagtgcattttcccaatcgcagtattctgcttgcagagtgaagtatgtgttgatgaggacgatcaacatataggcctatgccaagaagttcacaacctcctgagctcattgtgcctctgcttgtgaatgtcttaacattcgatgttttctcttagcagaaagttatttttctgatagtgttgatggactagtatggatacactgataatggtctcccatgctgataaaaaatgatcatggcatcccatgaaggaaagattagtccagagggttatatttgggttttgtgtgggtggatgatcgtgtgtgcccagattttgtccataacttcctcctcatgcttattcagaacagattacacacattcatcccaacattgattaaaacggcttccaaagtccctgaggatatctgtctttgagtaacctctctgagggaagaatagtgttatgaagattaggtatacggggtagtgttggagaaatgtctctagacatacttataataagacatacctgtgtattctgtatatttatattattgacatgtattaataacaaaactttttatctagacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcctgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcaccaaa

SEQ ID NO: 4565 - DNA, 3450 bp, human
tggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcctgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcaccaaa

SEQ ID NO: 4566 - DNA, 5144 bp, human
ttaatggggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcggtatggaagggtcctggagacggggcatgctgcgggctagtgaccgcagccccgaggtctgtagagtgcctggcataggggtcctgtgaggagtgcccactgctgtgtagcaaattctcaactccactgtggagattccaatgggcggggccctgagttcctaaaaatgtgactttggggtgggggggaagtgggcctagcaaatcattatgtgacaaaattggtggtcactgcagtttcagttctgtagctgtaatttcctacttgtctccctgatggagtgtccagttgtgaaaccaacctcatgggaaatgccctgtgttttttgccaggagccttaagacatcgctcagctagctagacctacttaagtggctttgcaagcattcgattcaaaaggtgcatacacttatacttgcccggggactttcagagtatttctaaattaaaaaaaaaaaaaatgtccaagttaacatttgaccatgaaagcggtcaaatctagttgtcctgtcaagtgcattttcccaatcgcagtattctgcttgcagagtgaagtatgtgttgatgaggacgatcaacatataggcctatgccaagaagttcacaacctcctgagctcattgtgcctctgcttgtgaatgtcttaacattcgatgttttctcttagcagaaagttatttttctgatagtgttgatggactagtatggatacactgataatggtctcccatgctgataaaaaatgatcatggcatcccatgaaggaaagattagtccagagggttatatttgggttttgtgtgggtggatgatcgtgtgtgcccagattttgtccataacttcctcctcatgcttattcagaacagattacacacattcatcccaacattgattaaaacggcttccaaagtccctgaggatatctgtctttgagtaacctctctgagggaagaatagtgttatgaagattaggtatacggggtagtgttggagaaatgtctctagacatacttataataagacatacctgtgtattctgtatatttatattattgacatgtattaataacaaaactttttatctagacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcctgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcaccaaa

SEQ ID NO: 4567 - DNA, 2948 bp, human
gcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcctgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcaccaaa

SEQ ID NO: 4568 - DNA, 1938 bp, human
gtgcgcatgttcactgggcgtcttcccatcggccccttcgccagtgtggggaacgcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcggtatggaagggtcctggagacggggcatgctgcgggctagtgaccgcagccccgaggtctgtagagtgcctggcataggggtcctgtgaggagtgcccactgctgtgtagcaaattctcaactccactgtggagattccaatgggcggggccctgagttcctaaaaatgtgactttggggtgggggggaagtgggcctagcaaatcattatgtgacaaaattggtggtcactgcagtttcagttctgtagctgtaatttcctacttgtctccctgatggagtgtccagttgtgaaaccaacctcatgggaaatgccctgtgttttttgccaggagccttaagacatcgctcagctagctagacctacttaagtggctttgcaagcattcgattcaaaaggtgcatacacttatacttgcccggggactttcagagtatttctaaattaaaaaaaaaaaaaatgtccaagttaacatttgaccatgaaagcggtcaaatctagttgtcctgtcaagtgcattttcccaatcgcagtattctgcttgcagagtgaagtatgtgttgatgaggacgatcaacatataggcctatgccaagaagttcacaacctcctgagctcattgtgcctctgcttgtgaatgtcttaacattcgatgttttctcttagcagaaagttatttttctgatagtgttgatggactagtatggatacactgataatggtctcccatgctgataaaaaatgatcatggcatcccatgaaggaaagattagtccagagggttatatttgggttttgtgtgggtggatgatcgtgtgtgcccagattttgtccataacttcctcctcatgcttattcagaacagattacacacattcatcccaacattgattaaaacggcttccaaagtccctgaggatatctgtctttgagtaacctctctgagggaagaatagtgttatgaagattaggtatacggggtagtgttggagaaatgtctctagacatacttataataagacatacctgtgtattctgtatatttatattattgacatgtattaataacaaaactttttatctagacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggt

SEQ ID NO: 4569 - DNA, 4980 bp, human
ggaacgcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcggtatggaagggtcctggagacggggcatgctgcgggctagtgaccgcagccccgaggtctgtagagtgcctggcataggggtcctgtgaggagtgcccactgctgtgtagcaaattctcaactccactgtggagattccaatgggcggggccctgagttcctaaaaatgtgactttggggtgggggggaagtgggcctagcaaatcattatgtgacaaaattggtggtcactgcagtttcagttctgtagctgtaatttcctacttgtctccctgatggagtgtccagttgtgaaaccaacctcatgggaaatgccctgtgttttttgccaggagccttaagacatcgctcagctagctagacctacttaagtggctttgcaagcattcgattcaaaaggtgcatacacttatacttgcccggggactttcagagtatttctaaattaaaaaaaaaaaaaatgtccaagttaacatttgaccatgaaagcggtcaaatctagttgtcctgtcaagtgcattttcccaatcgcagtattctgcttgcagagtgaagtatgtgttgatgaggacgatcaacatataggcctatgccaagaagttcacaacctcctgagctcattgtgcctctgcttgtgaatgtcttaacattcgatgttttctcttagcagaaagttatttttctgatagtgttgatggactagtatggatacactgataatggtctcccatgctgataaaaaatgatcatggcatcccatgaaggaaagattagtccagagggttatatttgggttttgtgtgggtggatgatcgtgtgtgcccagattttgtccataacttcctcctcatgcttattcagaacagattacacacattcatcccaacattgattaaaacggcttccaaagtccctgaggatatctgtctttgagtaacctctctgagggaagaatagtgttatgaagattaggtatacggggtagtgttggagaaatgtctctagacatacttataataagacatacctgtgtattctgtatatttatattattgacatgtattaataacaaaactttttatctagacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcctgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcaccaaa

SEQ ID NO: 4570 - DNA, 2948 bp, human; identical to SEQ ID NO: 3400

SEQ ID NO: 4571 - DNA, 4977 bp, human
gggaacgcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcggtatggaagggtcctggagacggggcatgctgcgggctagtgaccgcagccccgaggtctgtagagtgcctggcataggggtcctgtgaggagtgcccactgctgtgtagcaaattctcaactccactgtggagattccaatgggcggggccctgagttcctaaaaatgtgactttggggtgggggggaagtgggcctagcaaatcattatgtgacaaaattggtggtcactgcagtttcagttctgtagctgtaatttcctacttgtctccctgatggagtgtccagttgtgaaaccaacctcatgggaaatgccctgtgttttttgccaggagccttaagacatcgctcagctagctagacctacttaagtggctttgcaagcattcgattcaaaaggtgcatacacttatacttgcccggggactttcagagtatttctaaattaaaaaaaaaaaaaatgtccaagttaacatttgaccatgaaagcggtcaaatctagttgtcctgtcaagtgcattttcccaatcgcagtattctgcttgcagagtgaagtatgtgttgatgaggacgatcaacatataggcctatgccaagaagttcacaacctcctgagctcattgtgcctctgcttgtgaatgtcttaacattcgatgttttctcttagcagaaagttatttttctgatagtgttgatggactagtatggatacactgataatggtctcccatgctgataaaaaatgatcatggcatcccatgaaggaaagattagtccagagggttatatttgggttttgtgtgggtggatgatcgtgtgtgcccagattttgtccataacttcctcctcatgcttattcagaacagattacacacattcatcccaacattgattaaaacggcttccaaagtccctgaggatatctgtctttgagtaacctctctgagggaagaatagtgttatgaagattaggtatacggggtagtgttggagaaatgtctctagacatacttataataagacatacctgtgtattctgtatatttatattattgacatgtattaataacaaaactttttatctagacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcttgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcac

SEQ ID NO: 4572 - DNA, 5136 bp, human; identical to SEQ ID NO: 3399

SEQ ID NO: 4573 - DNA, 5144 bp, human; identical to SEQ ID NO: 3401

SEQ ID NO: 4574 - DNA, 3450 bp, human
atggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcttgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcaccaa

SEQ ID NO: 4575 - DNA, 4935 bp, human; identical to SEQ ID NO: 3397

SEQ ID NO: 4576 - DNA, 4935 bp, human; identical to SEQ ID NO: 3397

SEQ ID NO: 4577 - DNA, 4980 bp, human; identical to SEQ ID NO: 3398

SEQ ID NO: 4578 - DNA, 5136 bp, human; identical to SEQ ID NO: 3399

SEQ ID NO: 4579 - DNA, 2948 bp, human; identical to SEQ ID NO: 3400

SEQ ID NO: 4580 - DNA, 5144 bp, human; identical to SEQ ID NO: 3401

SEQ ID NO: 4581 - DNA, 4333 bp, human
tgaatgtcctcagatgactttcggcagactctagagaatcttcccgaaggtgagtatctctcaaatctaaatgaccagagaacctttgtccctccatggatgcgaaaactggtaagagtgggagaatatcaaaaatgccctcactgcctcctttttcccatgtctatcacaacacctgatgtagcattgacggcttgataacactgacagttgtaatccttaacacttcttttgttttcatagtgatgccagatattctaagcaggttacatggattaatttatttaatccttaagaatacgtctatgacgttgtttctattattatctccaaataatgtctcatacatttcagttgtcatccacacaaaagccatgtgacttggcgcaaatcttctaagttctctgagctccagactcctgggccatgaaatggaagtaaagaatcatagttcatgttttagatcatagttatcagcaaaataataataacatgagactatcgtggtacagagatgttagagaattttcctgaggtgcagtggcagtggtagtctgatccagagctccaagccatttaaagctcattcacgtttgcatttgtttatgaagttcagatgttgctcactagggctttaccccatagggcctgctggtgcttccaaggagacacccactctcgcaacaggaaggaccagctggcttctgatccgttactggggccactcgcatggcttaggaataggtttgactgtgggcccctccctactgtgagctccttgagggctttctctacacctggtgcatccgagaaaccccagtcccagcccaggggtttccttggaggcccctgaacgagtgactccacaactacatattcaattccggtttagagggtaaagggatctgggattgggttgccagtatggaggacaaattcaaagaaggatcatgaaaggtattaattgttattattactacatttaaacagtgtttataagctcagagaggactttcccttagcctattttacatgtattgttcactatttcataagtgaggaagctgaataaatgtagcttaagactgttggtcagtgacccatcccagtgcaaccagaattgatatgggtaccacctcactgaattccacattcaatgttggtgcctcggtaggctggtatgccagatctggtactgctttctttgctgcctggattaatttcagcaaaccatttctttccctctcccttccctgtattcctctccccacaccatctttcccagcagtgtttcgtcccctccctatgtttttacatttaccctcccagcagctgtctacgagcttatatgggatcccttgtattttatagaagctcttccttttgcagacctgtgaattcttagaatgctatgctccaaatcttctgtatatcacactctcaattacatggagatttttgctgtttgcaagaatgtcagtcctaaaagagtgggaagataagcattctatccctggaaaccccattcatgtaggccaatcctttcccttctaacctcccctcccaggtttctcctaatttaggcaagtgtaactctcccagctttgttgagaacattgattaaggtaatgcatgcgaagacgctttgtaagctctaaagcactatagaaatggcactgattctgtttatctgtgaccttcacattataaagatcatgcccaagaagccagcagaggaaggaaatgattagaagggagtgccagaagcatctgccccacaaaacgatccgaagcagctgtgcccacccaggaaaagcaaatacctctagaagattcacaagagatctggtaagaggaaacaattcgggaacaaaccctctggctttcctggctatgttcaggtgtgtggattgggtgtgtggcacggaccccagacaagcctgggtcccggctgagctgaggagcttgcccagcgccagaagagatgttagacatgacttccagagacacagagtggagttgtcatccatatacaaccacgtgacttggggcaagtcttccaaattttctcagctccagattcccagtccatacgatggaagtaaagaatcatagttcacaaattgtttggagacattatatttagtctagaaggcctgatgacatgaaaggtgctcaagcaattctatctgtaattaattacctgggatcatgtcttacgcagctcaatgcctgatacccaatcagttgtacttcagagatattgcaggttcggttccagaccactgcaataaagtgagtcacacattttttttgttattgtcgtttcgcagtgcataaaaacattacgttttcactatagtgtactctactaagtgtgcaatagcattgtctaaaaatgtacataccttaattttaaaataattcattgataaaaaatgctaacaatcttctgagccttcagtgagtcacactctttttgctggtggagggtcttgccttggtgttaatggctgctggctgatcaaggtggtggttgctgaagattggagtggctgtggcagtttcttaaaagaacacaacggtgaaatttgccacattgattagctctccctttcatgaaagatttccctgtagtgtgtgatgctactggatagcattttacccacagtagaacttctttcaaagttggagtcaatcctctctagctatgaaagtcctagatggcatctccttccaatagaaggctattttatctacattgaaaatctgttgtttagtgtagccaccttcatcagtgatcttagctagatctcctggataacttgctgcagcttctccatcagggtttgctgcttcaccttgcacttttatgttatggagatggcttctttccttaaacctcacgaaccaacttctactagcttcacgtgtttctcctgcagcttcttcacctctctcagctttcatggacgtgaagagagttcaggtctttctctgaattagactttggcttaagggaatgttgtggctggtttcatgttctgtcctgaccacgcaatcttcctctatttcagcagtaaggctgctttactttcttatttgtgtgttcactggagtattagtattattatttccttcaagacctttcctttgcattatatactattatttccttcaagaacttttcctttgcaatcacagcttggctgtttggtggaagaggccgagctttcagcctgtcttggctttcagcgtgccttcctcactaagcttagccatttctagcttgtgatttagagtgagagacatgcgactcttcccttcctttgaacacttagtggccattgtagggttgttcattgtcctaatttcagtattgctgtgtctcaagaaatagggaggcccaagaaaaggaaggtaggcaaggaagagctcatcggtggagcagtcagaacacacacaacattgatcaattaagtttgtcatcttctgtgggtgcagttcctgttacccctaaaacaattacccacaacagggtgattattgtcagtaataacctaattgcacatttaaaaaaactaacacagtgtaaatggattgtttgtaacacaaggataaatggttgaggggacggataccctatttgccatgatgtgattattatgcattgcatgcatgtatcaaaacatctcacgtaccccataagtatatagacctactgcgtacccacaaaaataaaaaaaattattttaaaagactaaagaacaacaaaacaatcgcaatcataatatcaaagctcactgatcacagatcactataacagatataataataatggaaaagtgtaaaattggtgagaatttcaaaaaaaaattgcagtatctgcgaagcaggataaaaatgaggtgccataaaacaaggtttgccttgtgcccttaacaaatacgtgcagcatgaaaggaggtatgggtgagtgttcccataagtgaagaggctgggaatctaaacctgacaacggaaggagccagaagctaaaactttaattggtatttgtggtgtattggtgtggatctaaggcctcagcctctctaagccagagaatgtgaaaaactggataaagaaggcccatgggcacttggtggtggggaggcatctccttttttgagaaaacagagcctaacactctccaacccacccaaccctcactttccaactattctccatcataggacccaaaagggggaaacatgcctggacccacagactgcgtgagagaaagcagctggtgatttatgaagagatcagcgaccctgaggaagatgacgagtaa

SEQ ID NO: 4582 - DNA, 4329 bp, human
ttgaatgtcctcagatgactttcggcagactctagagaatcttcccgaaggtgagtatctctcaaatctaaatgaccagagaacctttgtccctccatggatgcgaaaactggtaagagtgggagaatatcaaaaatgccctcactgcctcctttttcccatgtctatcacaacacctgatgtagcattgacggcttgataacactgacagttgtaatccttaacacttcttttgttttcatagtgatgccagatattctaagcaggttacatggattaatttatttaatccttaagaatacgtctatgacgttgtttctattattatctccaaataatgtctcatacatttcagttgtcatccacacaaaagccatgtgacttggcgcaaatcttctaagttctctgagctccagactcctgggccatgaaatggaagtaaagaatcatagttcatgttttagatcatagttatcagcaaaataataataacatgagactatcgtggtacagagatgttagagaattttcctgaggtgcagtggcagtggtagtctgatccagagctccaagccatttaaagctcattcacgtttgcatttgtttatgaagttcagatgttgctcactagggctttaccccatagggcctgctggtgcttccaaggagacacccactctcgcaacaggaaggaccagctggcttctgatccgttactggggccactcgcatggcttaggaataggtttgactgtgggcccctccctactgtgagctccttgagggctttctctacacctggtgcatccgagaaaccccagtcccagcccaggggtttccttggaggcccctgaacgagtgactccacaactacatattcaattccggtttagagggtaaagggatctgggattgggttgccagtatggaggacaaattcaaagaaggatcatgaaaggtattaattgttattattactacatttaaacagtgtttataagctcagagaggactttcccttagcctattttacatgtattgttcactatttcataagtgaggaagctgaataaatgtagcttaagactgttggtcagtgacccatcccagtgcaaccagaattgatatgggtaccacctcactgaattccacattcaatgttggtgcctcggtaggctggtatgccagatctggtactgctttctttgctgcctggattaatttcagcaaaccatttctttccctctcccttccctgtattcctctccccacaccatctttcccagcagtgtttcgtcccctccctatgtttttacatttaccctcccagcagctgtctacgagcttatatgggatcccttgtattttatagaagctcttccttttgcagacctgtgaattcttagaatgctatgctccaaatcttctgtatatcacactctcaattacatggagatttttgctgtttgcaagaatgtcagtcctaaaagagtgggaagataagcattctatccctggaaaccccattcatgtaggccaatcctttcccttctaacctcccctcccaggtttctcctaatttaggcaagtgtaactctcccagctttgttgagaacattgattaaggtaatgcatgcgaagacgctttgtaagctctaaagcactatagaaatggcactgattctgtttatctgtgaccttcacattataaagatcatgcccaagaagccagcagaggaaggaaatgattagaagggagtgccagaagcatctgccccacaaaacgatccgaagcagctgtgcccacccaggaaaagcaaatacctctagaagattcacaagagatctggtaagaggaaacaattcgggaacaaaccctctggctttcctggctatgttcaggtgtgtggattgggtgtgtggcacggaccccagacaagcctgggtcccggctgagctgaggagcttgcccagcgccagaagagatgttagacatgacttccagagacacagagtggagttgtcatccatatacaaccacgtgacttggggcaagtcttccaaattttctcagctccagattcccagtccatacgatggaagtaaagaatcatagttcacaaattgtttggagacattatatttagtctagaaggcctgatgacatgaaaggtgctcaagcaattctatctgtaattacctgggatcatgtcttacgcagctcaatgcctgatacccaatcagttgtacttcagagatattgcaggttcggttccagaccactgcaataaagtgagtcacacattttttttgttattgtcgtttcgcagtgcataaaaacattacgttttcactatagtgtactctactaagtgtgcaatagcattgtctaaaaatgtacataccttaattttaaaataattcattgataaaaaatgctaacaatcttctgagccttcagtgagtcacactctttttgctggtggagggtcttgccttggtgttaatggctgctggctgatcaaggtggtggttgctgaagattggagtggctgtggcagtttcttaaaagaacacaacggtgaaatttgccacattgattagctctccctttcatgaaagatttccctgtagtgtgtgatgctactggatagcattttacccacagtagaacttctttcaaagttggagtcaatcctctctagctatgaaagtcctagatggcatctccttccaatagaaggctattttatctacattgaaaatctgttgtttagtgtagccaccttcatcagtgatcttagctagatctcctggataacttgctgcagcttctccatcagggtttgctgcttcaccttgcacttttatgttatggagatggcttctttccttaaacctcacgaaccaacttctactagcttcacgtgtttctcctgcagcttcttcacctctctcagctttcatggacgtgaagagagttcaggtctttctctgaattagactttggcttaagggaatgttgtggctggtttcatgttctgtcctgaccacgcaatcttcctctatttcagcagtaaggctgctttactttcttatttgtgtgttcactggagtattagtattattatttccttcaagacctttcctttgcattatatactattatttccttcaagaacttttcctttgcaatcacagcttggctgtttggtggaagaggccgagctttcagcctgtcttggctttcagcgtgccttcctcactaagcttagccatttctagcttgtgatttagagtgagagacatgcgactcttcccttcctttgaacacttagtggccattgtagggttgttcattgtcctaatttcagtattgctgtgtctcaagaaatagggaggcccaagaaaaggaaggtaggcaaggaagagctcatcggtggagcagtcagaacacacacaacattgatcaattaagtttgtcatcttctgtgggtgcagttcctgttacccctaaaacaattacccacaacagggtgattattgtcagtaataacctaattgcacatttaaaaaaactaacacagtgtaaatggattgtttgtaacacaaggataaatggttgaggggacggataccctatttgccatgatgtgattattatgcattgcatgcatgtatcaaaacatctcacgtaccccataagtatatagacctactgcgtacccacaaaaataaaaaaaattattttaaaagactaaagaacaacaaaacaatcgcaatcataatatcaaagctcactgatcacagatcactataacagatataataataatggaaaagtgtaaaattggtgagaatttcaaaaaaaaattgcagtatctgcgaagcaggataaaaatgaggtgccataaaacaaggtttgccttgtgcccttaacaaatacgtgcagcatgaaaggaggtatgggtgagtgttcccataagtgaagaggctgggaatctaaacctgacaacggaaggagccagaagctaaaactttaattggtatttgtggtgtattggtgtggatctaaggcctcagcctctctaagccagagaatgtgaaaaactggataaagaaggcccatgggcacttggtggtggggaggcatctccttttttgagaaaacagagcctaacactctccaacccacccaaccctcactttccaactattctccatcataggacccaaaagggggaaacatgcctggacccacagactgcgtgagagaaagcagctggtgatttatgaagagatcagcgaccctgaggaagatgacgagta

SEQ ID NO: 4583 - DNA, 8971 bp, human
ggctgagtcgttccaacatggcgcagatgccacaaggacactagcacaccagcaggaagctgaacagaaggctggaggtgccacggtgacaaggacgggatcctgtcaggccaggtaagcttctgctctgccagtgacacggaaagggacaatgaagggccacagatacagaaagcatgtctgtgcagcctgcagagttcaggtgaaggagggacccaggcaggagcagtcagaaccaggagggcttaggcaagagacaggacaggcaaaggcactgatgcagcccacccagacttgacagacgcgttcatccaggtgttcatgtccttgtcactgtggacatctgtgttgcagccacagaaccacatactcgattaggacgcctgaacccaatcaatagtcgtttttccctacagaccctgggggaggcccacatgcacttgccctagggtactctgacattttggcactgcagtcccactgggaggccacatggagtaacatactggccaagacatatttaaaaattctggcagggtgcggtggctcacacctgtaatcccaggacttggggagggcaaggcaggcagatcacttgaggtcaggagttcaagaacagcctggccaatatggtgaagccccatttctactaaaaatccaaaaaaaaaataatcccgggtgcagtgacgcacacctgtaatcccagctacttgggtggctgaggcacaagaatcacttgatcccaggaggtggaggatgcagtgagctgagattgtgccactgcactccagcctgggtgacagagctagtctctatctaaaataaacaaataattttgtagcctcttttactaggagttctggaattagggaagagaggaaaggtacaaccctcctcccgaactccaggggaggagaatctcattgcacagatgtcctctgttcactcgattctcctggagcatttctaaggcacacagagctgctaccatcatagccattactgaccaagtactctgggtgaaattcctttattaactgaataaacttgttctgaagtgctgaccggacactctggggacagggggaggtttcggctgtatccttgctggcagatgacccccacacttggggggtaaggagagccatggcagaattcaacccacggtcccctaggagtacacaggagaccaccctaccctcacctgagggatgtgtgtgtgcaagggttgggtcagggcagactcttcagaagaggggaggtttgtgcggcaggcactttgattctgcacagcttacagtccagagagccgaagaacaagaggaactagattcccattctcagtctgttgatttccacaccacatttggagtctgatcaactccacagctgtgttgcagccgctaacgctgcctctgctctgtttgcctctagattcttcttatctgttaaataaagtgaggctgatggagatgtaatttagggcaggggtggattgcaagtgtctctgtgatagggcaaagcgcctcccggtggaggcgcagaagctaaactcgactggtagctgtgaggcaagggacgccagggcagctcctgtggactgtgttagaacttttcagggtggctttgccctgccaggggcctggatctcacagggggacgtcgtgttaggaccaagctgactgtcccatcacagaataatatctgcagctcagcatggggagcataagcaaagtacgttgtcgtgagtttaaagaggcctggctttggagtctgacagaacccgcgtgtgagtcccagatccagccttttctgcctcagtgccctgacctctttcagcttggttccttatctgtagatgggagtttgatacttacctctctgggtctttgggaaatcaacactgtacatgagtagcacacagtaggtcctcaacaaccaggctccagggagagagagccattcacactgtgccatgttagaggcacatcagtgtgcaggccagcgtgccaggacagtgggagtccagtctaccctccagccagggtttgggcttgggctgatggtggcaggaccagggccatttccatcttttctcttttattgtccatatgtccaaagcagacacttccattcatattcaggtgtgcaatgctaggagctgaaataacaggctgtagtgaatgaagcgaagcctcacagttcactctatggcaggaagaaccagctgtgaggcaggtcctcagcccacatcacttcatggtactgaacctggggccacagttccaaactccatgttcacacatgatgagtctataggaatgaaggagagatctatgttgtgtatctttattattatgttttattgtatatatttaaggtataaaacatgttgttatacacacacacacacacacacacagtgaaataattgctacagtcaggcaaatgaacctgtcaccttcctcagttaccttcctgcatcctatttttgcaagtaaacttttcctaaaaaccctactctcacgtgacattccagttggttggcccattgggggaattttcatgaatctccatcatgtgctattcagtaaaaatatcaaacccactaagcatgccttttcatccagttgctccctaggtaaagtataatttgctctccttcacttgagagctgaaggtaaggagcaatcaggcagcggttgatggagcaagtgcaggccagacagagggaagggcggttgtgaggcggcagacacgagagagagacagcgagagagcgagcgtgcacgctagacagagagaggcctggtagtagctggggcctgataccctaatccaggaggctggactttatcctaagggcagcaggcagccctagtagaatttgaaaaggtttgacatgaccagattagcagtcaagaaaggtgccccactcactgggacagagaatgcgtgggaaggggtcaagactggcagcaagatgagctatgaattgttggtggtcatcgaggagggagatgagggtgactggactagggaacttcctgtggtgatggagaggagtcagtgtcaaggtctcacttagaaaaacttgggaggtctaactggccaggctcggtcaactgtgggggtggtaagaggcagcaatcaaggatggctttcaagatctttggcccaagctgctgggtagagggtggtgcctgtcactgagtcaggcagcacaggaggaggggcaggcgtgctgagtggggatgggtgcgttcactttgggacatgctgagcagtacttgctatgggactcaacgacttatgacttgaagacttcgcagagctgacctaacctccctgtgcttaccgtgcctcatctgtaataggagaataagaataattagaaaaaataactaattagtttcatttgttgagtctaggagaatgttctccttttatactgcagagtggtattttcttgtcaggtcttcccaagtaaaatgggaatgtctcgacttgcccatacagtggcttgattttacctgtctgctttgggtatcaccaccattcggcatgtattgccaatactaaacaaataagtaaatacataaattcaaagtaacaggtgtttattatcacgtgtgtgctgtaatagcccatcagcctgtccctcagacaaataaactctctttaaatcttctaaacttcctcttgaagcccacctctccctccaggggctggacagggcatttgggacccaggatctctaacactctcttctctgggaagccatctcccactgcccaggatgctggatgggaggtgagtgcaacgggcctgtggggttgtcagttggcggaagaaatctgtagatccagggagagaatcgagccacatgtgtggatttggaaatgacagtgtatggctgcacagcacgaaggggatgaagtcacagacacctggatttaaatcgagactccaccatttatttcttgtacgactttggggaggttacttaatctctttgtggctcagttacttcatttgtaaaatgaaatgataatattctgggagaatggttcatgtttccttccttcataaactgctgttcacgaggcggcttcttccagggttaaaaaggaatctactatccatgtatctgctaggacagacattgttgcgtgtcacttgactcctgaaatacgccacggtaaagaaatctctgtacactttcgtgttctgggaagtcactgaccacacaggaccaattattctccatgagacttagataagggatgctgtctgcccactctgtgccgtgactcccagatggcagacaccaccagtccttgttcttttgtctcatgaatgtgttgtaaccaagcgagttatagagaaacgccacacttttgagacaaattaaggggacctttattagctggcgacctacaggcagctaacgctcaaaattctctcggccccaaggaaggggctagttttgtttttataccgtggtctaaacaggggaggggggagtttagctgaagcaattttacagaagcagaataggcaaaaagttaaaaaaaattaattggttatagaagcagttacaaaaaataaacagttccaggtgcaggggcttaaactatgattaagagataaatgcaggggcttttaggtaccttccaccgagcacattcccgagctgttggtacagcctgcctcaatatcttaccagcaggtgtattcttggatgtgcttggactcagcttgcactagttattcccttaagggggataaagggggctgcaagtgaagaaactaaaatggagtctgtccggctctctctgctaggaaagagtcactcaggttaaaacaaggtagggtatcacaaatgattcacttagacgggaagtctgtcctcctaaaagtagctaggcacagagagaaacattccctgttcagctggctgagacttccgctgattaaaaaaaaaacaaaaaaccctgccccataaatctccccactgaaaccggtgtactccttcctatgaaagtaaaagacacccccgccccgccccggttaccccaacagtgtgatttccacttctggggcgctctccctaaggcagtagcctgaataatttcaatgtattggattgtttggtttctgtctttaccaaggtgcatttatcattcatgcaaaaacagtaaaaaaaaaaaaaaaaaaaaaaaaaaatgaaacagcacgtgtcggttctcagcggcgcgccctagctcaaaactccagccaatcacaggagaagtcggccgcctcccaaccctccagcccagttcccacgtccctcgcccgggaagtcacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggttcagtttctcagcggcgtcgcatccctgtgacgtgagcacatcctcgccggcgcccccttccgcgctgcggcgcctctagcccgccggagggcggctcctctcgatggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggtgagtctaggcaagctccattctcgccagagcggacttgctccttgtcttcctcttgctgctctggccactcttcttggtccctcccctgttccctccccggactcccggttgtactcccgctgcttttctgtgtactcacctgctgggagacccctgatgccagcaccacgcttcactgctgtcttcattttcttctttctttcttgaaagtgggcattgctggctttactgactacctgttcttttgttacaaagctgctaaaaattgtatctcttccgctccagacccagtaggatagagatgatctgtgtaggcatcaaaaatgtagaacatctgcaagtcatgtgtaggacagactctttcctcaatctgtgtggcgttgcgtggctaggagttagattcctttgccatgacatggcacaagactaggagcacggttttcagcacccagagaacttgcacagaccttagacattttgctgtaggattttgccacttctagaaaaaagtccatgtggccgggcgtggtggctcacgcctgtaatctcagcactttgggaagccgacgtgggcagatcacaaggtcaggagttcgcggccagcctggccaccgtggtgaaaccctgtctctactaaaaatacaaatgtgagccgggtgtggtggcgggtgcttgtaatcccagctactccggaggctgaggcaggagaattgctttaaaccaggagacggaggttgcagtgagctgagatcatgccactgcactccagcctgggcgacacagtgagactgtctcaaaaaaaaaaaaaaaagtccatatttaattgggattattaaatgaaatctgtatctttaaactgaaataaatgcattttattatctcatattattgtggaagattgaaaaaagcatcacatgggactggcttaattttgaaaagaaacacaaagctcttcctggcgctcatctgcagggtgtagtctggattcacttgcttagctgttctctttctccttccgcacaggagaattgaagcgaatgagagtgg

SEQ ID NO: 4584 - DNA, 16753 bp, human
ctttggaaaagctttggccgagaggaagggtccattcagatggttggggagtggggcttagaattttatatttagtttacaaagatgatgggggctgtgttaaaaagaaaaaatatacagatcacagtacagggattgggaattgggggaggcactgggttagctgcaggtaaattataacagagtgactagggtaggctgggttgagaaggtgacaatttgacaaagatgtgaagggggaggagtcagtcaagcagatatctgtggtgaaggccttccagacagagggagcagttggaaaaaagtcagaggctgagtcgttccaacatggcgcagatgccacaaggacactagcacaccagcaggaagctgaacagaaggctggaggtgccacggtgacaaggacgggatcctgtcaggccaggtaagcttctgctctgccagtgacacggaaagggacaatgaagggccacagatacagaaagcatgtctgtgcagcctgcagagttcaggtgaaggagggacccaggcaggagcagtcagaaccaggagggcttaggcaagagacaggacaggcaaaggcactgatgcagcccacccagacttgacagacgcgttcatccaggtgttcatgtccttgtcactgtggacatctgtgttgcagccacagaaccacatactcgattaggacgcctgaacccaatcaatagtcgtttttccctacagaccctgggggaggcccacatgcacttgccctagggtactctgacattttggcactgcagtcccactgggaggccacatggagtaacatactggccaagacatatttaaaaattctggcagggtgcggtggctcacacctgtaatcccaggacttggggagggcaaggcaggcagatcacttgaggtcaggagttcaagaacagcctggccaatatggtgaagccccatttctactaaaaatccaaaaaaaaaataatcccgggtgcagtgacgcacacctgtaatcccagctacttgggtggctgaggcacaagaatcacttgatcccaggaggtggaggatgcagtgagctgagattgtgccactgcactccagcctgggtgacagagctagtctctatctaaaataaacaaataattttgtagcctcttttactaggagttctggaattagggaagagaggaaaggtacaaccctcctcccgaactccaggggaggagaatctcattgcacagatgtcctctgttcactcgattctcctggagcatttctaaggcacacagagctgctaccatcatagccattactgaccaagtactctgggtgaaattcctttattaactgaataaacttgttctgaagtgctgaccggacactctggggacagggggaggtttcggctgtatccttgctggcagatgacccccacacttggggggtaaggagagccatggcagaattcaacccacggtcccctaggagtacacaggagaccaccctaccctcacctgagggatgtgtgtgtgcaagggttgggtcagggcagactcttcagaagaggggaggtttgtgcggcaggcactttgattctgcacagcttacagtccagagagccgaagaacaagaggaactagattcccattctcagtctgttgatttccacaccacatttggagtctgatcaactccacagctgtgttgcagccgctaacgctgcctctgctctgtttgcctctagattcttcttatctgttaaataaagtgaggctgatggagatgtaatttagggcaggggtggattgcaagtgtctctgtgatagggcaaagcgcctcccggtggaggcgcagaagctaaactcgactggtagctgtgaggcaagggacgccagggcagctcctgtggactgtgttagaacttttcagggtggctttgccctgccaggggcctggatctcacagggggacgtcgtgttaggaccaagctgactgtcccatcacagaataatatctgcagctcagcatggggagcataagcaaagtacgttgtcgtgagtttaaagaggcctggctttggagtctgacagaacccgcgtgtgagtcccagatccagccttttctgcctcagtgccctgacctctttcagcttggttccttatctgtagatgggagtttgatacttacctctctgggtctttgggaaatcaacactgtacatgagtagcacacagtaggtcctcaacaaccaggctccagggagagagagccattcacactgtgccatgttagaggcacatcagtgtgcaggccagcgtgccaggacagtgggagtccagtctaccctccagccagggtttgggcttgggctgatggtggcaggaccagggccatttccatcttttctcttttattgtccatatgtccaaagcagacacttccattcatattcaggtgtgcaatgctaggagctgaaataacaggctgtagtgaatgaagcgaagcctcacagttcactctatggcaggaagaaccagctgtgaggcaggtcctcagcccacatcacttcatggtactgaacctggggccacagttccaaactccatgttcacacatgatgagtctataggaatgaaggagagatctatgttgtgtatctttattattatgttttattgtatatatttaaggtataaaacatgttgttatacacacacacacacacacacacagtgaaataattgctacagtcaggcaaatgaacctgtcaccttcctcagttaccttcctgcatcctatttttgcaagtaaacttttcctaaaaaccctactctcacgtgacattccagttggttggcccattgggggaattttcatgaatctccatcatgtgctattcagtaaaaatatcaaacccactaagcatgccttttcatccagttgctccctaggtaaagtataatttgctctccttcacttgagagctgaaggtaaggagcaatcaggcagcggttgatggagcaagtgcaggccagacagagggaagggcggttgtgaggcggcagacacgagagagagacagcgagagagcgagcgtgcacgctagacagagagaggcctggtagtagctggggcctgataccctaatccaggaggctggactttatcctaagggcagcaggcagccctagtagaatttgaaaaggtttgacatgaccagattagcagtcaagaaaggtgccccactcactgggacagagaatgcgtgggaaggggtcaagactggcagcaagatgagctatgaattgttggtggtcatcgaggagggagatgagggtgactggactagggaacttcctgtggtgatggagaggagtcagtgtcaaggtctcacttagaaaaacttgggaggtctaactggccaggctcggtcaactgtgggggtggtaagaggcagcaatcaaggatggctttcaagatctttggcccaagctgctgggtagagggtggtgcctgtcactgagtcaggcagcacaggaggaggggcaggcgtgctgagtggggatgggtgcgttcactttgggacatgctgagcagtacttgctatgggactcaacgacttatgacttgaagacttcgcagagctgacctaacctccctgtgcttaccgtgcctcatctgtaataggagaataagaataattagaaaaaataactaattagtttcatttgttgagtctaggagaatgttctccttttatactgcagagtggtattttcttgtcaggtcttcccaagtaaaatgggaatgtctcgacttgcccatacagtggcttgattttacctgtctgctttgggtatcaccaccattcggcatgtattgccaatactaaacaaataagtaaatacataaattcaaagtaacaggtgtttattatcacgtgtgtgctgtaatagcccatcagcctgtccctcagacaaataaactctctttaaatcttctaaacttcctcttgaagcccacctctccctccaggggctggacagggcatttgggacccaggatctctaacactctcttctctgggaagccatctcccactgcccaggatgctggatgggaggtgagtgcaacgggcctgtggggttgtcagttggcggaagaaatctgtagatccagggagagaatcgagccacatgtgtggatttggaaatgacagtgtatggctgcacagcacgaaggggatgaagtcacagacacctggatttaaatcgagactccaccatttatttcttgtacgactttggggaggttacttaatctctttgtggctcagttacttcatttgtaaaatgaaatgataatattctgggagaatggttcatgtttccttccttcataaactgctgttcacgaggcggcttcttccagggttaaaaaggaatctactatccatgtatctgctaggacagacattgttgcgtgtcacttgactcctgaaatacgccacggtaaagaaatctctgtacactttcgtgttctgggaagtcactgaccacacaggaccaattattctccatgagacttagataagggatgctgtctgcccactctgtgccgtgactcccagatggcagacaccaccagtccttgttcttttgtctcatgaatgtgttgtaaccaagcgagttatagagaaacgccacacttttgagacaaattaaggggacctttattagctggcgacctacaggcagctaacgctcaaaattctctcggccccaaggaaggggctagttttgtttttataccgtggtctaaacaggggaggggggagtttagctgaagcaattttacagaagcagaataggcaaaaagttaaaaaaaattaattggttatagaagcagttacaaaaaataaacagttccaggtgcaggggcttaaactatgattaagagataaatgcaggggcttttaggtaccttccaccgagcacattcccgagctgttggtacagcctgcctcaatatcttaccagcaggtgtattcttggatgtgcttggactcagcttgcactagttattcccttaagggggataaagggggctgcaagtgaagaaactaaaatggagtctgtccggctctctctgctaggaaagagtcactcaggttaaaacaaggtagggtatcacaaatgattcacttagacgggaagtctgtcctcctaaaagtagctaggcacagagagaaacattccctgttcagctggctgagacttccgctgattaaaaaaaaaacaaaaaaccctgccccataaatctccccactgaaaccggtgtactccttcctatgaaagtaaaagacacccccgccccgccccggttaccccaacagtgtgatttccacttctggggcgctctccctaaggcagtagcctgaataatttcaatgtattggattgtttggtttctgtctttaccaaggtgcatttatcattcatgcaaaaacagtaaaaaaaaaaaaaaaaaaaaaaaaaaatgaaacagcacgtgtcggttctcagcggcgcgccctagctcaaaactccagccaatcacaggagaagtcggccgcctcccaaccctccagcccagttcccacgtccctcgcccgggaagtcacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggttcagtttctcagcggcgtcgcatccctgtgacgtgagcacatcctcgccggcgcccccttccgcgctgcggcgcctctagcccgccggagggcggctcctctcgatggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggtgagtctaggcaagctccattctcgccagagcggacttgctccttgtcttcctcttgctgctctggccactcttcttggtccctcccctgttccctccccggactcccggttgtactcccgctgcttttctgtgtactcacctgctgggagacccctgatgccagcaccacgcttcactgctgtcttcattttcttctttctttcttgaaagtgggcattgctggctttactgactacctgttcttttgttacaaagctgctaaaaattgtatctcttccgctccagacccagtaggatagagatgatctgtgtaggcatcaaaaatgtagaacatctgcaagtcatgtgtaggacagactctttcctcaatctgtgtggcgttgcgtggctaggagttagattcctttgccatgacatggcacaagactaggagcacggttttcagcacccagagaacttgcacagaccttagacattttgctgtaggattttgccacttctagaaaaaagtccatgtggccgggcgtggtggctcacgcctgtaatctcagcactttgggaagccgacgtgggcagatcacaaggtcaggagttcgcggccagcctggccaccgtggtgaaaccctgtctctactaaaaatacaaatgtgagccgggtgtggtggcgggtgcttgtaatcccagctactccggaggctgaggcaggagaattgctttaaaccaggagacggaggttgcagtgagctgagatcatgccactgcactccagcctgggcgacacagtgagactgtctcaaaaaaaaaaaaaaaagtccatatttaattgggattattaaatgaaatctgtatctttaaactgaaataaatgcattttattatctcatattattgtggaagattgaaaaaagcatcacatgggactggcttaattttgaaaagaaacacaaagctcttcctggcgctcatctgcagggtgtagtctggattcacttgcttagctgttctctttctccttccgcacaggagaattgaagcgaatgagagtggggagtgtgagaggtgcgtttggtgcagcatttctggcatgggaacagaactggccaggaggaagtgacggtaaggattcgcagcattgcacccgatccccgggcagctgtggacatgcgggtcagcccctaggactctgctgtctgaactcttccctcaggattactttctcgcttaggtatcaggggaggctgaacacccagagaggcaatgccaccaggggtgtgttcatctgcagtcagggagacctgggagggaattctgtccctgagtggttgtgtgatctgagggaagttacttgacctctccatgcaggaatttctgcctttgcaacgtgggaaaatatggattctgcagggttgacttgacattctcagtgagatgtttatcacgggccccacatccttcttgtttcatttgatagatatttgtgaatgtccactgggctcaaggctctgtgatgggtgaacaagacaaagtccctggcctctgtcagctcctgggctagtgggttgacagagaaataaccatctgttgacagctgagtgggattggggctgggacaggggaaatacagggcgttttaggagcttggagaaggcttcctgggagaagtgctatctcagctgagtcatgcagggtgaatgagaggtgaaagtcttgccaagggccatggcagtcccaaactacaggcacccatcactatacccggctaatttttatttttagtagagatggggtttcaccccggtggccaggctgctctcgaactgctgacctcaagtgatccacccgcctcagcctcccgaagcagggattacaggcgtgagccactgtgcccagcgtgattgtaaatgttaatcatgtccacaaataccttcccagcaacaactagagtagcatttgaccaaaagggaccaggcaccaagcctggccgagttgaccgataaaaccatcacagtgagggattggtacccagagacatcacctctcatgctgaaggtctgaccggtaaactgtctgggttccctgtctccagtagtccttctctctcttcggtagctgcatgacatgatgcaggaaacttgaggctgtggtgtttcatgcagagatttttgatacaaggtcttttacctgggggcaagtgcctgttgaagaaatgacattggtgagatgatgaaggaagggaagtcacatgtattgctgcagctgctcccctccgcacacacaacggacttctctaggcctcactgtccttaatgcctctgtcagggatcatgagcaactccatgggtgtggtttgagaatctctggatgaacctacacataggacggtaaaatgtttcatttcacaaaattgctggagggagaaagagagaaaagagagcgatgactatgcaggccggttgtcagttgatgtctccagaatcttcctatttcttttttttctttttcttttttttttttttttttttttttttttttgagacagagtcttgctccgttgcccagactggagtgcagtggtgcaatctcggcttactgcaacctccgcctcctgggttcaagtgattctcctgcctcaacctctctattacctgggattacaggtgcccaccaccacacccagctaatttttttgtattttccgtagagatggcgtttcgccatgttggccaggctggtctcaaacccctgacctcaggtgatctgcctgcctcggccttccaaagtgctgggattgcaggcatgagccaccacacccggctcacatttcttctcataaaagtgtttctggctgggaacagtggctcacgcctataatcccagcactctgggaggctgaggcatgcagatcatgtggagctcaggagttccagaccagcctaggcaacatggcaaaaccccgtctctacaaaaaatacaaaaattagccgggcatggtggctcacgcctgtagtgcaagctgctcaggcgtctgagactggaggatcccttgagcccaggaagcagaggtttcaatgagccgaggttttgccactgcacaccagactaggtaacagagcgagtccctgcctcaaacaaacaaacaaaacagcaaaagaaacgtggggggtgggggtcgtaaggtcttttctctctctgagaattggctttctacatgtagaaatagatcctgagagagtccttgtgacacatgagaattggctgggagataattgggttaagatcattttccaaacgtttcacacattaactgtttgtgtcagatagtggtggcccaaaggatgtcagggaactaactcgtaggaaagatagattgcaatttctgaaaagttaagaactctttctgggatgtgtgtgtgtgtgtgtttatatatgtttgtgttcagtacatattcaaactgttcctgttacggttctgtctttcttgccccagtgtgggctgatagccacgatttggtgaataaacattcagaggaccagtatcctctgaagaaaactagtgaattcttggtttccacgtttgtcaaaagaatagagcctgggaggctgatctaaagtttccatttagcatttaatgtcaatttttggttgcactcatccaagatgtatttatcaaaacagtacagagagatacccttatcgcaaaatatgccgttgggtttttccacttaacctacagcaagattgacttttttccctcaggagtacagttctgtgagctttgacacgggcatacattcttgtcaccaccaccacagtcgggatccagaacagtcccatcaccgcaggacactccctggaactgccccattgcggttaccccttcttcatccatcatccctggtgtaaagtgatctgtttccttccctctagttttgtcttggggagagtgttatgtcaatgacaccatacagtttgtggccttgtgaggcgggcttccttcttttggcccgatgaacatctcggatgagtgtcagatgcctctgtcacaggctgttgttttttcatgaaggcagtttcacggtgtggaagaccacaggtgttcagccatccttctactgaatgacattttcctctgtccagtgtggggcagtttcgcatcgagctgcttttacaattcagtgcgggcttttttgtgaacctaagttttcatttctctagggtagatacccaggagtgggatggctgggtcctatggtaaacatctgtttgacttacaagaaactgccaaactgcttctcaaagttgctgtgctatttcgccctcccagctgcaaagtgtgagagttccagtcacccaacatgttctcgcttggccttgccagtctccatggtgttaatttgcattcccctaatgctgaatgatgttaaatatggtttcttgcgctcccattcaagtctttcccccattttctagttggggtgttgattttcttattgtggagttttgaaaacgcgccatgtgttttggatataagatctgtcaggttggtgattctcaaacatttcctcctagtggtgcagctttgattttcattctctgaacacactggctcttacacagccaaagttgtgttgtattgtattgtgttgtattgtgttgtattgtattgtattgtatcgtatcgtatcgtatagtatcgtatagtatcgtatcgtatcctattctattctatctatcctattctattctgttctattctgttctatttatttatttagagacaggggctcgctatgtcgcccagactggagggcagtggctcgatctcggctcactgcagcctctgcctcctgggtcgagcaattctcctgcctcagcctccccagtagctggggactacaggtatgtcccaccatgccaggtaatttttgtattttttggtagagacagggtttcaccatgttggccaggctggtctcgaacaactgaactctagtgatctgcccaccttggcctcccgaagtgttgggattacaggcaggagccaccacgcccggccagagccagagttttaaattttgccaaactcctatccatccatctttcctttccatggatcatgcatctcaggtcatgtcctagcctcccctcacaaagatgtcctcctacggtttctaccaaaagtcatagtattgaactttggcgtgtaggtctctgaaccctttttccttaattgcgtgtaaaggttgaggttgaggtgcatctttttgcgtaaggataggccacctcatgtattgaaaagcttatcccttctccattggattccctctcacacccatgtcaaaactcactggacacatttctatggatggattcatggactctattttattccatggatctactcgtctacccctgtaagccagcaatctcgattattacagctttagagcaaatctgaaaatctgataatatcatctctctaaaataccttctgctttttgaaacatcagatattccacgtgaattgtagaatctgcttgtttatgcatgcaaatgtccctcaaggattctgattggcaggcactgcattcattctacagatcaagttggggacaatggactgttaacttttttgggtctttaaatatgggaacacattgtttctctccatttaactaaatcttctttgattttttcattaccgtttaatagttttgggcatacagaccccgtccacgtattttagctttatacataaccattgcattgtgtttgtagcttttgtaaaacagtattatttcttaaatttaggtttccagttacgcataggattgttttccgtgtgttgagtttctctcctgtattgctgctaagctctcattaatgagcactaagctcttattagctctgagagtctgggggagatacactggttgtttcatgtagacgatcacaggacccatgaaaaggagtactttggtttcttgctttctccggtgtgtgccgtgattcttctggcattatagcactgactgggcctcagcgtgacgttgaatagctgtggtgagagtggacgtccttgcctggttcgcatccttaggcagaaagcatccagtcgttgaccattaagtggcttgttagttgtaggtttgactgtacacgccctttttcaggttgaggaagttgtcttgtgttcctagtgtgctagagcttttatatcaccagtggactttgaatcttatcaaagggtttttctgcatagcttgatgtgatcctgtcatttttgttcttcatctgatctctcaatctgtgggttacattgattgattttcaggtgtgggaagaacaacccttgcattcccgctataaaacccacttgatcgtggcttattattcttctcacatattgctcaattcaaactgcaaggttttgttgaatactttggtgcctgtactaggaaagaatactggtctgtccttttcttggtatccctgtggtgctggcctcataaaatcagtggggcgcattccctctgctttgtttcctagaagaagttgtgtaagttggtgatatttcttcattaaacgtttggtagacttggccagtgaaactgtcttggcccagagatctttttgcaaatgtgtttgcctgtgaattcaacttctttaaaacatataggactgtgcacacagttcagtgtttgaaatccatcctgtgtgagtttccgtagcttgtggttttcaagtatgtgctacatttcctctgacctgtggaatgtgaatctgtagagttgcgtgtattcttaccatattgacccttttatgttttctgggtctggagtgaaatctcttcttgcattcctgatattggtaacttgtttctttgccctcttttttcccagccagtcctgccacgggtgtatcaatttcattgatcacttcaaagaaccagcttttttttttttttttttcctggattaattgaattcatctatgtgtttttctgtttgaagtctcctgggggtttatgcttctgttgtttagcaaaataaattcttatccacactaggaatttggaaacgatttccataggcatgagcagccttttcgactagatgcaaacccagtggtcaggaaggcgaacatacaaaagggtgtgtccccatggtgcaaacgcttacagttgagtaaaagtctcccttgtgagtggatgaaaatgaacgctcatgggcagagcacctgtgagtcacacattgattattctacaaatgatgcttgggaaggggttggaaaatgtcagcagggaattgacatcgtcgaactgcattgcatccttttgcaccccgtgtcacgtggatgcattaattggtatcatttgtaaatcctttattagatggcattaatattctaagctggtgagatgtatgatctcacgtcatcctcagaagaagcctaggacagggtctctctataatccccattctacacacaggaagtggagggacagagaggttgagtaagatgaataattctgtgttttcttgtcttatcaccttgcgttgcagtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttc

SEQ ID NO: 4585 - DNA, 3691 bp, human
cacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggttcagtttctcagcggcgtcgcatccctgtgacgtgagcacatcctcgccggcgcccccttccgcgctgcggcgcctctagcccgccggagggcggctcctctcgatggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggtgagtctaggcaagctccattctcgccagagcggacttgctccttgtcttcctcttgctgctctggccactcttcttggtccctcccctgttccctccccggactcccggttgtactcccgctgcttttctgtgtactcacctgctgggagacccctgatgccagcaccacgcttcactgctgtcttcattttcttctttctttcttgaaagtgggcattgctggctttactgactacctgttcttttgttacaaagctgctaaaaattgtatctcttccgctccagacccagtaggatagagatgatctgtgtaggcatcaaaaatgtagaacatctgcaagtcatgtgtaggacagactctttcctcaatctgtgtggcgttgcgtggctaggagttagattcctttgccatgacatggcacaagactaggagcacggttttcagcacccagagaacttgcacagaccttagacattttgctgtaggattttgccacttctagaaaaaagtccatgtggccgggcgtggtggctcacgcctgtaatctcagcactttgggaagccgacgtgggcagatcacaaggtcaggagttcgcggccagcctggccaccgtggtgaaaccctgtctctactaaaaatacaaatgtgagccgggtgtggtggcgggtgcttgtaatcccagctactccggaggctgaggcaggagaattgctttaaaccaggagacggaggttgcagtgagctgagatcatgccactgcactccagcctgggcgacacagtgagactgtctcaaaaaaaaaaaaaaaagtccatatttaattgggattattaaatgaaatctgtatctttaaactgaaataaatgcattttattatctcatattattgtggaagattgaaaaaagcatcacatgggactggcttaattttgaaaagaaacacaaagctcttcctggcgctcatctgcagggtgtagtctggattcacttgcttagctgttctctttctccttccgcacaggagaattgaagcgaatgagagtggggagtgtgagaggtgcgtttggtgcagcatttctggcatgggaacagaactggccaggaggaagtgacg

SEQ ID NO: 4586 - DNA, 8971 bp, human; identical to SEQ ID NO: 4583

SEQ ID NO: 4587 - DNA, 11265 bp, human
atggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggtgagtctaggcaagctccattctcgccagagcggacttgctccttgtcttcctcttgctgctctggccactcttcttggtccctcccctgttccctccccggactcccggttgtactcccgctgcttttctgtgtactcacctgctgggagacccctgatgccagcaccacgcttcactgctgtcttcattttcttctttctttcttgaaagtgggcattgctggctttactgactacctgttcttttgttacaaagctgctaaaaattgtatctcttccgctccagacccagtaggatagagatgatctgtgtaggcatcaaaaatgtagaacatctgcaagtcatgtgtaggacagactctttcctcaatctgtgtggcgttgcgtggctaggagttagattcctttgccatgacatggcacaagactaggagcacggttttcagcacccagagaacttgcacagaccttagacattttgctgtaggattttgccacttctagaaaaaagtccatgtggccgggcgtggtggctcacgcctgtaatctcagcactttgggaagccgacgtgggcagatcacaaggtcaggagttcgcggccagcctggccaccgtggtgaaaccctgtctctactaaaaatacaaatgtgagccgggtgtggtggcgggtgcttgtaatcccagctactccggaggctgaggcaggagaattgctttaaaccaggagacggaggttgcagtgagctgagatcatgccactgcactccagcctgggcgacacagtgagactgtctcaaaaaaaaaaaaaaaagtccatatttaattgggattattaaatgaaatctgtatctttaaactgaaataaatgcattttattatctcatattattgtggaagattgaaaaaagcatcacatgggactggcttaattttgaaaagaaacacaaagctcttcctggcgctcatctgcagggtgtagtctggattcacttgcttagctgttctctttctccttccgcacaggagaattgaagcgaatgagagtggggagtgtgagaggtgcgtttggtgcagcatttctggcatgggaacagaactggccaggaggaagtgacggtaaggattcgcagcattgcacccgatccccgggcagctgtggacatgcgggtcagcccctaggactctgctgtctgaactcttccctcaggattactttctcgcttaggtatcaggggaggctgaacacccagagaggcaatgccaccaggggtgtgttcatctgcagtcagggagacctgggagggaattctgtccctgagtggttgtgtgatctgagggaagttacttgacctctccatgcaggaatttctgcctttgcaacgtgggaaaatatggattctgcagggttgacttgacattctcagtgagatgtttatcacgggccccacatccttcttgtttcatttgatagatatttgtgaatgtccactgggctcaaggctctgtgatgggtgaacaagacaaagtccctggcctctgtcagctcctgggctagtgggttgacagagaaataaccatctgttgacagctgagtgggattggggctgggacaggggaaatacagggcgttttaggagcttggagaaggcttcctgggagaagtgctatctcagctgagtcatgcagggtgaatgagaggtgaaagtcttgccaagggccatggcagtcccaaactacaggcacccatcactatacccggctaatttttatttttagtagagatggggtttcaccccggtggccaggctgctctcgaactgctgacctcaagtgatccacccgcctcagcctcccgaagcagggattacaggcgtgagccactgtgcccagcgtgattgtaaatgttaatcatgtccacaaataccttcccagcaacaactagagtagcatttgaccaaaagggaccaggcaccaagcctggccgagttgaccgataaaaccatcacagtgagggattggtacccagagacatcacctctcatgctgaaggtctgaccggtaaactgtctgggttccctgtctccagtagtccttctctctcttcggtagctgcatgacatgatgcaggaaacttgaggctgtggtgtttcatgcagagatttttgatacaaggtcttttacctgggggcaagtgcctgttgaagaaatgacattggtgagatgatgaaggaagggaagtcacatgtattgctgcagctgctcccctccgcacacacaacggacttctctaggcctcactgtccttaatgcctctgtcagggatcatgagcaactccatgggtgtggtttgagaatctctggatgaacctacacataggacggtaaaatgtttcatttcacaaaattgctggagggagaaagagagaaaagagagcgatgactatgcaggccggttgtcagttgatgtctccagaatcttcctatttcttttttttctttttcttttttttttttttttttttttttttttttgagacagagtcttgctccgttgcccagactggagtgcagtggtgcaatctcggcttactgcaacctccgcctcctgggttcaagtgattctcctgcctcaacctctctattacctgggattacaggtgcccaccaccacacccagctaatttttttgtattttccgtagagatggcgtttcgccatgttggccaggctggtctcaaacccctgacctcaggtgatctgcctgcctcggccttccaaagtgctgggattgcaggcatgagccaccacacccggctcacatttcttctcataaaagtgtttctggctgggaacagtggctcacgcctataatcccagcactctgggaggctgaggcatgcagatcatgtggagctcaggagttccagaccagcctaggcaacatggcaaaaccccgtctctacaaaaaatacaaaaattagccgggcatggtggctcacgcctgtagtgcaagctgctcaggcgtctgagactggaggatcccttgagcccaggaagcagaggtttcaatgagccgaggttttgccactgcacaccagactaggtaacagagcgagtccctgcctcaaacaaacaaacaaaacagcaaaagaaacgtggggggtgggggtcgtaaggtcttttctctctctgagaattggctttctacatgtagaaatagatcctgagagagtccttgtgacacatgagaattggctgggagataattgggttaagatcattttccaaacgtttcacacattaactgtttgtgtcagatagtggtggcccaaaggatgtcagggaactaactcgtaggaaagatagattgcaatttctgaaaagttaagaactctttctgggatgtgtgtgtgtgtgtgtttatatatgtttgtgttcagtacatattcaaactgttcctgttacggttctgtctttcttgccccagtgtgggctgatagccacgatttggtgaataaacattcagaggaccagtatcctctgaagaaaactagtgaattcttggtttccacgtttgtcaaaagaatagagcctgggaggctgatctaaagtttccatttagcatttaatgtcaatttttggttgcactcatccaagatgtatttatcaaaacagtacagagagatacccttatcgcaaaatatgccgttgggtttttccacttaacctacagcaagattgacttttttccctcaggagtacagttctgtgagctttgacacgggcatacattcttgtcaccaccaccacagtcgggatccagaacagtcccatcaccgcaggacactccctggaactgccccattgcggttaccccttcttcatccatcatccctggtgtaaagtgatctgtttccttccctctagttttgtcttggggagagtgttatgtcaatgacaccatacagtttgtggccttgtgaggcgggcttccttcttttggcccgatgaacatctcggatgagtgtcagatgcctctgtcacaggctgttgttttttcatgaaggcagtttcacggtgtggaagaccacaggtgttcagccatccttctactgaatgacattttcctctgtccagtgtggggcagtttcgcatcgagctgcttttacaattcagtgcgggcttttttgtgaacctaagttttcatttctctagggtagatacccaggagtgggatggctgggtcctatggtaaacatctgtttgacttacaagaaactgccaaactgcttctcaaagttgctgtgctatttcgccctcccagctgcaaagtgtgagagttccagtcacccaacatgttctcgcttggccttgccagtctccatggtgttaatttgcattcccctaatgctgaatgatgttaaatatggtttcttgcgctcccattcaagtctttcccccattttctagttggggtgttgattttcttattgtggagttttgaaaacgcgccatgtgttttggatataagatctgtcaggttggtgattctcaaacatttcctcctagtggtgcagctttgattttcattctctgaacacactggctcttacacagccaaagttgtgttgtattgtattgtgttgtattgtgttgtattgtattgtattgtatcgtatcgtatcgtatagtatcgtatagtatcgtatcgtatcctattctattctatctatcctattctattctgttctattctgttctatttatttatttagagacaggggctcgctatgtcgcccagactggagggcagtggctcgatctcggctcactgcagcctctgcctcctgggtcgagcaattctcctgcctcagcctccccagtagctggggactacaggtatgtcccaccatgccaggtaatttttgtattttttggtagagacagggtttcaccatgttggccaggctggtctcgaacaactgaactctagtgatctgcccaccttggcctcccgaagtgttgggattacaggcaggagccaccacgcccggccagagccagagttttaaattttgccaaactcctatccatccatctttcctttccatggatcatgcatctcaggtcatgtcctagcctcccctcacaaagatgtcctcctacggtttctaccaaaagtcatagtattgaactttggcgtgtaggtctctgaaccctttttccttaattgcgtgtaaaggttgaggttgaggtgcatctttttgcgtaaggataggccacctcatgtattgaaaagcttatcccttctccattggattccctctcacacccatgtcaaaactcactggacacatttctatggatggattcatggactctattttattccatggatctactcgtctacccctgtaagccagcaatctcgattattacagctttagagcaaatctgaaaatctgataatatcatctctctaaaataccttctgctttttgaaacatcagatattccacgtgaattgtagaatctgcttgtttatgcatgcaaatgtccctcaaggattctgattggcaggcactgcattcattctacagatcaagttggggacaatggactgttaacttttttgggtctttaaatatgggaacacattgtttctctccatttaactaaatcttctttgattttttcattaccgtttaatagttttgggcatacagaccccgtccacgtattttagctttatacataaccattgcattgtgtttgtagcttttgtaaaacagtattatttcttaaatttaggtttccagttacgcataggattgttttccgtgtgttgagtttctctcctgtattgctgctaagctctcattaatgagcactaagctcttattagctctgagagtctgggggagatacactggttgtttcatgtagacgatcacaggacccatgaaaaggagtactttggtttcttgctttctccggtgtgtgccgtgattcttctggcattatagcactgactgggcctcagcgtgacgttgaatagctgtggtgagagtggacgtccttgcctggttcgcatccttaggcagaaagcatccagtcgttgaccattaagtggcttgttagttgtaggtttgactgtacacgccctttttcaggttgaggaagttgtcttgtgttcctagtgtgctagagcttttatatcaccagtggactttgaatcttatcaaagggtttttctgcatagcttgatgtgatcctgtcatttttgttcttcatctgatctctcaatctgtgggttacattgattgattttcaggtgtgggaagaacaacccttgcattcccgctataaaacccacttgatcgtggcttattattcttctcacatattgctcaattcaaactgcaaggttttgttgaatactttggtgcctgtactaggaaagaatactggtctgtccttttcttggtatccctgtggtgctggcctcataaaatcagtggggcgcattccctctgctttgtttcctagaagaagttgtgtaagttggtgatatttcttcattaaacgtttggtagacttggccagtgaaactgtcttggcccagagatctttttgcaaatgtgtttgcctgtgaattcaacttctttaaaacatataggactgtgcacacagttcagtgtttgaaatccatcctgtgtgagtttccgtagcttgtggttttcaagtatgtgctacatttcctctgacctgtggaatgtgaatctgtagagttgcgtgtattcttaccatattgacccttttatgttttctgggtctggagtgaaatctcttcttgcattcctgatattggtaacttgtttctttgccctcttttttcccagccagtcctgccacgggtgtatcaatttcattgatcacttcaaagaaccagcttttttttttttttttttcctggattaattgaattcatctatgtgtttttctgtttgaagtctcctgggggtttatgcttctgttgtttagcaaaataaattcttatccacactaggaatttggaaacgatttccataggcatgagcagccttttcgactagatgcaaacccagtggtcaggaaggcgaacatacaaaagggtgtgtccccatggtgcaaacgcttacagttgagtaaaagtctcccttgtgagtggatgaaaatgaacgctcatgggcagagcacctgtgagtcacacattgattattctacaaatgatgcttgggaaggggttggaaaatgtcagcagggaattgacatcgtcgaactgcattgcatccttttgcaccccgtgtcacgtggatgcattaattggtatcatttgtaaatcctttattagatggcattaatattctaagctggtgagatgtatgatctcacgtcatcctcagaagaagcctaggacagggtctctctataatccccattctacacacaggaagtggagggacagagaggttgagtaagatgaataattctgtgttttcttgtcttatcaccttgcgttgcagtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaaa

SEQ ID NO: 4588 - DNA, 16753 bp, human; identical to SEQ ID NO: 4584

SEQ ID NO: 4589 - DNA, 11211 bp, human
cggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggtgagtctaggcaagctccattctcgccagagcggacttgctccttgtcttcctcttgctgctctggccactcttcttggtccctcccctgttccctccccggactcccggttgtactcccgctgcttttctgtgtactcacctgctgggagacccctgatgccagcaccacgcttcactgctgtcttcattttcttctttctttcttgaaagtgggcattgctggctttactgactacctgttcttttgttacaaagctgctaaaaattgtatctcttccgctccagacccagtaggatagagatgatctgtgtaggcatcaaaaatgtagaacatctgcaagtcatgtgtaggacagactctttcctcaatctgtgtggcgttgcgtggctaggagttagattcctttgccatgacatggcacaagactaggagcacggttttcagcacccagagaacttgcacagaccttagacattttgctgtaggattttgccacttctagaaaaaagtccatgtggccgggcgtggtggctcacgcctgtaatctcagcactttgggaagccgacgtgggcagatcacaaggtcaggagttcgcggccagcctggccaccgtggtgaaaccctgtctctactaaaaatacaaatgtgagccgggtgtggtggcgggtgcttgtaatcccagctactccggaggctgaggcaggagaattgctttaaaccaggagacggaggttgcagtgagctgagatcatgccactgcactccagcctgggcgacacagtgagactgtctcaaaaaaaaaaaaaaaagtccatatttaattgggattattaaatgaaatctgtatctttaaactgaaataaatgcattttattatctcatattattgtggaagattgaaaaaagcatcacatgggactggcttaattttgaaaagaaacacaaagctcttcctggcgctcatctgcagggtgtagtctggattcacttgcttagctgttctctttctccttccgcacaggagaattgaagcgaatgagagtggggagtgtgagaggtgcgtttggtgcagcatttctggcatgggaacagaactggccaggaggaagtgacggtaaggattcgcagcattgcacccgatccccgggcagctgtggacatgcgggtcagcccctaggactctgctgtctgaactcttccctcaggattactttctcgcttaggtatcaggggaggctgaacacccagagaggcaatgccaccaggggtgtgttcatctgcagtcagggagacctgggagggaattctgtccctgagtggttgtgtgatctgagggaagttacttgacctctccatgcaggaatttctgcctttgcaacgtgggaaaatatggattctgcagggttgacttgacattctcagtgagatgtttatcacgggccccacatccttcttgtttcatttgatagatatttgtgaatgtccactgggctcaaggctctgtgatgggtgaacaagacaaagtccctggcctctgtcagctcctgggctagtgggttgacagagaaataaccatctgttgacagctgagtgggattggggctgggacaggggaaatacagggcgttttaggagcttggagaaggcttcctgggagaagtgctatctcagctgagtcatgcagggtgaatgagaggtgaaagtcttgccaagggccatggcagtcccaaactacaggcacccatcactatacccggctaatttttatttttagtagagatggggtttcaccccggtggccaggctgctctcgaactgctgacctcaagtgatccacccgcctcagcctcccgaagcagggattacaggcgtgagccactgtgcccagcgtgattgtaaatgttaatcatgtccacaaataccttcccagcaacaactagagtagcatttgaccaaaagggaccaggcaccaagcctggccgagttgaccgataaaaccatcacagtgagggattggtacccagagacatcacctctcatgctgaaggtctgaccggtaaactgtctgggttccctgtctccagtagtccttctctctcttcggtagctgcatgacatgatgcaggaaacttgaggctgtggtgtttcatgcagagatttttgatacaaggtcttttacctgggggcaagtgcctgttgaagaaatgacattggtgagatgatgaaggaagggaagtcacatgtattgctgcagctgctcccctccgcacacacaacggacttctctaggcctcactgtccttaatgcctctgtcagggatcatgagcaactccatgggtgtggtttgagaatctctggatgaacctacacataggacggtaaaatgtttcatttcacaaaattgctggagggagaaagagagaaaagagagcgatgactatgcaggccggttgtcagttgatgtctccagaatcttcctatttcttttttttctttttcttttttttttttttttttttttttttttttgagacagagtcttgctccgttgcccagactggagtgcagtggtgcaatctcggcttactgcaacctccgcctcctgggttcaagtgattctcctgcctcaacctctctattacctgggattacaggtgcccaccaccacacccagctaatttttttgtattttccgtagagatggcgtttcgccatgttggccaggctggtctcaaacccctgacctcaggtgatctgcctgcctcggccttccaaagtgctgggattgcaggcatgagccaccacacccggctcacatttcttctcataaaagtgtttctggctgggaacagtggctcacgcctataatcccagcactctgggaggctgaggcatgcagatcatgtggagctcaggagttccagaccagcctaggcaacatggcaaaaccccgtctctacaaaaaatacaaaaattagccgggcatggtggctcacgcctgtagtgcaagctgctcaggcgtctgagactggaggatcccttgagcccaggaagcagaggtttcaatgagccgaggttttgccactgcacaccagactaggtaacagagcgagtccctgcctcaaacaaacaaacaaaacagcaaaagaaacgtggggggtgggggtcgtaaggtcttttctctctctgagaattggctttctacatgtagaaatagatcctgagagagtccttgtgacacatgagaattggctgggagataattgggttaagatcattttccaaacgtttcacacattaactgtttgtgtcagatagtggtggcccaaaggatgtcagggaactaactcgtaggaaagatagattgcaatttctgaaaagttaagaactctttctgggatgtgtgtgtgtgtgtgtttatatatgtttgtgttcagtacatattcaaactgttcctgttacggttctgtctttcttgccccagtgtgggctgatagccacgatttggtgaataaacattcagaggaccagtatcctctgaagaaaactagtgaattcttggtttccacgtttgtcaaaagaatagagcctgggaggctgatctaaagtttccatttagcatttaatgtcaatttttggttgcactcatccaagatgtatttatcaaaacagtacagagagatacccttatcgcaaaatatgccgttgggtttttccacttaacctacagcaagattgacttttttccctcaggagtacagttctgtgagctttgacacgggcatacattcttgtcaccaccaccacagtcgggatccagaacagtcccatcaccgcaggacactccctggaactgccccattgcggttaccccttcttcatccatcatccctggtgtaaagtgatctgtttccttccctctagttttgtcttggggagagtgttatgtcaatgacaccatacagtttgtggccttgtgaggcgggcttccttcttttggcccgatgaacatctcggatgagtgtcagatgcctctgtcacaggctgttgttttttcatgaaggcagtttcacggtgtggaagaccacaggtgttcagccatccttctactgaatgacattttcctctgtccagtgtggggcagtttcgcatcgagctgcttttacaattcagtgcgggcttttttgtgaacctaagttttcatttctctagggtagatacccaggagtgggatggctgggtcctatggtaaacatctgtttgacttacaagaaactgccaaactgcttctcaaagttgctgtgctatttcgccctcccagctgcaaagtgtgagagttccagtcacccaacatgttctcgcttggccttgccagtctccatggtgttaatttgcattcccctaatgctgaatgatgttaaatatggtttcttgcgctcccattcaagtctttcccccattttctagttggggtgttgattttcttattgtggagttttgaaaacgcgccatgtgttttggatataagatctgtcaggttggtgattctcaaacatttcctcctagtggtgcagctttgattttcattctctgaacacactggctcttacacagccaaagttgtgttgtattgtattgtgttgtattgtgttgtattgtattgtattgtatcgtatcgtatcgtatagtatcgtatagtatcgtatcgtatcctattctattctatctatcctattctattctgttctattctgttctatttatttatttagagacaggggctcgctatgtcgcccagactggagggcagtggctcgatctcggctcactgcagcctctgcctcctgggtcgagcaattctcctgcctcagcctccccagtagctggggactacaggtatgtcccaccatgccaggtaatttttgtattttttggtagagacagggtttcaccatgttggccaggctggtctcgaacaactgaactctagtgatctgcccaccttggcctcccgaagtgttgggattacaggcaggagccaccacgcccggccagagccagagttttaaattttgccaaactcctatccatccatctttcctttccatggatcatgcatctcaggtcatgtcctagcctcccctcacaaagatgtcctcctacggtttctaccaaaagtcatagtattgaactttggcgtgtaggtctctgaaccctttttccttaattgcgtgtaaaggttgaggttgaggtgcatctttttgcgtaaggataggccacctcatgtattgaaaagcttatcccttctccattggattccctctcacacccatgtcaaaactcactggacacatttctatggatggattcatggactctattttattccatggatctactcgtctacccctgtaagccagcaatctcgattattacagctttagagcaaatctgaaaatctgataatatcatctctctaaaataccttctgctttttgaaacatcagatattccacgtgaattgtagaatctgcttgtttatgcatgcaaatgtccctcaaggattctgattggcaggcactgcattcattctacagatcaagttggggacaatggactgttaacttttttgggtctttaaatatgggaacacattgtttctctccatttaactaaatcttctttgattttttcattaccgtttaatagttttgggcatacagaccccgtccacgtattttagctttatacataaccattgcattgtgtttgtagcttttgtaaaacagtattatttcttaaatttaggtttccagttacgcataggattgttttccgtgtgttgagtttctctcctgtattgctgctaagctctcattaatgagcactaagctcttattagctctgagagtctgggggagatacactggttgtttcatgtagacgatcacaggacccatgaaaaggagtactttggtttcttgctttctccggtgtgtgccgtgattcttctggcattatagcactgactgggcctcagcgtgacgttgaatagctgtggtgagagtggacgtccttgcctggttcgcatccttaggcagaaagcatccagtcgttgaccattaagtggcttgttagttgtaggtttgactgtacacgccctttttcaggttgaggaagttgtcttgtgttcctagtgtgctagagcttttatatcaccagtggactttgaatcttatcaaagggtttttctgcatagcttgatgtgatcctgtcatttttgttcttcatctgatctctcaatctgtgggttacattgattgattttcaggtgtgggaagaacaacccttgcattcccgctataaaacccacttgatcgtggcttattattcttctcacatattgctcaattcaaactgcaaggttttgttgaatactttggtgcctgtactaggaaagaatactggtctgtccttttcttggtatccctgtggtgctggcctcataaaatcagtggggcgcattccctctgctttgtttcctagaagaagttgtgtaagttggtgatatttcttcattaaacgtttggtagacttggccagtgaaactgtcttggcccagagatctttttgcaaatgtgtttgcctgtgaattcaacttctttaaaacatataggactgtgcacacagttcagtgtttgaaatccatcctgtgtgagtttccgtagcttgtggttttcaagtatgtgctacatttcctctgacctgtggaatgtgaatctgtagagttgcgtgtattcttaccatattgacccttttatgttttctgggtctggagtgaaatctcttcttgcattcctgatattggtaacttgtttctttgccctcttttttcccagccagtcctgccacgggtgtatcaatttcattgatcacttcaaagaaccagcttttttttttttttttttcctggattaattgaattcatctatgtgtttttctgtttgaagtctcctgggggtttatgcttctgttgtttagcaaaataaattcttatccacactaggaatttggaaacgatttccataggcatgagcagccttttcgactagatgcaaacccagtggtcaggaaggcgaacatacaaaagggtgtgtccccatggtgcaaacgcttacagttgagtaaaagtctcccttgtgagtggatgaaaatgaacgctcatgggcagagcacctgtgagtcacacattgattattctacaaatgatgcttgggaaggggttggaaaatgtcagcagggaattgacatcgtcgaactgcattgcatccttttgcaccccgtgtcacgtggatgcattaattggtatcatttgtaaatcctttattagatggcattaatattctaagctggtgagatgtatgatctcacgtcatcctcagaagaagcctaggacagggtctctctataatccccattctacacacaggaagtggagggacagagaggttgagtaagatgaataattctgtgttttcttgtcttatcaccttgcgttgcagtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaatacca

SEQ ID NO: 4590 - DNA, 11161 bp, human
agaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggtgagtctaggcaagctccattctcgccagagcggacttgctccttgtcttcctcttgctgctctggccactcttcttggtccctcccctgttccctccccggactcccggttgtactcccgctgcttttctgtgtactcacctgctgggagacccctgatgccagcaccacgcttcactgctgtcttcattttcttctttctttcttgaaagtgggcattgctggctttactgactacctgttcttttgttacaaagctgctaaaaattgtatctcttccgctccagacccagtaggatagagatgatctgtgtaggcatcaaaaatgtagaacatctgcaagtcatgtgtaggacagactctttcctcaatctgtgtggcgttgcgtggctaggagttagattcctttgccatgacatggcacaagactaggagcacggttttcagcacccagagaacttgcacagaccttagacattttgctgtaggattttgccacttctagaaaaaagtccatgtggccgggcgtggtggctcacgcctgtaatctcagcactttgggaagccgacgtgggcagatcacaaggtcaggagttcgcggccagcctggccaccgtggtgaaaccctgtctctactaaaaatacaaatgtgagccgggtgtggtggcgggtgcttgtaatcccagctactccggaggctgaggcaggagaattgctttaaaccaggagacggaggttgcagtgagctgagatcatgccactgcactccagcctgggcgacacagtgagactgtctcaaaaaaaaaaaaaaaagtccatatttaattgggattattaaatgaaatctgtatctttaaactgaaataaatgcattttattatctcatattattgtggaagattgaaaaaagcatcacatgggactggcttaattttgaaaagaaacacaaagctcttcctggcgctcatctgcagggtgtagtctggattcacttgcttagctgttctctttctccttccgcacaggagaattgaagcgaatgagagtggggagtgtgagaggtgcgtttggtgcagcatttctggcatgggaacagaactggccaggaggaagtgacggtaaggattcgcagcattgcacccgatccccgggcagctgtggacatgcgggtcagcccctaggactctgctgtctgaactcttccctcaggattactttctcgcttaggtatcaggggaggctgaacacccagagaggcaatgccaccaggggtgtgttcatctgcagtcagggagacctgggagggaattctgtccctgagtggttgtgtgatctgagggaagttacttgacctctccatgcaggaatttctgcctttgcaacgtgggaaaatatggattctgcagggttgacttgacattctcagtgagatgtttatcacgggccccacatccttcttgtttcatttgatagatatttgtgaatgtccactgggctcaaggctctgtgatgggtgaacaagacaaagtccctggcctctgtcagctcctgggctagtgggttgacagagaaataaccatctgttgacagctgagtgggattggggctgggacaggggaaatacagggcgttttaggagcttggagaaggcttcctgggagaagtgctatctcagctgagtcatgcagggtgaatgagaggtgaaagtcttgccaagggccatggcagtcccaaactacaggcacccatcactatacccggctaatttttatttttagtagagatggggtttcaccccggtggccaggctgctctcgaactgctgacctcaagtgatccacccgcctcagcctcccgaagcagggattacaggcgtgagccactgtgcccagcgtgattgtaaatgttaatcatgtccacaaataccttcccagcaacaactagagtagcatttgaccaaaagggaccaggcaccaagcctggccgagttgaccgataaaaccatcacagtgagggattggtacccagagacatcacctctcatgctgaaggtctgaccggtaaactgtctgggttccctgtctccagtagtccttctctctcttcggtagctgcatgacatgatgcaggaaacttgaggctgtggtgtttcatgcagagatttttgatacaaggtcttttacctgggggcaagtgcctgttgaagaaatgacattggtgagatgatgaaggaagggaagtcacatgtattgctgcagctgctcccctccgcacacacaacggacttctctaggcctcactgtccttaatgcctctgtcagggatcatgagcaactccatgggtgtggtttgagaatctctggatgaacctacacataggacggtaaaatgtttcatttcacaaaattgctggagggagaaagagagaaaagagagcgatgactatgcaggccggttgtcagttgatgtctccagaatcttcctatttcttttttttctttttcttttttttttttttttttttttttttttttgagacagagtcttgctccgttgcccagactggagtgcagtggtgcaatctcggcttactgcaacctccgcctcctgggttcaagtgattctcctgcctcaacctctctattacctgggattacaggtgcccaccaccacacccagctaatttttttgtattttccgtagagatggcgtttcgccatgttggccaggctggtctcaaacccctgacctcaggtgatctgcctgcctcggccttccaaagtgctgggattgcaggcatgagccaccacacccggctcacatttcttctcataaaagtgtttctggctgggaacagtggctcacgcctataatcccagcactctgggaggctgaggcatgcagatcatgtggagctcaggagttccagaccagcctaggcaacatggcaaaaccccgtctctacaaaaaatacaaaaattagccgggcatggtggctcacgcctgtagtgcaagctgctcaggcgtctgagactggaggatcccttgagcccaggaagcagaggtttcaatgagccgaggttttgccactgcacaccagactaggtaacagagcgagtccctgcctcaaacaaacaaacaaaacagcaaaagaaacgtggggggtgggggtcgtaaggtcttttctctctctgagaattggctttctacatgtagaaatagatcctgagagagtccttgtgacacatgagaattggctgggagataattgggttaagatcattttccaaacgtttcacacattaactgtttgtgtcagatagtggtggcccaaaggatgtcagggaactaactcgtaggaaagatagattgcaatttctgaaaagttaagaactctttctgggatgtgtgtgtgtgtgtgtttatatatgtttgtgttcagtacatattcaaactgttcctgttacggttctgtctttcttgccccagtgtgggctgatagccacgatttggtgaataaacattcagaggaccagtatcctctgaagaaaactagtgaattcttggtttccacgtttgtcaaaagaatagagcctgggaggctgatctaaagtttccatttagcatttaatgtcaatttttggttgcactcatccaagatgtatttatcaaaacagtacagagagatacccttatcgcaaaatatgccgttgggtttttccacttaacctacagcaagattgacttttttccctcaggagtacagttctgtgagctttgacacgggcatacattcttgtcaccaccaccacagtcgggatccagaacagtcccatcaccgcaggacactccctggaactgccccattgcggttaccccttcttcatccatcatccctggtgtaaagtgatctgtttccttccctctagttttgtcttggggagagtgttatgtcaatgacaccatacagtttgtggccttgtgaggcgggcttccttcttttggcccgatgaacatctcggatgagtgtcagatgcctctgtcacaggctgttgttttttcatgaaggcagtttcacggtgtggaagaccacaggtgttcagccatccttctactgaatgacattttcctctgtccagtgtggggcagtttcgcatcgagctgcttttacaattcagtgcgggcttttttgtgaacctaagttttcatttctctagggtagatacccaggagtgggatggctgggtcctatggtaaacatctgtttgacttacaagaaactgccaaactgcttctcaaagttgctgtgctatttcgccctcccagctgcaaagtgtgagagttccagtcacccaacatgttctcgcttggccttgccagtctccatggtgttaatttgcattcccctaatgctgaatgatgttaaatatggtttcttgcgctcccattcaagtctttcccccattttctagttggggtgttgattttcttattgtggagttttgaaaacgcgccatgtgttttggatataagatctgtcaggttggtgattctcaaacatttcctcctagtggtgcagctttgattttcattctctgaacacactggctcttacacagccaaagttgtgttgtattgtattgtgttgtattgtgttgtattgtattgtattgtatcgtatcgtatcgtatagtatcgtatagtatcgtatcgtatcctattctattctatctatcctattctattctgttctattctgttctatttatttatttagagacaggggctcgctatgtcgcccagactggagggcagtggctcgatctcggctcactgcagcctctgcctcctgggtcgagcaattctcctgcctcagcctccccagtagctggggactacaggtatgtcccaccatgccaggtaatttttgtattttttggtagagacagggtttcaccatgttggccaggctggtctcgaacaactgaactctagtgatctgcccaccttggcctcccgaagtgttgggattacaggcaggagccaccacgcccggccagagccagagttttaaattttgccaaactcctatccatccatctttcctttccatggatcatgcatctcaggtcatgtcctagcctcccctcacaaagatgtcctcctacggtttctaccaaaagtcatagtattgaactttggcgtgtaggtctctgaaccctttttccttaattgcgtgtaaaggttgaggttgaggtgcatctttttgcgtaaggataggccacctcatgtattgaaaagcttatcccttctccattggattccctctcacacccatgtcaaaactcactggacacatttctatggatggattcatggactctattttattccatggatctactcgtctacccctgtaagccagcaatctcgattattacagctttagagcaaatctgaaaatctgataatatcatctctctaaaataccttctgctttttgaaacatcagatattccacgtgaattgtagaatctgcttgtttatgcatgcaaatgtccctcaaggattctgattggcaggcactgcattcattctacagatcaagttggggacaatggactgttaacttttttgggtctttaaatatgggaacacattgtttctctccatttaactaaatcttctttgattttttcattaccgtttaatagttttgggcatacagaccccgtccacgtattttagctttatacataaccattgcattgtgtttgtagcttttgtaaaacagtattatttcttaaatttaggtttccagttacgcataggattgttttccgtgtgttgagtttctctcctgtattgctgctaagctctcattaatgagcactaagctcttattagctctgagagtctgggggagatacactggttgtttcatgtagacgatcacaggacccatgaaaaggagtactttggtttcttgctttctccggtgtgtgccgtgattcttctggcattatagcactgactgggcctcagcgtgacgttgaatagctgtggtgagagtggacgtccttgcctggttcgcatccttaggcagaaagcatccagtcgttgaccattaagtggcttgttagttgtaggtttgactgtacacgccctttttcaggttgaggaagttgtcttgtgttcctagtgtgctagagcttttatatcaccagtggactttgaatcttatcaaagggtttttctgcatagcttgatgtgatcctgtcatttttgttcttcatctgatctctcaatctgtgggttacattgattgattttcaggtgtgggaagaacaacccttgcattcccgctataaaacccacttgatcgtggcttattattcttctcacatattgctcaattcaaactgcaaggttttgttgaatactttggtgcctgtactaggaaagaatactggtctgtccttttcttggtatccctgtggtgctggcctcataaaatcagtggggcgcattccctctgctttgtttcctagaagaagttgtgtaagttggtgatatttcttcattaaacgtttggtagacttggccagtgaaactgtcttggcccagagatctttttgcaaatgtgtttgcctgtgaattcaacttctttaaaacatataggactgtgcacacagttcagtgtttgaaatccatcctgtgtgagtttccgtagcttgtggttttcaagtatgtgctacatttcctctgacctgtggaatgtgaatctgtagagttgcgtgtattcttaccatattgacccttttatgttttctgggtctggagtgaaatctcttcttgcattcctgatattggtaacttgtttctttgccctcttttttcccagccagtcctgccacgggtgtatcaatttcattgatcacttcaaagaaccagcttttttttttttttttttcctggattaattgaattcatctatgtgtttttctgtttgaagtctcctgggggtttatgcttctgttgtttagcaaaataaattcttatccacactaggaatttggaaacgatttccataggcatgagcagccttttcgactagatgcaaacccagtggtcaggaaggcgaacatacaaaagggtgtgtccccatggtgcaaacgcttacagttgagtaaaagtctcccttgtgagtggatgaaaatgaacgctcatgggcagagcacctgtgagtcacacattgattattctacaaatgatgcttgggaaggggttggaaaatgtcagcagggaattgacatcgtcgaactgcattgcatccttttgcaccccgtgtcacgtggatgcattaattggtatcatttgtaaatcctttattagatggcattaatattctaagctggtgagatgtatgatctcacgtcatcctcagaagaagcctaggacagggtctctctataatccccattctacacacaggaagtggagggacagagaggttgagtaagatgaataattctgtgttttcttgtcttatcaccttgcgttgcagtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaaa

SEQ ID NO: 4591 - DNA, 47172 bp, human; identical to SEQ ID NO: 3408

SEQ ID NO: 4592 - DNA, 8218 bp, human
actttggaaaagctttggccgagaggaagggtccattcagatggttggggagtggggcttagaattttatatttagtttacaaagatgatgggggctgtgttaaaaagaaaaaatatacagatcacagtacagggattgggaattgggggaggcactgggttagctgcaggtaaattataacagagtgactagggtaggctgggttgagaaggtgacaatttgacaaagatgtgaagggggaggagtcagtcaagcagatatctgtggtgaaggccttccagacagagggagcagttggaaaaaagtcagaggctgagtcgttccaacatggcgcagatgccacaaggacactagcacaccagcaggaagctgaacagaaggctggaggtgccacggtgacaaggacgggatcctgtcaggccaggtaagcttctgctctgccagtgacacggaaagggacaatgaagggccacagatacagaaagcatgtctgtgcagcctgcagagttcaggtgaaggagggacccaggcaggagcagtcagaaccaggagggcttaggcaagagacaggacaggcaaaggcactgatgcagcccacccagacttgacagacgcgttcatccaggtgttcatgtccttgtcactgtggacatctgtgttgcagccacagaaccacatactcgattaggacgcctgaacccaatcaatagtcgtttttccctacagaccctgggggaggcccacatgcacttgccctagggtactctgacattttggcactgcagtcccactgggaggccacatggagtaacatactggccaagacatatttaaaaattctggcagggtgcggtggctcacacctgtaatcccaggacttggggagggcaaggcaggcagatcacttgaggtcaggagttcaagaacagcctggccaatatggtgaagccccatttctactaaaaatccaaaaaaaaaataatcccgggtgcagtgacgcacacctgtaatcccagctacttgggtggctgaggcacaagaatcacttgatcccaggaggtggaggatgcagtgagctgagattgtgccactgcactccagcctgggtgacagagctagtctctatctaaaataaacaaataattttgtagcctcttttactaggagttctggaattagggaagagaggaaaggtacaaccctcctcccgaactccaggggaggagaatctcattgcacagatgtcctctgttcactcgattctcctggagcatttctaaggcacacagagctgctaccatcatagccattactgaccaagtactctgggtgaaattcctttattaactgaataaacttgttctgaagtgctgaccggacactctggggacagggggaggtttcggctgtatccttgctggcagatgacccccacacttggggggtaaggagagccatggcagaattcaacccacggtcccctaggagtacacaggagaccaccctaccctcacctgagggatgtgtgtgtgcaagggttgggtcagggcagactcttcagaagaggggaggtttgtgcggcaggcactttgattctgcacagcttacagtccagagagccgaagaacaagaggaactagattcccattctcagtctgttgatttccacaccacatttggagtctgatcaactccacagctgtgttgcagccgctaacgctgcctctgctctgtttgcctctagattcttcttatctgttaaataaagtgaggctgatggagatgtaatttagggcgggggtggattgcaagtgtctctgtgatagggcaaagcgcctcccggtggaggcgcagaagctaaactcgactggtagctgtgaggcaagggacgccagggcagctcctgtggactgtgttagaacttttcagggtggctttgccctgccaggggcctggatctcacagggggacgtcgtgttaggaccaagctgactgtcccatcacagaataatatctgcagctcagcatggggagcataagcaaagtacgttgtcgtgagtttaaagaggcctggctttggagtctgacagaacccgcgtgtgagtcccagatccagccttttctgcctcagtgccctgacctctttcagcttggttccttatctgtagatgggagtttgatacttacctctctgggtctttgggaaatcaacactgtacatgagtagcacacagtaggtcctcaacaaccaggctccagggagagagagccattcacactgtgccatgttagaggcacatcagtgtgcaggccagcgtgccaggacagtgggagtccagtctaccctccagccagggtttgggcttgggctgatggtggcaggaccagggccatttccatcttttctcttttattgtccatatgtccaaagcagacacttccattcatattcaggtgtgcaatgctaggagctgaaataacaggctgtagtgaatgaagcgaagcctcacagttcactctatggcaggaagaaccagctgtgaggcaggtcctcagcccacatcacttcatggtactgaacctggggccacaattccaaactccatgttcacacatgatgagtctataggaatgaaggagagatctatgttgtgtatctttattattatgttttattgtatatatttaaggtataaaacatgttgttatacacacacacacacacacagtgaaataattgctacagtcaggcaaatgaacctgtcaccttcctcagttaccttcctgcatcctatttttgcaagtaaacttttcctaaaaaccctactctcacgtgacattccagttggttggcccattgggggaattttcatgaatctccatcatgtgctattcagtaaaaatatcaaacccactaagcatgccttttcatccagttgctccctaggtaaagtataatttgctctccttcacttgagagctgaaggtaaggagcaatcaggcagcggttgatggagcaagtgcaggccagacagagggaagggcggttgtgaggcggcagacacgagagagagacagcgagagagcgagcgtgcacgctagacagagagaggcctggtagtagctggggcctgatacccctaatccaggaggctggactttatcctaagggcagcaggcagccctagtagaatttgaaaaggtttgacatgaccagattagcagtcaagaaaggtgccccactcactgggacagagaatgcgtgggaaggggtcaagactggcagcaagatgagctatgaattgttggtggtcatcgaggagggagatgagggtgactggactagggaacttcctgtggtgatggagaggagtcagtgtcaaggtctcacttagaaaaacttgggaggtctaactggccaggctcggtcaactgtgggggtggtaagaggcagcaatcaaggatggctttcaagatctttggcccaagctgctgggtagagggtggtgcctgtcactgagtcaggcagcacaggaggaggggcaggcgtgctgagtggggatgggtgcgttcactttgggacatgctgagcagtacttgctatgggactcaacgacttatgacttgaagacttcgcagagctgacctaacctccctgtgcttaccgtgcctcatctgtaataggagaataagaataattagaaaaaataactaattagtttcatttgttgagtctaggagaatgttctccttttatactgcagagtggtattttcttgtcaggtcttcccaagtaaaatgggaatgtctcgacttgcccatacagtggcttgattttacctgtctgctttgggtatcaccaccattcggcatgtattgccaatactaaacaaataagtaaatacataaattcaaagtaacaggtgtttattatcacgtgtgtgctgtaatagcccatcagcctgtccctcagacaaataaactctctttaaatcttctaaacttcctcttgaagcccacctctccctccaggggctggacagggcatttgggacccaggatctctaacactctcttctctgggaagccatctcccactgcccaggatgctggatgggaggtgagtgcaacgggcctgtggggttgtcagttggcggaagaaatctgtagatccagggagagaatcgagccacatgtgtggatttggaaatgacagtgtatggctgcacagcacgaaggggatgaagtcacagacacctggatttaaatcgagactccaccatttatttcttgtacgactttggggaggttacttaatctctttgtggctcagttacttcatttgtaaaatgaaatgataatattctgggagaatggttcatgtttccttccttcataaactgctgttcacgaggcggcttcttccagggttaaaaaggaatctactatccatgtatctgctaggacagacattgttgcgtgtcacttgactcctgaaatacgccacggtaaagaaatctctgtacactttcgtgttctgggaagtcactgaccacacaggaccaattattctccatgagacttagataagggatgctgtctgcccactctgtgccgtgactcccagatggcagacaccaccagtccttgttcttttgtctcatgaatgtgttgtaaccaagcgagttatagagaaacgccacacttttgagacaaattaaggggacctttattagctggcgacctacaggcagctaacgctcaaaattctctcggccccaaggaaggggctagttttgtttttataccgtggtctaaacaggggaggggggagtttagctgaagcaattttacagaagcagaataggcaaaaagttaaaaaaaaattaattggttatagaagcagttacaaaaaataaacagttccaggtgcaggggcttaaactatgattaagagataaatgcaggggcttttaggtaccttccaccgagcacattcccgagctgttggtacagcctgcctcaatatcttaccagcaggtgtattcttggatgtgcttggactcagcttgcactagttattcccttaagggggataaagggggctgcaagtgaagaaactaaaatggagtctgtccggctctctctgctaggaaagagtcactcaggttaaaacaaggtagggtatcacaaatgattcacttagacgggaagtctgtcctcctaaaagtagctaggcacagagagaaacattccctgttcagctggctgagacttccgctgattaaaaaaaaaacaaaaaaccctgccccataaatctccccactgaaaccggtgtactccttcctatgaaagtaaaagacacccccgccccgccccggttaccccaacagtgtgatttccacttctggggcgctctccctaaggcagtagcctgaataatttcaatgtattggattgtttggtttctgtctttaccaaggtgcatttatcattcatgcaaaaacagtaaaaaaaaaaaaaaaaaaaaaaatgaaacagcacgtgtcggttctcagcggcgcgccctagctcaaaactccagccaatcacaggagaagtcggccgcctcccaaccctccagcccagttcccacgtccctcgcccgggaagtcacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggttcagtttctcagcggcgtcgcatccctgtgacgtgagcacatcctcgccggcgcccccttccgcgctgcggcgcctctagcccgccggagggcggctcctctcgatggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagagaatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgact

SEQ ID NO: 4593 - DNA, 46864 bp, human; identical to SEQ ID NO: 3409

SEQ ID NO: 4594 - DNA, 40298 bp, human; identical to SEQ ID NO: 3410

SEQ ID NO: 4595 - DNA, 47591 bp, human; identical to SEQ ID NO: 3411

SEQ ID NO: 4596 - DNA, 46764 bp, human; identical to SEQ ID NO: 3412

SEQ ID NO: 4597 - DNA, 48182 bp, human; identical to SEQ ID NO: 3413

SEQ ID NO: 4598 - DNA, 15915 bp, human
gaggctgagtcgttccaacatggcgcagatgccacaaggacactagcacaccagcaggaagctgaacagaaggctggaggtgccacggtgacaaggacgggatcctgtcaggccaggtaagcttctgctctgccagtgacacggaaagggacaatgaagggccacagatacagaaagcatgtctgtgcagcctgcagagttcaggtgaaggagggacccaggcaggagcagtcagaaccaggagggcttaggcaagagacaggacaggcaaaggcactgatgcagcccacccagacttgacagacgcgttcatccaggtgttcatgtccttgtcactgtggacatctgtgttgcagccacagaaccacatactcgattaggacgcctgaacccaatcaatagtcgtttttccctacagaccctgggggaggcccacatgcacttgccctagggtactctgacattttggcactgcagtcccactgggaggccacatggagtaacatactggccaagacatatttaaaaattctggcagggtgcggtggctcacacctgtaatcccaggacttggggagggcaaggcaggcagatcacttgaggtcaggagttcaagaacagcctggccaatatggtgaagccccatttctactaaaaatccaaaaaaaaaataatcccgggtgcagtgacgcacacctgtaatcccagctacttgggtggctgaggcacaagaatcacttgatcccaggaggtggaggatgcagtgagctgagattgtgccactgcactccagcctgggtgacagagctagtctctatctaaaataaacaaataattttgtagcctcttttactaggagttctggaattagggaagagaggaaaggtacaaccctcctcccgaactccaggggaggagaatctcattgcacagatgtcctctgttcactcgattctcctggagcatttctaaggcacacagagctgctaccatcatagccattactgaccaagtactctgggtgaaattcctttattaactgaataaacttgttctgaagtgctgaccggacactctggggacagggggaggtttcggctgtatccttgctggcagatgacccccacacttggggggtaaggagagccatggcagaattcaacccacggtcccctaggagtacacaggagaccaccctaccctcacctgagggatgtgtgtgtgcaagggttgggtcagggcagactcttcagaagaggggaggtttgtgcggcaggcactttgattctgcacagcttacagtccagagagccgaagaacaagaggaactagattcccattctcagtctgttgatttccacaccacatttggagtctgatcaactccacagctgtgttgcagccgctaacgctgcctctgctctgtttgcctctagattcttcttatctgttaaataaagtgaggctgatggagatgtaatttagggcgggggtggattgcaagtgtctctgtgatagggcaaagcgcctcccggtggaggcgcagaagctaaactcgactggtagctgtgaggcaagggacgccagggcagctcctgtggactgtgttagaacttttcagggtggctttgccctgccaggggcctggatctcacagggggacgtcgtgttaggaccaagctgactgtcccatcacagaataatatctgcagctcagcatggggagcataagcaaagtacgttgtcgtgagtttaaagaggcctggctttggagtctgacagaacccgcgtgtgagtcccagatccagccttttctgcctcagtgccctgacctctttcagcttggttccttatctgtagatgggagtttgatacttacctctctgggtctttgggaaatcaacactgtacatgagtagcacacagtaggtcctcaacaaccaggctccagggagagagagccattcacactgtgccatgttagaggcacatcagtgtgcaggccagcgtgccaggacagtgggagtccagtctaccctccagccagggtttgggcttgggctgatggtggcaggaccagggccatttccatcttttctcttttattgtccatatgtccaaagcagacacttccattcatattcaggtgtgcaatgctaggagctgaaataacaggctgtagtgaatgaagcgaagcctcacagttcactctatggcaggaagaaccagctgtgaggcaggtcctcagcccacatcacttcatggtactgaacctggggccacaattccaaactccatgttcacacatgatgagtctataggaatgaaggagagatctatgttgtgtatctttattattatgttttattgtatatatttaaggtataaaacatgttgttatacacacacacacacacacagtgaaataattgctacagtcaggcaaatgaacctgtcaccttcctcagttaccttcctgcatcctatttttgcaagtaaacttttcctaaaaaccctactctcacgtgacattccagttggttggcccattgggggaattttcatgaatctccatcatgtgctattcagtaaaaatatcaaacccactaagcatgccttttcatccagttgctccctaggtaaagtataatttgctctccttcacttgagagctgaaggtaaggagcaatcaggcagcggttgatggagcaagtgcaggccagacagagggaagggcggttgtgaggcggcagacacgagagagagacagcgagagagcgagcgtgcacgctagacagagagaggcctggtagtagctggggcctgatacccctaatccaggaggctggactttatcctaagggcagcaggcagccctagtagaatttgaaaaggtttgacatgaccagattagcagtcaagaaaggtgccccactcactgggacagagaatgcgtgggaaggggtcaagactggcagcaagatgagctatgaattgttggtggtcatcgaggagggagatgagggtgactggactagggaacttcctgtggtgatggagaggagtcagtgtcaaggtctcacttagaaaaacttgggaggtctaactggccaggctcggtcaactgtgggggtggtaagaggcagcaatcaaggatggctttcaagatctttggcccaagctgctgggtagagggtggtgcctgtcactgagtcaggcagcacaggaggaggggcaggcgtgctgagtggggatgggtgcgttcactttgggacatgctgagcagtacttgctatgggactcaacgacttatgacttgaagacttcgcagagctgacctaacctccctgtgcttaccgtgcctcatctgtaataggagaataagaataattagaaaaaataactaattagtttcatttgttgagtctaggagaatgttctccttttatactgcagagtggtattttcttgtcaggtcttcccaagtaaaatgggaatgtctcgacttgcccatacagtggcttgattttacctgtctgctttgggtatcaccaccattcggcatgtattgccaatactaaacaaataagtaaatacataaattcaaagtaacaggtgtttattatcacgtgtgtgctgtaatagcccatcagcctgtccctcagacaaataaactctctttaaatcttctaaacttcctcttgaagcccacctctccctccaggggctggacagggcatttgggacccaggatctctaacactctcttctctgggaagccatctcccactgcccaggatgctggatgggaggtgagtgcaacgggcctgtggggttgtcagttggcggaagaaatctgtagatccagggagagaatcgagccacatgtgtggatttggaaatgacagtgtatggctgcacagcacgaaggggatgaagtcacagacacctggatttaaatcgagactccaccatttatttcttgtacgactttggggaggttacttaatctctttgtggctcagttacttcatttgtaaaatgaaatgataatattctgggagaatggttcatgtttccttccttcataaactgctgttcacgaggcggcttcttccagggttaaaaaggaatctactatccatgtatctgctaggacagacattgttgcgtgtcacttgactcctgaaatacgccacggtaaagaaatctctgtacactttcgtgttctgggaagtcactgaccacacaggaccaattattctccatgagacttagataagggatgctgtctgcccactctgtgccgtgactcccagatggcagacaccaccagtccttgttcttttgtctcatgaatgtgttgtaaccaagcgagttatagagaaacgccacacttttgagacaaattaaggggacctttattagctggcgacctacaggcagctaacgctcaaaattctctcggccccaaggaaggggctagttttgtttttataccgtggtctaaacaggggaggggggagtttagctgaagcaattttacagaagcagaataggcaaaaagttaaaaaaaaattaattggttatagaagcagttacaaaaaataaacagttccaggtgcaggggcttaaactatgattaagagataaatgcaggggcttttaggtaccttccaccgagcacattcccgagctgttggtacagcctgcctcaatatcttaccagcaggtgtattcttggatgtgcttggactcagcttgcactagttattcccttaagggggataaagggggctgcaagtgaagaaactaaaatggagtctgtccggctctctctgctaggaaagagtcactcaggttaaaacaaggtagggtatcacaaatgattcacttagacgggaagtctgtcctcctaaaagtagctaggcacagagagaaacattccctgttcagctggctgagacttccgctgattaaaaaaaaaacaaaaaaccctgccccataaatctccccactgaaaccggtgtactccttcctatgaaagtaaaagacacccccgccccgccccggttaccccaacagtgtgatttccacttctggggcgctctccctaaggcagtagcctgaataatttcaatgtattggattgtttggtttctgtctttaccaaggtgcatttatcattcatgcaaaaacagtaaaaaaaaaaaaaaaaaaaaaaatgaaacagcacgtgtcggttctcagcggcgcgccctagctcaaaactccagccaatcacaggagaagtcggccgcctcccaaccctccagcccagttcccacgtccctcgcccgggaagtcacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggttcagtttctcagcggcgtcgcatccctgtgacgtgagcacatcctcgccggcgcccccttccgcgctgcggcgcctctagcccgccggagggcggctcctctcgatggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagagaatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggtgagtctaggcaagctccattctcgccagagcggacttgctccttgtcttcctcttgctgctctggccactcttcttggtccctcccctgttccctccccggactcccggttgtactcccgctgcttttctgtgtactcacctgctgggagacccctgatgccagcaccacgcttcactgctgtcttcattttcttctttctttcttgaaagtgggcattgctggctttactgactacctgttcttttgttacaaagctgctaaaaattgtatctcttccgctccagacccagtaggatagagatgatctgtgtaggcatcaaaaatgtagaacatctgcaagtcatgtgtaggacagactctttcctcaatctgtgtggcgttgcgtggctaggagttagattcctttgccatgacatggcacaagactaggagcacggttttcagcacccagagaacttgcacagaccttagacattttgctgtaggattttgccacttctagaaaaaagtccatgtggccgggcgtggtggctcacgcctgtaatctcagcactttgggaagccgacgtgggcagatcacaaggtcaggagttcgcggccagcctggccaccgtggtgaaaccctgtctctactaaaaatacaaatgtgagccgggtgtggtggcgggtgcttgtaatcccagctactccggaggctgaggcaggagaattgctttaaaccaggagacggaggttgcagtgagctgagatcatgccactgcactccagcctgggcgacacagtgagactgtctcaaaaaaaaaaaaaaaagtccatatttaattgggattattaaatgaaatctgtatctttaaactgaaataaatgcattttattatctcatattattgtggaagattgaaaaaagcatcacatgggactggcttaattttgaaaagaaacacaaagctcttcctggcgctcatctgcagggtgtagtctggattcacttgcttagctgttctctttctccttccgcacaggagaattgaagcgaatgagagtggggagtgtgagaggtgcgtttggtgcagcatttctggcatgggaacagaactggccaggaggaagtgacggtaaggattcgcagcattgcacccgatccccgggcagctgtggacatgcgggtcagcccctaggactctgctgtctgaactcttccctcaggattactttctcgcttaggtatcaggggaggctgaacacccagagaggcaatgccaccaggggtgtgttcatctgcagtcagggagacctgggagggaattctgtccctgagtggttgtgtgatctgagggaagttacttgacctctccatgcaggaatttctgcctttgcaacgtgggaaaatatggattctgcagggttgacttgacattctcagtgagatgtttatcacgggccccacatccttcttgtttcatttgatagatatttgtgaatgtccactgggctcaaggctctgtgatgggtgaacaagacaaagtccctggcctctgtcagctcctgggctagtgggttgacagagaaataaccatctgttgacagctgagtgggattggggctgggacaggggaaatacagggcgttttaggagcttggagaaggcttcctgggagaagtgctatctcagctgagtcatgcagggtgaatgagaggtgaaagtcttgccaagggccatggcagtcccaaactacaggcacccatcactatacccggctaatttttatttttagtagagatggggtttcaccccggtggccaggctgctctcgaactgctgacctcaagtgatccacccgcctcagcctcccgaagcagggattacaggcgtgagccactgtgcccagcgtgattgtaaatgttaatcatgtccacaaataccttcccagcaacaactagagtagcatttgaccaaaagggaccaggcaccaagcctggccgagttgaccgataaaaccatcacagtgagggattggtacccagagacatcacctctcatgctgaaggtctgaccggtaaactgtctgggttccctgtctccagtagtccttctctctcttcggtagctgcatgacatgatgcaggaaacttgaggctgtggtgtttcatgcagagatttttgatacaaggtcttttacctgggggcaagtgcctgttgaagaaatgacattggtgagatgatgaaggaagggaagtcacatgtattgctgcagctgctcccctccgcacacacaacggacttctctaggcctcactgtccttaatgcctctgtcagggatcatgagcaactccatgggtgtggtttgagaatctctggatgaacctacacataggacggtaaaatgtttcatttcacaaaattgctggagggagaaagagagaaaagagagcgatgactatgcaggccggttgtcagttgatgtctccagaatcttcctatttcttttttttctttttcttttttttttttttttttttttttttttgagacagagtcttgctccgttgcccagactggagtgcagtggtgcaatctcggcttactgcaacctccgcctcctgggttcaagtgattctcctgcctcaacctctctattacctgggattacaggtgcccaccaccacacccagctaatttttttgtattttccgtagagatggcgtttcgccatgttggccaggctggtctcaaacccctgacctcaggtgatctgcctgcctcggccttccaaagtgctgggattgcaggcatgagccaccacacccggctcacatttcttctcataaaagtgtttctggctgggaacagtggctcacgcctataatcccagcactctgggaggctgaggcatgcagatcatgtggagctcaggagttccagaccagcctaggcaacatggcaaaaccccgtctctacaaaaaatacaaaaattagccgggcatggtggctcacgcctgtagtgcaagctgctcaggcgtctgagactggaggatcccttgagcccaggaagcagaggtttcaatgagccgaggttttgccactgcacaccagactaggtaacagagcgagtccctgcctcaaacaaacaaacaaaacagcaaaagaaacgtggggggtgggggtcgtaaggtcttttctctctctgagaattggctttctacatgtagaaatagatcctgagagagtccttgtgacacatgagaattggctgggagataattgggttaagatcattttccaaacgtttcacacattaactgtttgtgtcagatagtggtggcccaaaggatgtcagggaactaactcgtaggaaagatagattgcaatttctgaaaagttaagaactctttctgggatgtgtgtgtgtgtgtgtttatatatgtttgtgttcagtacatattcaaactgttcctgttacggttctgtctttcttgccccagtgtgggctgatagccacgatttggtgaataaacattcagaggaccagtatcctctgaagaaaactagtgaattcttggtttccacgtttgtcaaaagaatagagcctgggaggctgatctaaagtttccatttagcatttaatgtcaatttttggttgcactcatccaagatgtatttatcaaaacagtacagagagatacccttatcgcaaaatatgccgttgggtttttccacttaacctacagcaagattgacttttttccctcaggagtacagttctgtgagctttgacacgggcatacattcttgtcaccaccaccacagtcgggatccagaacagtcccatcaccgcaggacactccctggaactgccccattgcggttaccccttcttcatccatcatccctggtgtaaagtgatctgtttccttccctctagttttgtcttggggagagtgttatgtcaatgacaccatacagtttgtggccttgtgaggcgggcttccttcttttggcccgatgaacatctcggatgagtgtcagatgcctctgtcacaggctgttgttttttcatgaaggcagtttcacggtgtggaagaccacaggtgttcagccatccttctactgaatgacattttcctctgtccagtgtggggcagtttcgcatcgagctgcttttacaattcagtgcgggcttttttgtgaacctaagttttcatttctctagggtagatacccaggagtgggatggctgggtcctatggtaaacatctgtttgacttacaagaaactgccaaactgcttctcaaagttgctgtgctatttcgccctcccagctgcaaagtgtgagagttccagtcacccaacatgttctcgcttggccttgccagtctccatggtgttaatttgcattcccctaatgctgaatgatgttaaatatggtttcttgcgctcccattcaagtctttcccccattttctagttggggtgttgattttcttattgtggagttttgaaaacgcgccatgtgttttggatataagatctgtcaggttggtgattctcaaacatttcctcctagtggtgcagctttgattttcattctctgaacacactggctcttacacagccaaagttgtgttgtattgtattgtgttgtattgtgttgtattgtattgtattgtatcgtatcgtatcgtatagtatcgtatagtatcgtatcgtatcctattctattctatctatcctattctattctgttctatttatttatttagagacaggggctcgctatgtcgcccagactggagggcagtggctcgatctcggctcactgcagcctctgcctcctgggtcgagcaattctcctgcctcagcctccccagtagctggggactacaggtatgtcccaccatgccaggtaatttttgtattttttggtagagacagggtttcaccatgttggccaggctggtctcgaacaactgaactctagtgatctgcccaccttggcctcccgaagtgttgggattacaggcaggagccaccacgcccggccagagccagagttttaaattttgccaaactcctatccatccatctttcctttccatggatcatgcatctcaggtcatgtcctagcctcccctcacaaagatgtcctcctacggtttctaccaaaagtcatagtattgaactttggcgtgtaggtctctgaaccctttttccttaattgcgtgtaaaggttgaggttgaggtgcatctttttgcgtaaggataggccacctcatgtattgaaaagcttatcccttctccattggattccctctcacacccatgtcaaaactcattggacacatttctatggatggattcatggactctattttattccatggatctactcgtctacccctgtaagccagcaatctcgattattacagctttagagcaaatctgaaaatctgataatatcatctctctaaaataccttctgctttttgaaacatcagatattccacgtgaattgtagaatctgcttgtttatgcatgcaaatgtccctcaaggattctgattggcaggcactgcattcattctacagatcaagttggggacaatggactgttaacttttttgggtctttaaatatgggaacacattgtttctctccatttaactaaatcttctttgattttttcattaccgtttaatagttttgggcatacagaccccgtccacgtattttagctttatacataaccattgcattgtgtttgtagcttttgtaaaacagtattatttcttaaatttaggtttccagttacgcataggattgttttccgtgtgttgagtttctctcctgtattgctgctaagctctcattaatgagcactaagctcttattagctctgagagtctgggggagatacactggttgtttcatgtagacgatcacaggacccatgaaaaggagtactttggtttcttgctttctccggtgtgtgccgtgattcttctggcattatagcactgactgggcctcagcgtgacgttgaatagctgtggtgagagtggacgtccttgcctggttcgcatccttaggcagaaagcatccagtcgttgaccattaagtggcttgttagttgtaggtttgactgtacacgccctttttcaggttgaggaagttgtcttgtgttcctagtgtgctagagcttttatatcaccagtggactttgaatcttatcaaagggtttttctgcatagcttgatgtgatcctgtcatttttgttcttcatctgatctctcaatctgtgggttacattgattgattttcaggtgtgggaagaacaacccttgcattcccgctataaaacccacttgatcgtggcttattattcttctcacatattgctcaattcaaactgcaaggttttgttgaatactttggtgcctgtactaggaaagaatactggtctgtccttttcttggtatccctgtggtgctggcctcataaaatcagtggggcgcattccctctgctttgtttcctagaagaagttgtgtaagttggtgatatttcttcattaaacgtttggtagacttggccagtgaaactgtcttggcccagagatctttttgcaaatgtgtttgcctgtgaattcaacttctttaaaacatataggactgtgcacacagttcagtgtttgaaatccatcctgtgtgagtttccgtagcttgtggttttcaagtatgtgctacatttcctctgacctgtggaatgtgaatctgtagagttgcgtgtattcttaccatattgacccttttatgttttctgggtctggagtgaaatctcttcttgcattcctgatattggtaacttgtttctttgccctcttttttcccagccagtcctgccacgggtgtatcaatttcattgatcacttcaaagaaccagctttttttttttttttttttcctggattaattgaattcatctatgtgtttttctgtttgaagtctcctgggggtttatgcttctgttgtttagcaaaataaattcttatccacactaggaatttggaaacgatttccataggcatgagcagccttttcgactagatgcaaacccagtggtcaggaaggcgaacatacaaaagggtgtgtccccatggtgcaaacgcttacagttgagtaaaagtctcccttgtgagtggatgaaaatgaacgctcatgggcagagcacctgtgagtcacacattgattattctacaaatgatgcttgggaaggggttggaaaatgtcagcagagaattgacatcgtcgaactgcattgcatccttttgcaccccgtgtcacgtggatgcattaattggtatcatttgtaaatcctttattagatggcattaatattctaagctggtgagatgtatgatctcacgtcatcctcagaagaagcctaggacagggtctctctataatccccattctacacacaggaagtggagggacagagaggttgagtaagatgaataattctgtgttttcttgtcttatcaccttgcgttgcagtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttggga

SEQ ID NO: 4599 - DNA, 46831 bp, human; identical to SEQ ID NO: 3415

SEQ ID NO: 4600 - DNA, 30014 bp, human; identical to SEQ ID NO: 3407

SEQ ID NO: 4601 - DNA, 47172 bp, human; identical to SEQ ID NO: 3408

SEQ ID NO: 4602 - DNA, 46864 bp, human; identical to SEQ ID NO: 3409

SEQ ID NO: 4603 - DNA, 40298 bp, human; identical to SEQ ID NO: 3410

SEQ ID NO: 4604 - DNA, 47591 bp, human; identical to SEQ ID NO: 3411

SEQ ID NO: 4605 - DNA, 46764 bp, human; identical to SEQ ID NO: 3412

SEQ ID NO: 4606 - DNA, 48182 bp, human; identical to SEQ ID NO: 3413

SEQ ID NO: 4607 - DNA, 29891 bp, human; identical to SEQ ID NO: 3414

SEQ ID NO: 4608 - DNA, 46831 bp, human; identical to SEQ ID NO: 3415

SEQ ID NO: 4609 - DNA, 47504 bp, human
tccttctagggaagggctggggaggagggggtggtgacacggtggagacaccggctaggccagggggcctgcccttgggacaggtccagacccatggagccccccgggaggagcagcaggtaggaacctgggccccgcagcctggccccctcccttcctgcccaggcctggacccagtccctgggctactgattcagcagcctcctggcttcctggttcctggctcccttcttggactctgagaggcctttggcctgggggagggagccagttcaagtgggagatcccatgggcatccaggtgcccagctctggaaggaccctggaaccctgagcagcacagcctgtggcctgtgaggggtgagcttggctcctaccctgctctactagccttgtgtgcgaggcactgcagggctccaggctcgtggcctctgagattctaacaccaacattccagcagcctaagagtctctgagtctcagattcaaaagagataatgagtcaaggacttgggctggagactggcacctgagaagcagttgccctgatgatgattaatccagagccttcgataagaagagtctcagattcaaagattccctgtaaggttctgagatttggacatcctcaaattcgcagctggcctggcccgcagccatgtctcctggcttttacatgggcttttgaatggccaggccctgaccacagtctgcctctgtgggcttgtgggggacaggggctggctgacctggaaggggtcggctccactcccagcttgctctggctccagctgactggcatacctctggcatctgcgctgcactgggtagggcagggaccaggccctcagcctccctgccctgctgtacctcctcctccccttggccattctccggactttaatcgcaggaggcaggaggtggaggggtctttggaccctgcactaggggtggtgggggcacagcatcaggggtggagtgtgggccccgccttggggtggggggtaaagcactggccttcaaagcaaaagactcctacctggaaccaccccatcctctgcctcacccactcagccctgagtcccatcctgtcaccaagaccactgagaccttgtcagcctcctccgccctcaccctcctctgctctggcgctctctgcctctctctggcttctctctgtgtcttctgtctcgccctttctctgtcttcctctttctctgtctttctccttttctgtctctttcggtttctctctatctctctccctctcttccttcagtgttccccttacccacccacctgggttctcccccttctttgggcccagagcttctccttcctccatcccttcctcccttcctgtgagggatcttctctaaggggagcccccatgcatctttcccccttctctttcatccccccttcccctcccgtcctccctacccctgtggcgtctggtgtgaggagggctcccttcccccttccctactgtggtgtcccagcgtctctgtggctgaggtccccacggagtcacctggaacacaggaggcccagcccggctctttcgtctctactgccccctgttgtcgttgtgttctgtatgtggttcgagtgccgtcctctctttcttgactttgtggtttttttctttttttcttccttccttccttccttccttccttcctccctccctccctccctccctccttccttccttcctctctctccatcttcctccctctctcccttcctcttttcctttctcccttatcttccttcctttcctccctccctgcctcccacgcctcctcttccatttcccatcctccattcctcccagccttcccttttcccctcccgcactcactctcaccttcttgcccccatcgcccaccctgccacttccctccctccctgtctctctctctgtctctctctgtctcttgctgtctctcaggtccacagcgtctcatactctacaccagtattgctgtcctactcaggtccttgactccatgaagcttaccccctcaggcaggctggcagagagcaggtaagagctagacccatccctcccccaattcctcctccttccagacaaatatacagtgtcattgccagcccctcccacctccctgagcccctgctgtgcctgtggaatgggtgtccgagtgtatgaggagagtgcctggaagatcaggtcagcagaccaaagaggacatttgggatctatctaatttgtccttccttaaaaaaatccttccctagagacctgccccaaaaggcctgagtggttggtcctagactatgtgataatccagcttttttaaaggatgaataggagtttgccagttggatagactgaggaagggcagttaggcagagggaacaatctgcccatatctttgcagaatgttatttcttttttttttttctgagatggagtcttgctctgtcgcccagactagagtgctgtggtgcgatctcggctcactgcagcctctgcctcctgggttcaagcaattctcctgcttcagcctcccgagtagctgggataacaggcatgcgccactacacctggctgatttttgtatttttcttttagtagagacggggtttcaccatgttggccaggctggtctcgaactcctgacctcgtgatccgcccgccttggcctcccaaagtgttgggattacaggtgtgagccaccacacccggctggaaaacattatttctaagttaattagaaaacctattttatgttttctaattacagctcaataaaaggaaatattaacagcagcagcaaaaaggctaggccctcctccctatttgaaagtttaaaaatacttgtgttaaagaggaaataagagtggaatttatggactatttagaataaatgtcagtgagaatactacaacttaaaacctataaaatatgggcacagggattcccagaggaaaatttataatcttaattgcttttattaaagaacaagatggtttaaattaaatggactaattattccactcaagaagctagaaaaaaacaaccaaaacaaagcagaataattactacaaataaaaccagaaattaatgaaatggaaaacaaaagatttgataaagtattaataagtaagtaaatatgacttttggaaagaccagctctacctagtttggtagacattctttggcagatatgactaagaaaaaggctaaataaataaatacattaagaaataaggaaggggatttaaccatagattctaaggagatgaaaaaaaagttattataagaaaatattggggccaggcgcagtggctcacgcctgtaatcccagcactttgggaggctgaagcaggcagatcacgaggtcaggagatcgagaccatcctggctaacacagtgaaaccccgtctctactaaaaatacaaaaaattagtcaggcatggtggcgggtgcctgtagtcccagctactcgagaggctgaggcaggagaagggcttgaacccgggaggcggagcttgcagtgagccgagattgcaccactgcactccagcctgggcgacagagtgagactccgtctcaaaaaaaaaaaaaaaaaaaaaaaaagaaaaagaaaagaaaagaaaaaaagaaaatattggttggacacagtggctcatgcctgtaatcccaggactttgggaggccaaggtgggtggatcacctgaggtcaggagttcgagaccagcctggccaacatggcaaaaccccgtctctactaaaaatacagaaattagccgggcgtggtggtgtgtgcctgtaatcccagctactagggaggctgaagcaggagaatcacttgaacctgggaggcagaggttgcagtgagccaagatcgtaccactgcactccagcctgggtaacagagcaagactccgtctcaaaataaaataaaataaacattgtatatacttttttaccagtaaatgtgaaaatatagatgaattgggtggttttctaggaaaatgtaaattaccaaagtgacttaaggtgggacaggaaacctgaataaaatggaaaagtagggaagaaacttaaaagatggtcaaagtggccgggcgtggtagctcacacctgtaatcccaccactttgggaggccgaggcgggtggatcacgaggtcaggcattcaagaccaccctggccaacatagtgaaaccccgtctctactaaaaataaaaaataaaaaataattagccaggcgtggtggcaggcgcctgtaatcccacctactcgggaggctgaggcaggagaatcgcttgaacctgggaggcggaggttgcagtgagccgagattgcgcccctgcactccagccagggcaacggtgtgagactccatctcaaaaaaaaaaagaaaagacggtcaaagttttctccccagaaatggtaccaggtccagttggtattctggaagttctggtatgatggaaattctagcaaatcttgaaagatcagataataggaaaagatagatagcttcccagttcatcccataaggctagtataactagacaggtttaaacaaaataaaaaaaaaacaacaactatagcctaatgccacatattaatagagcaacaactattttcaataaaagattatcaaatggaatccatcagtgtattaaaagaagaatatattgtgacaaatgaaagtttgccccaagagtgcagggattgttcaacattaggaaatgttattgtaatttattgtattaagatattaaagagaaaatatcatataatcatctccataaatgctgaaaagtgatctgattaaattatacatctattctgctgtattggggtagtttgttacacagtaatagatgactaaatagtaagctaggaatcatgaaaacttccttaacttggtaaagaatttttatcagaaaccaaagagaatcatcaaatgtaacagtgaggccctagatacatttccattgaattcaggaacaaaataaggatggctgctatcactgttattaaccaatatttttctggaagttttaaccagtgggattaacaaaagaaatacatggtataaatgttagaaagacaaagttagaattagcattatttgaggatggtatgattgtctacttagataattgaagagaataaaatgaaaaattagtagaactaagaagaaaagtcagtgcagtgagtagacacagataaatatacacgcaaaccattaacttctctgagtaccagcaataactaattagaacacataatagaaaagatcccattcacaatagaaaaaataattctataaaaccactatgaatttacaagaaatgtgaaatacttctctatagaaaactataaaatttaatcaacggctgtaagaagacttgagtaaaacaaagttatatcttgttcttggatgagaagagtcactgtggtaaaaatgacattttgttcctaatttggccaaaacattcattgcattccttattaaaatttcagtgatattttctttgggatttgagtgattggagtttaaagttcattcagaagagtaaatgttcatgaatcactaagaaaattttgaaaaagaatgcaggtggctgggcgtggtggctcacgcctgtaatcccagcactttgggaggccgaggtgggctgatcacgaggtcaggagatcgagactatcctggctaacacggtgaaaccccatctctactaaaaatacaaaaaaaaaaaaaaattgccaggcgtggtggcgggtgcctgtagtcccagctactcaggaggctgaggcgggagaatggtgtgaacctgggaggcagagtttgcagtgagccaagatctcagtctcaaaaaaaaaaaaaaaaaaaagaatgagggcaacttgttgttctgttagatataaacttaccataaagctgcaataatttcaaatgttctatcacagaaatagaggactacagacatgaaacaaaatagagagtttagacacaaacttatgttcatatgggaatttaattcatgacaaaagacatctcaaatcagtggggagtcaataaatgagatgggactattggttacccatttgggaaaaaaaatttaagtgaaatccttgtctcatatgaaaacaaatacaggccaggtgcagtggctcatggggttacatgcctgtaaccccagcactttgggaggctgaggcgggtggattgcttgagctcaggagttcaagagcagactgggaaacatggcaaaacaccaaaaatacaaaaattagccgggcctggtggcacatgcctgtaatcccaactcggcaggatgagacaggagaattgcttaaacccgggaggtggaggatgcagtgagctgagatctcgccactgcactccagccctccagcctaggcaacagagggagactctgtcaaaagaagaaaaaaaaagccataaaagtaccagaaaaaaatctggaatattttaataatattaaggtggagaaagccttcctgagcatgacttaaaaacccataagctataacataaagagtaataattttggctacattaaaatttaaaacttctgtgtggagaaagatgctatacacaaaattaaaacataaacaggctaggagaaagtgtttactacacagatatcaggcaaaaggttaatatctctgcctatatctatatcaccttctggaaactagtaagaaaaagatacaaaacccattcaaaatggagagataacatgatatggcaattcagggaagaaatagacaattagctaataaaggagaaaatatgcccaagcttactaatagttaaagaaatgcagctaaagcaggccgggtgcggtggctcatgcctgtaatcccagcactttgggaggccgaggcaggcggatcatgagatcaggagatcgagaccatcctggctaacatggtgaaactccgtctctagtaaaaatacaaaaaattagccaggcgtggtggcgggcgcgtgtagtcccagctactcaggaggctgaggcaagagaatggcgtgaacccgggaggcggaacttgcagtgagccaagattgcgccactgcactccagcctgggcaacagagcaagactccgtctcaaaaaaaaaaaaaaaaaaaaaaaaaaagaaatgtaactaaagcaatgaagtgccatttttaggttcccaaattaaaaatattggaagggttctggagaaacagaacctctcagataccttctgcaaattggtaacattttttatggggctagtttgtcagttaccaccagaatcctaaatgtctgtattcttccatgctgagaaccatatcctggagctagatttctccaaggtcttgcttccagaaggacctcaacttggccaaccagaggccttttctaaaacaccacaatccaaactgcaaacataagccagactgtgcaactctttatcacctgcccttgtaggatatcattctcaaccaactcttaactaaaaggtgcatgatatatgcttctcaaaagaaagacaagattatgtgagtaggaataatctttctttacagccagactgcaaacatgttaaagtaacggaaataacttttatgtgcactttaaacaaaatgtgcattcctttgacccagcagttcaacttttaagaatcttaaccttcaagaatacttggagacatatgcagagatgttcagtgcagcattgcttgtgatactgaaaaattaaaacaacctaaatgtctatcagtagggaatagatcttagtccatgatatacccatattatggattactctgtagcagatccaaagaaaaggtagctctgtatatactcgcacagcaagatctacaagacttactgttacatggagaaagcaagttgcagaacagggtttacagtataatcccatttttgtaaggaaaagaaaacccccataacaacagtgaaaacatgttatgaacaccctgtcatcatttcaaaattactggcctttttccttggtcccatttccttgcttttattaattcatttccctcctcctttataccttgtccctgtatccagctgttcagattttgtttagatccttttaataattagctcagataccacatcattcattcagcaaggattctgtcttgcctgctttagattaggccttgtgctgacctttggtggaatattggaatgaattgtatctgatcctgctctcatggagctgaagtctagaagggagaaaggcacatagacaatgacaccgtagtgtgatttgggatgggacagaagtaggcccagaaggctgccagatgaggggcaattaaccccatctgggaaggcttcctactggaggggacgtttgtactgagtcttggaagagtgctagctttccttcatccccttcctccaccagaaatggtcttgttcactctttggcccttccaagcaggatgacgtcataggggaaaaatagtggagtcagtacctttattcaagtccgagttctgccacttaccaactcggtgactctgggcaagtcatttatcctctgagcctctgtttcctcatctatgtaatgcggctaatgccaacttacctcttagggctgtctttaggattggagataatgcatgtaaggctcctgggtgactgtcagctctagaagaggagggactacctgtgtcttgttttcctcatagccaactgtgtagcattgaattggattcgatctcaaagctgtgtgtattagacggttctggagcaaagaatgggcctgaccatagcagggctttgggatgagaaggctgagaggagtacagggtacatgggttgcatcataagaagagagaaccaggtgcctggtcttgccttatataaaggtgatgcaggagggaaaataagagtaggcgttcctgggaaagggattccaagtagggagttctggccctggttcttggtcctcttctactgataccatctcctaatctcacagttcagagcagtgaggcatggtggaccactacttgccatggcattcatggcaatttcagtcccaactttgtcactcactagctagctgaccttgaccaactcacttcacgtttctgagcctagttccttatctgttaaacaggactcaataccaccaacatcatggggttcatttactgaatgagctgagctcattcagatgaatgcattcagaatctgagtggctggcacataatgggtactcaggaaagagtagctattattagtgttgatttcagtagatacttttggagtactgctgtgaccagggtctctgttgagtaacagttcttgccctccatgagttcccagtcactcagggagactgagaagggccctgacagaggagaacactgaagggtatggaagcccagaggaaggaatttggccctgtctggggctggtacaggtcaactcagcctaagagctgggtcttaaaggttaagtaagagccagggacagaagggtgaagtgtggaagagcattccaggcagaaggaatagcatacagcatatggaaaagaaacgggatgttattgggaagggccagaagttcctaacctggggtgcatgggtctcagatgggcttcaggaaccccacgaacctccggaaattgaatgcaaaatgttgcattcatatacctatgtgcattttttggtggaagagatggtccatggctttcattaaattggtaaaggggtttgcattcccctcaaaaagcttgagaaccaatattgttggtgacaaagtgtcagttgaatggattctaaataggagagtaatttggcaaaatttgtgttttagaaacatcacattagcagtcagtatgaaaaatgggttgtatgcagggaaaccagctggaaggcctaaactggggtattggcagagaagaaatggatttgagcagggctacggtgttgcacgactccagtgagcaccatttgttgagaagcactttaatttcaaattatagaatccaaatcctttgagagttattaatgagatagactcaatagaagtgtcagatgatataaactgttgtggatgtataaggtgagggaaagggaagaggcgaggatgagtcaaagttagcagagggccagagggacatgagtccatgccagggtgatagtgcaaggggaaaagggaacctctattaatgctcacccagcatccagagtccttagtctcagacatatttactaactttcatcctacccctggttctcagagatcccaagtgacactggcaatactcatttccctgcggattttgcagaggaattacttttgctttgtgagttaggtcaagtttcctgaagaaagctgtgtttaagccagtcattcaaggtccatgaggattctgagagttagagatgggggaggaggtgctgacagtgtccgcaaaggcctggaggtgagcaaggtgaaatcagacattggagggtgcagaggtcaggcttacctcaagcagctgtctgaagagtataggctttttattttattttattttttttttggtaggcagttggagagccatgaacagttcttgaataggaaaagatgaaaagtgacatgatcaaattagcgttttagaagggaaatgagggaggaggctatgcagtaatccaagggagagagaagccaaggtcgtgggcatagagccgaggagatggatttgagaggtgatcaggaggaagagaggactggagtcagagactgaagaggtaaccggggagagaggaggaggtggagatgacagaggctggagttcgcagtaagttcaagtgttcatgcctggcactggattcattcattcactgaatatttattgaatgccaggcactgtgttaggcactaggggtttagcactgaacagaacagatgcctgtcctgatggatcttacagtgagtgagacagaaaaataaataaacaactaaatgtctagagtgtatctgatgtcgataagtgctatgaagaaaaagctggggtgataaggtagagaatgttggggtgccttttgagagggagggcctctctgatgaggcagtatttgagcagaggcttgaaggaggtaagagagtgagccgtgtacctctcagggacgatgttccagatagaaggaaccgcaggtgtaaaggccccgaggcaagagtgtgtttggtctgtttggggagcagcagggagaccagtgtgatggggaaaaggctgaagaaggagtgagaggagtagaagatgagatggtaggggcaacatcacagtctatcttttagagctatttaggaggtagagtccacaataattggtgactgacttgctaagagggcaggaagaatctagggtgactccaaggtatgttttgggctcaggtgactggatgaatggtggtgccttaaggacaatggtgagatgctgagtcagaggtccctatgagagctgaaggcccaaagggccatcctggtagagctgtccagcaagcattgggctcgacgggtccgggacccaggagagggatctacacctgaagttatgaaatggaatgagatcactgaaaaagtgtggagtgaaagagaagagggccagagcagaattgggaaggggaaaccaacgcgtagggaaggagcccaggaagaaatgggggcggggtcagagcagtaggaggaaaagcagtgggggtgggctcacagaagcagaggaaggaaagggccatgcagaggagggccttgttaagagtgtcaaatgttgcagcctgggctagtaagccgagggcggaagagagtctattggctttaaccatcaggagggcctgggcgaccttcctcagaacagcttccatggagtggtgggcgcatgaggcagattggagtgggtcgaagagctcgtgggaggtaccgaagtgaagcagagatggccagtgtagacgggtttcttaagaagaagcttagctgtgaagaggagagagggacagagggggatgtgggggcagatagagggtttttattcccagatgggagagacttgagcttctataaatgttgataggaaggaggcaacagagggggagaggttgaaaacgcaggagggagaggggatgattgttgtggaggaggtaatggggatgggctccagagtccaggtggagagactggccctaaatgctagaggggccccctctttcttacagaggagcaaagcagtgatagtggtggggatacaagggtattgggggattggtgaaagaaatgcttcaggaaagttcaaagcaacaaatggagagccctggccaagggaacggatgctggagctggaaggaagcagagaatacttctggctaggacttccttaggaagtggcacttgagctgggtcaggaaattcagaaaggatggtaataggcaaagatctgtgcagagggaagagtattctaagtggaagaaacagaatcagcacacacatagagatgtgaaaaggccaggcatgctgatggaataatgaacaagctagcttgatgaaggctgggcatcagtgagtagggaacatggataccactataatggccgttataataatagttaccatgcactaagcaccagccttgcttagtacatatttgaattcctttagtcccactgcaccctgcagaataggtatttcctcagtttgcaggtaaggaaagtgtgtcctggaatggtgaagaaatggacccaaggtcatccggctagtaaatgatggggctggtattgaaactcaggtccgtctgattccatagcctgtgcttttgccatctaacaggaaaggcctggtgaggccatatggtgggagagccttgaatgccaacttgaggaccctgaactttatccaggaggcagtgggtgtctgagcagaagagatgcatgcttgaaggtgggctttaggaaggctaatgtggttcaagaagggagggagaagaaatcaggaggtgactgcagtgttagggggagaggaagcaggggcctcgcctggaaaagaggggagtgagcagtgggaatggaatatcacttgttcctcatgacagcctggagaggtgtggatcttctgtttttatagatgaggaatgggacactcagaaagggagggctacttgcccagaacttgcgccctgcttcatgtgattttgctgattcaggaagtccgtggaacaatgtgtcagagggagctctgagtctgagaaaggcgtgtgcgtgcgtgtgtgtgcttgtctgtgcatcagatggacagcaatgccttcctttcctttcccttcacttccctgtctgcgttccttcccacctcttcccattcttccagtctcctggattccataattcctgcatcccctgagccaaggggtctgggaatgagggtaactgtttccttgtctgtccccagaaggtcagccttgtcactcccaagtcacctggtcccctcccagcccaactgtctgtccatccaccatatgaaactgtagcccagcaccagtgaatgccacatgcagcctggcccctggtactgctcagcagcaccctagggataggtgcttgttcctgcagcgactcttctcccactgctgtggctgcttctgtgtgggcagacggccactttgggaattagattcagctcacgagtagttaacaataatcaccaccatgttcccattgctggtgtttgccagacacttgatatatgttctagttcttgcaacagtcctgggaggttcacatcacgagccccatttttacagacgaggaaactgaggctccaagagtgacaataatgcgctcaagggcatatagcctggaaccacttgtagagctgggatttgaacccaggtctgtttgcttccaaagctgtgggctttccgtactccatttccaagtatctcccattttcctgagcctgaaccttcaggaaatacaaatccttgtccttcaagagcagggtgggtttctagagatagtgccaagttcacccaaaggacctagtgggatgagtctgagacttggagctccaaaaactctgggttcaaatcctgactctaccacttacccagctgtgtgacctagagcaagttatctaacctttctgagttttaattccctcatctctaaaatgctcctctgcagagctgttgtaggggctaagtgagatgatgcgtgcaaaatgagagcaggttgctgttattatattaaaatgagggtcaggcacctggcagggttagaaagggagttgatatacgctgagggtgaccttaagactgagcccaggctgggtgtgggggagggctgtcccagcacactgagttgggtgtgaccctggataatccatcacactggcctccccaccctgacccccattctcgtcccaccttctggttccggtcctggcccttcgcgtatctcccctgctctgcaaactaatgcctctgcctctctctgtcacccaccgcctgtggcctctaccccgcccttcctggccccagggaagaggaggaggaggaggagactgaggaagaggaagaggaagacgctcaccagttctgctgtccggcctccgagtgcagtagtccctcctctcggtaactgagaggacaagggccattttctatgcagaagcaaaagccttaaccagcccctccttccccccacccacccccccgcagattcccccatgggaccctgtcccctgcttcaggaaccagatgggcaagcatcgtgccccttcctccccccaccttcttcttggaattcccatccccactgctgtctcctctggactccagcccctgaattaaagagagctggagccctaggtccgactaaaatgtgggagaagcagagcttggagcttggagcttggaacctggatcctcccgtacccgcactcccacttcccaggcaccctggagcctgccactactggagaggtctccaaatgacatcccaaggacctacctctgtcctctgtgagcacaaacagagatgcagggtgcctagggctcagaggaccagacgggggcaggacccagcctgcctagttccctgtcgtttgttcccttgctgtggccattgctgccatctcctccactgcttgaaggcctcaccccatgccctctgccactcccatagtgctctgtaaatattatcaggaggaaaaggcctctcagagtgcgtgttgctgtgtacaaaggaatttccatcaataaaagctgatctcttctctctgtctgatgtatattccacccacccccacttccctcttccaatccccaccagggccttgccttctttcctatccagggctgggaataggggccgggaaagagagtagggtttgattcgtggttttgtcaacacccaggaggcactcaataaatgcatgaatgactcccaacacgggcaggctaaccttggatgtgtcgcatgacctctttgacatctataaaaaggagaagggttggattagagggtctccaatgactcttccagctgtgacattttgtgaatctgagatgctacagttttaagaagctatgattatgtgaatttaatagacaatgattcagtgacacattccactgcaattttatgatttctatttctacaatgcagtgattttgggattttccagtcctgtggttttaagattgcataattctaccatttgaacaaattctgatgatgcaattttaatattctgcaatgtttagattccttgatcgtttacttttaaggttctgattctacaactttagggatctctgaatctgagaggaagccatttccctccaatgcaacgaccctaaatattccctgcacctgggcagaggctggttctaagactccctggaggctctcagctggagggtggaagatgtcctttacgggtttgtaggactcacaccttccatgatgtgtctgaagtgggctcatacccccgacttttcctgtctgagcctttggtattagacaaatctgagtttaccttctggttctgccacttacatctgtataaccttgagcaagttttttcttctccttgagctttgttttcctcctgagtacagtgagaatatacctacctctctgggttgtcatgaagattagcaagaaagaacacaacgagcccagcataggagcttgtgcactgttgggcaagtgtgctgtgattggtggctcttgttttgattaaggcccaggtgagagttttctcctgtcttttctttcctccctcccttcagcatctctatcacattgaacctctaggtttcctagaacctcacctccttccctcacttattgcctcactcgctcaactcatctactcattcacccattcaaagtctcatttatttctcccctccctccctgcctgtctcccttatttactcttcctcattctactcaacaaagcattgtttgagcccttactgggtataagacctgacgctaaatactgtgagagatccaaagtaagacagaggccaggtgtggtggctcacacctgtaatcctagccctttgggaggctgagacaggcagatggcttgaggccaggagtttcagatcagcctgggcaacatagtgagatctcatctctacaaaaagatttttttttttttttaagcatgacagtggctgtgtcctctgcgagctctccatctcccaggggagatgagagatgagaaatcctttgggaaagtaggaaggatgcaaagggttaacatgattggacaggaacggcttcagtaatgagcacattttgttcctggcccagagaggaaggagatgtcaaggtgggtggggaggtgtggtgtccaggagggcttgctggaggaagaggtgcaagagttgagccttgaaggctggtaagggtttgaaaaggtggcaaggggtgagaaggcattataggagacagggaccgcatagacaaaaacctgggggagcgctccagggtcatgcaggggaatggtgggtacattactctgtttattctgctctccagggtgtgtgaatgtaggtgacctggggctggggacgaggagaccattctacccttccgctgaatggagagagaagcaagtgtgggggtggggacgggggttcaactacatggggggagggggcaagtcagggtcagatgaccctcccgacccgtgggcaactgaattggctgaatcgggcagagggcttgtgctgtgggaagggggtggggttttgatcagccgtgagagaaatatgtgtgcacgcatggcctccatgtggccggccatcctcacacatgtctttgcacaaggctctgcaggtctcacagttgtgagactgtgcacactgctgcagagctgaggaaatgtgatgatgtgagactgggtgtgaggaattctgagtgtgaggttgattgtgtgaagtggtgactttatgtacctggcagccttgatgtctgtgtctggtggatgtaatcacaaggctgggtgtgggtggcttttaagcacgtgaggctgtggcctttagggtgacagttgtcaggcaggatggtcacacacacacagacacacgtgatttctacctgtggtcttcgaggacccagggtggctgctgagtaactgctgtgtgcttagtactggcatgagtgccataggtccgcaaaggtgaatcacaccgggccgctgcccttgggaaacaggacgggggtgtggggtgggagacggacactttaagagagaaccacaagttagccaggaagaaagactgactgtgataatatgggtatgcataagacacaggggagggagtcactgaccctgtcatgttccgtgagcggcaggagtgagtcagcattgacttcccagaaggaccaacctgcccagggtactgcaagatgaagatgagctcacccagatcaagcaagtcggggggtgaaggggagacagaagacattctgggcagaagaaacaaaggaagagtatgagcatgggcttggttatgtggatcagcttgctgtagtctaggaattgcaagtaacctgctattgcctgtgacattgaggaacttacagggcagggtgggaggtgaggggtggggagacaggccagattcagaggggcttctgaagctaagagtgggatgctggccagaggtgagggggattcttgtcctgtgcaaccctgggcaagtcactttgactctctgggcctccatttgggtctgtgggattggatggttcataaagcctagtccgtccagtccatcccagctctgtgcatcttctgccacccttggctagccacatccatgagtcatcgctcttgaggtcaggagcttcttccatctaacctcagtccttcctgcttcctcccgggttgcttcctcgttcacccactccacaaatatttacccagcatgcgatcctttgtgtgccactgtgggaaggcacggggagatgaagaatgcgaggactgtaccttgaagggactgcttatagtgcctgggacagagggtggggtggtggtaagagcacgggctttgtgttcagatacacttttgtttgaatcttggctccaccagtgctgagcttcaaggctttgggcaggttacttcatctctctgtacctcagtttcatcatctgtgctgtcctcctcagagagaacaacccaaaccttgcagtgttgctcagcctagcaaaatgacaactcaataaatgacaactattatttttagggctgcacagcagcaaagctgggattcaagctcaggtcttgcgctcccaaagcccgtgtatgcagctcagctcctctgaaggctgctttcttccctgtcagttcctgtgccaagccaggctgggctagggcttagatccctgtgacactgggattgggcagcagaactagcttgcagaagaaatattggagggagaggtggctgcagtccccctgcctcctctctcccctgccactgggtccagtctcctggcccagtctgctccttccagaacccaaagcccctggtcccatccaggtgcaatgaccttcctcgtcttgttttcttgtctctacttccagtccgtcccgttccccccactgccacctaagttgtcatggggatagtcctcaccatccctagcttcctcttgccctcatcttatgatatccatggcaacagcccccattcgtttccatgacaactgcatcctgatcccatcccctgctggctgcctggttccgggcagtgccaataaagggaaggagggagagaagacctcccattagaagcagcatttgaggaggattagtgcccctgccatgggcaggccagccccagatccctgtggaacatcctacactgcttctccccatcttagtgctttggcacacaaggttccctcactcttcatctctaccaactccttccaggcaagacccagtccacaagcttcctcccccaggaagccttccgggcagcagaggaactagcacaagctttggggtttgaatctctgtcctgccacttgctagctctgagacctttggcagtcatttcccctcttggagtttttttcttcatctgcaaaataggaatcctaattcttccctcacgtttgccatgcagattaaataatgtgtggaaaatgcctgacacagggaaggtgcgcagtaagtgcgagtttatttttattctgctcaaccacccccaaacagaagggatctctctcctgcactcccccagcacttcctctgttccccagccctgataactttctgctttgtactgtggttatttgtgtagcatagcttatttccccctctgcagaggatgctctccaatttcccccacagaatagcccagcagacagcgcacatgggcgtgtgtgtgtgtgtgtgagtgtgtgtgtgtggttgtgtccgtatatgtgcatgtctgcatgtgtttgtgtctattttcttgtgtctgtggatgtgtttttgtttctaggtttgtctgcctttgcatgtgtctgtgttattgtacctctgcatgcatgtgtgtgagtgtatgtgtgtgtgtgtgtgtgtgtgtgtgcacatgcagatgttttgctcctggctgggaagagtccagagagggggtgctcccagaccgtttctgaagtccaggaatccaaagagggagttggttttgcttgacccctgcacagatgagaaactgagttgcagagaggaaaagtgacatgcacgggctcacacagctggtcagtggcagtcaggacctgagccttggcctgcccagcgtcttactctacaacaggctctttctctctctgtgtgtttgcatgtgtgtgtatgtgtgcgagagaaagagaagaagagagattttccatgtgatcagcatgtccccgagtgttgttctgggggctctgacttgagggattccacatccccagtgctgtttcttcagcagtatgtatgatgtcagaagcaacgccgtcaagcaccctcctttttttgccaggctcccttgtgggaggctgtgctgacagcctgatctccctgccactattccctttgcaaccaaaacgggggtgagctctcaagggaggaattgccaaagagtgcagagccaggggcagcacggagccgggagtgaggagaggcaacaagatgtcatgaaaagcctgggccctgggtttgaatcctagcttttttacttaatagctatgtgaccttgagcaagtttatgtcacctctctgagcctcagtgtcttcatctatgaaatgaggctaatggtgcctgccttggtaagtttcaagaattcaatgagctaagtagtgcctttgccctaggaattagaggtgacaacagggccctactgcagcccgagaggagcgggtgtaagacagcctgtgtggaggaggcaggcaggcatggaaaggcatacctgagcagagcattgaaggctgagcaggaggtagccaggttggggcaatggggcagagaatatatgaggtgggggtcaagtcaggagagccatccatggccacagtgaggaagttgaaggttatcccatggctgctgattcctggaacacccaagttagatcatgtccctcctctgctcacctcaatcagagcaaaagccaaagtctttattgtaggctcatgccctttccgatttggcccccatgacctctctgatcttacctcctatctcctctcattcactctgttccggccacactggcctcttcactgtttctcgaacatgccagacacagttctacctccgggcctttgcgctggctgtaccctctctctggactgctctgcctttgccatgcaacttcctctcacttccctcagcactctgcttatatgccattgctccagaaaggccttccctgagcaccacttctcaaacagcaccttttcgcaatctgctatattttccttcctagcacttcacccctacctgaaatggcaggatatatttacttgtttctttcttctgtaagcctccaaccttgtgccccccataatgagaccattctctgggtcccagccacacccattccctcactagaacatcacctccctgagaatgttctcgtgcattttgctcactagtatatttccagcacccagcactgtgcctggcatacagagggtgctcagttgttgtttgttgagtgagttatctggcgctgtggaagggttttagtgagagaatgaaatagttaggttagtacagttttgtttttgtttttgtttttgtttttgagacagggtctcactttgttgcccaggctggagtgcagtggcaggatcacggcttaccgcagccttgacctcctgggctcaagcgattttcctgcctcagcctccctagtagctaggaccacaggcatgcgccaccacgcctggctaattttttattttctgtagagacggggtctccctatgttgcccaggctggtcttgaactcctgggcttaagtgatcctcctacctcagcctaccaaagtgctgagattatgggcctgagccaccatgcctggcaatacttttttttttgagatggagtctcactctgtcactcaggctggagtgtggtggcacaatcttggctcactgcagcctccacctcccgggttcaagcgattctcgtgcctcagcctcccaagtagctgggactacaggggcccaccaccacacctggctaattttttgtatttttggtagagatgaggttttgccatgttgcccaggctggtcttcaactcctgccttaagtgatccttccatgtcagcctctggagtagctgggattacaagtataagccactgtgcccagctagatttgtacttttttttttttttttttttttttggagacagtctcactctatctcccaggctggagtgcagtggtgcgatgtcagctcactgcaacctctgtctcctgggttcaagtgattctcctgcctcagcctcccaagtagctgggattacaggcacacccaccatgctcagctaatttttgtatttttagtagagatgtggtttcatcatgttggccaggctggtcttgaattcctgacctcaggtgatccacctgccttggcctcccaaagtgctgggattacaggcatgatccacggcgccaggcctagatttgtacttttggtggtggtggtggtggtgggttttgtttgtttgtttgtttgtttgtttttagacggagtctcgctctgtctcccaggctggagtgcagtggcacaatcttggctcactgcaacctctgcctcctggattcaagtgattctcctgcctcagcaggagatttcaggcccccaccaccacgcccggctaatttttgtattttcattagagacgggttttcgccatgttgcctgggttggttttgaactcctggcctcatgtgatctgctcgcctcagcctcccaaagtgctgggattacaggagtaagccaccacgcccggcccagatttgtacttttgaaagctctcactggccacagggtgaagaatgggttggaagaggagatcggaggctgtggtaaaagttcaggagagagtatttcttagagcagcctcctgagcacattcattgactccctctggacggcagcttttattgagcacctactctgttccaggccgtgtgctctgtgttagctgggagattatcaaattctcttcctgagctgggattctgggagtcatgaacacaaatagctgtcatgctttgccaaagctaacctgtgccataaaaagcaggacagacatgtgctgtgtgtgggagctctgaacaggatcagcaataatttctggctggaggcgggattcaggagggcttcttagtggtggcatatgacctgaatcttgacggaactaggatgtgggggaatttctcagattgcagatggcggagacgatggggattgcatttcaagtggtaggtactgtatgagcagttttggaggtagaaagcagaggagcatttgggaaaagcaggatgtgggccaggctggaatgatgggtggatggaatagggggctggcagccaaccctgaagtatggcttaatgtttaagagtgtgggctctggagtcagactgcctggatttgaatcctggctctatcattagtagctgtgtgaccatagatatgttacttaacctctctgggcctcagtttctttatgtgtaaaatgaagataaattacagtacctacctcatacggttgtcttgaagagcaagcaagttattcagtgtgaagtggtaagaatggtacctaaatgtgctaaatggtctataaatattagctgttgtatcttggagaagcctcaaatgccagaataagggacttgggctatctcttctgagcagtggaagttatagatgatggttcatgcatacaggagacagttgatcaaaactgggcttgagccgtgtgctgggaggggaggtttgagagattaatgggcaagatcctgcagtcctggcagggaggagaggaacatcttggatgccgggggtgggctgagctggggctgaaccctggagtgggggtgatgtcagggccaccgccccaggcccaggaggagagagaatttggggtggagagcgagcgatgggtgggagctctccccagggcggagccgagctccacagcgctgcagcccgggaccgggcctcgtgggcgcagccttcacaccacatccagcccccagtgcaaagcgctctgctgcaaggctggcaggcctgttgcagttccagctcctgcactggtagggtcccccccagtacctaccccagcccatttctgccctttgcctttgcctctgccgaataggggctggggagtaccccttcacctgtttaccagccaagagcctccaaccttgtgccccccataatgagaccattctctgggtcccagccacacccattccccccacagcctcctccatgcctcacctgcgtgttccttcccgcccgactccttccctgtcttccccacctctgtggctcttcaccgtgcaggctcggctcaaggcgcctgggctctgtcgccacctgggttccctggcagcctggttgccatggcaccatgggagcagttctggtggaacaacagctctgggaaaccagggcaggcaagacccggggcccagctcctgccacgcgtggagactcccctgcccccttcccccagctgagcagaggaggccatgaggagaaaaaggaagctgccccgcagggctgctctttacctgtgaggatgctggatgggaggcgcctcccactgttgctgctcgccctgccctgctgctggccctgccctcgcaaccagggaaccctgggaactggcttggcctggcccggagtccaggcaccagggggcaggggccaggctgcaggggacagggctgggcggatgaggggagagctgtgtgcaggggtgggcctcacacagctgggacagggctgggagggggtggcgctttgaaggagctagtctggggtggtgctgggaatcggactgggagggaaatcacagcgagcactgcgttggggacaaggccaggaggggatggagctgtaaggggaagaggtctgtggggaggggtggagctgtgagggggcagaagaaagggcatgaggagacaagactgggaggagagtggtctaggggagaaggctgtgaggggtgaggaggactggggaccaggcagagccttgagggaaaggagtctaagaggatcttgccgtaaaggcaggggggctggaagggaggggacttgggtgggagtggggagacgtccaagagctaggactcaccgtggcctgtaagtgttgggtccctatatctgtgaggaagctggggtggatgggatggggggcagggatctggctcacccactctcagtatggcccagtaggcccctgtcctgtccccacatcctggctcatcttatctcatccccacagtgtggagggtgatgccccaggcagtgacctgagcacagcggttgatagtcctgggagccaacccccctaccggctgagccagctgcccccctccagcagccacatggggggcccccctgctggagtgggccttccctgggctcagcgggcacgcctccagccagccagtgtcgccctgaggaagcaggaggaggaggagataaagcgctccaaggccctatcggacagctatgaactctccacagacctgcaggacaagaaggtgcaacagaggcatctggttgggaatgggagtcgggatgcaagagagcgccaggggagggtttgggatgtggctcttgggggtggtatcagggagggataatgaggctggaattggagaagactggcccaggacccttcaccccactggggatgcactcattcaccacccatccactgaggcttgtattcactcaagaaacatttactgagctccctgcccgggtcctggcgatgtaaagatgaatgagtcctggatccagtccccaaaaaactcagtctaacaggaagaacacacatcagttgaccttttcagaagagtgccatacaatagattgtttggctaaaaagaaaggtggagggaaaacaaaatactacatataggaaaaaactggaaggacatatacaaaaacatataccctacaccaaaagacatattctagttatgcttaggtgtttggaatgtaggtaattcaacctacctacctaccttccttccttccttctctgcctttctctctccctctctccttctcctttctcattctctttcttcctcctttctttccttcttgctctccatttatttctaccttgctttctttttttttggcttctctgtttgtttcctgttttcaaataatcaatatgttcttcttgcaaataagaaaacaaaacataatccaatcccatttgactagtgttatctgaaattcaagtgaggagacaacactgagcacctagcctggcgctctcggtggctgtaagcagtcagccatgattccagtgggggtggtgtggttgagtgcctagggagatgaggctgccatgactttctgaccttgttcccctcgacccttctctgccaggtggaaatgctggagaggaagtatgggggctccttcctgagccgcagggctgccaggaccatccagacagccttccgccagtaccgcatgaacaagaactttgagcggctacgcagctcagcctcagagagccgcatgtcccgccgcatcatcctttccaacatgcggatgcagttctcctttgaggagtatgagaaggcacagaaccccgcgtacttcgagggcaagcctgcctcgctggacgagggtgccatggctggtgcccggagccaccggcttgaacgggggctcccatatggaggctcctgtggtgggggcatcgatggtggtggaagctccgtcaccacatctggagagttttctaatgacatcacagaacttgaggactccttctccaaacaggtcaggatccctgaaaaggacctttcttccccatccccgtgttctggctactcctgctactttttacctagattgcaaactgaaagaagttgcgtgacaggcatttaataacagcaaatagctaccatttgagttgggactgtgagaataatgagaaagaactggtaagatagaaattaccttttttttttttttttttgagacggagtttcgctctcgacacccaggctggagtgcaatggcacgatcttggctcactgtaacctctgcctcctgggttcaagtgattctcctgtctcactctcccgagtagctgggattgcaggtatgtgacaccacgcccggctaattttgtatttttagtagagacagggtttcaccatgttggtcaggctggtctcaaactcctgacctcaggtgatccacctgccatcacctccggaagtgctgagattacaggcgtgagccactgtgcccggccagaaattacattgttaaaacaagcaagttataaatatgggtgttccatgtcgttcccttcttgtgggaaaaaatatgtatgggtgtatagaacaaataagaaaaaagttctcactacttggaacttgatctactataaaataaagcttaactcacaggtagtgagctcctactgtgtgccagtgctgtatatgcctcacagcagacctgtgagacagggattattattcccatttaatagaggaggagactgaggctaaggacctggaattggtccttgtcctcaaggatcccagggcagtgggaaatggcagacatatgtgtgcattactgtctcctgaagtagagtgtgctctgagccatgagaaaggctatagtataatgtatagtaccttgggaacccagaggagggggaggaaactttcttctgggagaaccacagaaaacctgtttgagaaaacagcattggagctggaccttaccagacagaaaagatttagcaagttagaaatacttgggagggtgttgcttacataggcgttgcatcagcaaaagtgtggagggtggaattgtaatgcagtaaaggtagtgggtgatcgttgtaggcttggggtgtgtcaacatacttgcccaggtgtgaatcccagttctgccatttcccaactgtgtggccttggcaaactgtttaaccacactgaaacatgatcaataaaatggagagaaaataaaatggagagaaaacccttttagagctgtttggaagactcggtgcaactatacaggtaatatatatgaaaacacctagcacgtagtagctgctaagtacgttagttttcttcctaaaaccaagaaggtacttggtagagattgttgaatgaatggaagaagctttataagagaaaaagtcaccctgctctaacctctatgatctggccttgccatcagcctgggcatgcctccttggagctggtgaagaggtggagggaaggacaggagtattgaagggaagatctatatcattcgtctgttcattcatacaacaaagatttaattgaacatctcttctgtgtcaagcaatgtgttgagctgagctaaaaagagagaaaccaggcctggatccctccctcaagggaggaatgggaaataggagatcagtctgggaagcaggtctggtcccagctctgagtgctattgaagtctgatggggaagtatatctgttatctgttgctgtgtaacaaattacccccaaatttggtagcttaaaactgacccaagagagtgagcctaaacaataaacatttattatttcatacagtttctgggtgccaggaagctgggaatggcatggctgagtggttctggttcagggcctttcatgaggctgcggtcaagctgtagggagagcccgcaatatctgaagattagactggggctggcagtctgctttcaagctcacccacttggctgttggcaggaggattcaatgcctcaccctgtgggcctctccataggactgttcgtgatgcggctttccccaggttggggggtctgagagaaatagtacaagtgacaagcgaccaagagtgctcaagatgcaagctgcagtcattaaaaaaattttttttaatgttttaaatttttaaaaaatgttttgcagtttttttttttttttttaataaattttttttggccaggtgtggtagctcatgcctgtaatctcagcacttcgggaggccaaggtgggcaggtcacctgaggtcaggagtttgagaccagcctgtccatcatggcgaaaccccgtctctactaaaaatacaaaaattagccaaacatggtggtgcgcacctgtaatccctgctactggggaggctgaggaaggagaatcgcttgaacctgggaggtgcaggttgcagtgaggtgagatcgtgccactgcactccagcctgggtgagagcaagactctgtctcaaacaaacaaataaaaattttagagacagtatcttgctctgttgccaggctggagtgtagtggcgtgatcatagctcactgcagcctcaaactcctgggctcaagtgatcctcctgcctcactctcctgagtagctgggactacaggtgtgtgccaccacacccagctaatgtttttattttttgtagagatagagtctcgccatgttgcccaggctgctcttgaactcctgggctcaagggatcctcccatcttggcctcccaaagtgctgggattacaggcatgagccaccatgcccagcctctgcagtcttttaaaacctaatttcagaagtgacatacattcgcttctgccatatgctgtttgtcacacagactaactctggtacaatgtggtaccctagggtgtgaataccaggaggcagggatcattagcggccagtttagagtctggataccacagggagagagcattaccagctgtggtccagatgctcaaggtcaaatgttatggatttcctaagagaattcccacagaggaaactgggattttggtttactctgggggatggcagaggcaagaatgtggcttgaatcagggaggaggtaacgtttggcttgagtctaaatggacacaaaggaggtattggggtgtgagctgagtggggaacttgtgggcattagtctcagctcctgtgagctcacaatggttccctgggagtcattttacagaccacagagagcctgtcagggctgggggaggggaatccaccctccttgctgacctaccaggaagactccccctttttccttacctccctccctcattcccaccttccaccattcttccctttatctttctttcttttctctccctttccctcctctcctcccccccttgcacaggtaaagtctctggctgaatccatcgacgaagccctgaactgccacccgtcagggcccatgtctgaggagccagggtcagcccagctggagaagcgggagtcaaaggaacagcaagaggacagctcagccacatccttcagtgatcttcccctctacctggatgacacagttccccaacaatcccctgagcgactgcccagcacagaacccccaccccagggccggcccgagttctgggcgccagcccctctcccgccagttcctccaccagtgccatcaggaacccgggaagacggtagccgtgaggaaggcactcgcaggggtcccgggtgcttggagtgccgggatttccggctgcgggctgcccaccttcccctgcttaccattgagcctcctagtgacagctccgtggacctgagtgaccgctcagatcgcggctctgtccaccgccagctggtgtatgaggctgatggctgcagcccccatgggaccctgaagcacaaggggccaccaggcagggccccgatcccacaccgccactacccagcccctgaaggcccagccccagccccaccagggcccctgccaccagcccccaacagtggcactgggcccagtggtgtggctgggggtcggaggttggggaagtgcgaggcagcaggcgagaactctgatggtggagataacgagagccttgagagctccagcaattccaatgagaccatcaactgcagctccggctcctcttctcgggacagtctaagggagcctccggctaccggcctgtgcaagcagacttaccagcgggagacaaggcatagctgggactcgccagctttcaacaatgatgtggtccagaggcggcactaccgaatcggcctcaacctcttcaacaagtgcgtgctccccgttctagcctgcttaccccttcctaccctgccacatgcacttgggttcctgggacagaactccacacagtgatccccgttctgccatcctttcattttgtggaatggtatttctccccagacattcagggaagaggattggcaacagggtggcagagtagagagtcccttaacacacctgggctcgggtcccagtactgcccctggctggctgtctgatcttgggtgagatgaccccactaaatggattctgaaccttgtcctccccaccttccctttttagaggggaggtgatatggtgtagaaagagccctagtctgggaaacaggagacctggccccctcagtcggcctttggctagactcactgcatagccctgggcaaggtgcattcctcccctgggcttccatttttccacctaccactagcagaatgtgtatgtaagaggtgttgggggcagggtggtgtgctggacccttcagtgactgtgactaagctctttctaggtgcctggtcttctgccaggtgtttaggagtgaggtgggagtgtgacatttgattagaaaataattggaaaatattagatgtaattggaaaacattagatgtaattggaagccattacttgaatgccttacatctttatagcttattaaacactgccacctatatttaattcttacaataactcagcaaggcaggcagtagtgttcctattttgtagataaggaaccaaggcttggagaagcaaaaggaattgtccaaagtcatacaactgggaagtgatggatctgagactcctatggcatcagtcccttccaaattttaaccttgtggggtcctaaggttctggggttctgaatatgggatagctgtgacccagattttggcccagctccctggaaatctagggggcaccttgtctacagaaacactcagagaaagttggtgatacctgcctgagtgggatgtgggacgtggaacaaagtaacctcttcacttcttccctactctgagggtctgtgactcagagggaaggtgctcagccctctcctcggttcttgctgggaatgtcaagcctggcatagagcaggctctcattagatactgattttctttcaattgtgatgtggctccagtgaagggggatgttgggttgaagataccttgggattttgaagctccttgaaatgggcaagtggcttcttctccctgggcctcagttttctcacttgtgccatgatgggattggatcaaattatgtatttgacttcgttggtcctctgaggccggacttagttgggcccaaaattagttcaacaaatgagacagagagcacagttccaggaggacagtcatctcatctacctctcctctttctgcaggaagccagagaagggtatccagtatctgatcgagcggggcttcctgtcagacacaccggtgggagtggctcacttcatcctggagcggaaaggcctcagccggcagatgataggggaattcctagggaaccggcagaagcagttcaacagagacgtgttggagtgaggaccccaggatggggcaggctgggccagggattcctggaaaaggacagcaagagggaggaagggggcagcctgtccctttagctcagataagcttttcaaaacaggatgaatagaccttcctgcccctgtacccttctgccccaaaggggtctgatcttgtttggctctattcctaaagtcttctgggtggccctgggcaagacatgctcatcctgtagcctgttttgggcctcagttttcctgtctctgaaatgagtggcttgatggaaaggacctttagtgaccacgtgccttgcctcaattttctgagatggatttgatttcaaacattctgtcctcatgtgtacttgctcgggccacaggtcctgaatttgagagtctatcagtgggggtgttggtccatttgagcaggtccaggtgggtcagaggttttctgcagaggaattgaaagcgccacacctccttctttgctccttagctgtgtggtggatgagatggacttctcctccatggatctggatgatgcgctccggaagttccagtcccatatccgggttcagggtgaggcccagaaagtggagcgactcatcgaagccttcaggtgtgcctacctcccactcgcgaagctgcccctccctcctgtgggcatcgacgtagtatgtgtttataagtcacttctctgagcctcatactttcttcaccataaaacagagatgataaatcctatcttgcaaggcaattgtgaggatcagaggtagtgcatataaagtatctagctcagcctctgggacatgggcattcgataagtgacaacaacatcagcaataacagctaacattcacggagcacttactaggtatcaggtgcagagctgagcactttacatgattatttcaccgaataatcacaaccaccccataaagtaggcacttctgttattattcccattttacagatgagaaatcagaagtttagagaggttaagtaacttgcccaggctcatacagtgaataagtggtagaaacaggatttgaactcgtatgtgtctgagtccatgatccatccatgcccttaaccattttactgtactataaatgctttggagatcagatagactggggtctaaatcctggctctgccactttagggtatttagaagagaaacaggagttgctgagaacttgtttcccacaatgggggaaggatttgctttgcagtcagaaataactgggttttcatcctggcttcaccatttaccagctctattaccttgggcaagttacctcgccactttgagtcttagtcacttcatctgtaaaatgggactgccaatagctaccttgcaggattatgataggattacgtgaaacaacgtacataaatcccctggaagagctctgtaaaaggtagcgattgtgatttttacatgctggtctaggggaagctctgaagaggacagacccagagatcaagaaagtatttcttgcaggaaagggttgctggtgccagactgggtggatggtgggtaggcagagatggctggttcctgagtctggctttgacccctcctgccctgcagccagcggtactgtgtctgtaacccagccctcgtgcgccagttccggaacccagacaccatcttcatccttgcttttgccatcatcctcctcaataccgacatgtacagtcccagcgtcaaagctgaacgaaagatgaaactagatgacttcatcaagaacctgagaggtgacttccctgtcagcttttcctgcccttcacctggaaagggaaagtggggggtaaggggaaggatgcaggagatcccatctgttccttggaaattaatttgtgatgctgtcactttctgccctagctggatgttcccaggatattcacttattaattcactcaaatcgtcatttgcccattgtactgagcttctactgtgtaccaggtttctaggtcctggggttcaagcagtgaacatgatagattaaagtcctgactcttacaaggctttactctgattcattcattcattcattcagtaattcacttgtcctttcctcgctccttctttccctctcttatttatgcccatgaggactcatttaattattttaggtaccttttcctctattcatgcattcatttatcactcgaccaaacaaccagccagccagtcaacacttagcgcttagtgtgtgccaagccccatgatgggtgccaaggacaatggaggggaatctgccatactccctgttctgagagagctccctgtgtgtgggagaggctgacttgtagcacccagataactaacataagacagaaagtgaacagtgacatcagagaggccaaaagtgcagtcagagctcaaaggagggagagcccacctctagctagcttcctggaggaggtagtatttttattttaaggtgggtcttgaaggcatggagaaggtgacacaatagagatagaggagggcttacctagcaatgagaataccaaaggcgcagaggcaggaacatttattttctttagggaacaattgagggctgggtacgttggctcacacctgtaatcccagcactttgtgaggctgaggcaggtggatcccatgaggccaggagttccagaccagcctggccaacatggggaaaccccatctctactaaaaatacaaaaattagcaggcatggtggtgcacacctgtaatcccagccactcaggaggctgaggcaggagaattacttgaacctgggaggtagaggttgcagtgagctaagatcgcaccactgcactccagcctgagtgacagagcaagactctgtcttgaaaaaaaaaaaaaaaaaaaaagaacaattgagatgaggtcattgatgggttgggaaggtcccaatatatgaggttccaatatatggaaccaatatatgagggccttgaatgccagatgaaaggtgtcaccttgctctttttgcttattctactgatgtcgagccctgcctatcaccaaagagcagctactaaaaatggtacagatgttaagattatttaagcagaaaagaaagagggaaatagagtcaaagaaaaaaagcaaactgaacacaagacaaattggctgcccatcaggtttgtgccgctgtggctgctctggtaagaaagtcagtgcgatgtagtatgttcctttagcacctgtccaaggaggagatgtgacatttccaaggaagaaaacattttttttgttttctgtttttttattttatttgttttttttttttttatttttagagacagggtctcactctctcacccaggctggattgcagtggtgctagcagagctcactgcagccttgaactcctgggctcaagcgatcctcccacctcagcctcctaagtagctgggactataggcgcgtgccaccatgcccaactaatttctaaattttttgtagagacagggtcttgctaggttgcccaggctggtctcaaactccttgcctcaactcggcctcccaaagtgctgggattacaggtgtgagcctccacgtcctgcccagaaaacattttctctagtagaggatttagagagaagagtgagtgggtttcactcagcaatcagaagtggagaaggatggtgaacatgggaggagggagttagatcagaggccatttggagctgtctcctagaattttgccatcattcattcatccattctttttccctctctctctcaatatatgtgtgtgtgtgtgtgggtgtgtgtgtgtgtatgtgtaacttccccctctaattattaaataaataagcaaataaatgaaggtaatacatactttatttcagaaatgttggaagattcagaaaattagaaaatttctttttatcacccaaaatgtgccccctagaggcaatcatagttaatgttttggtgcgttctaatcttttcccccatgcatatgtaactttttatatagttcagatcataccacacatgcaatttatcttactcttttcccataatttgctactgtaattttctcatgctattgaaatgtttttgtaaatgtcaagtttttaatagctgtgcattatcttattaaatggatatactatcctctattgttaaaatttaggttgtttcaaattgtccccataagtaacacttagtgagttttttttttttttttttgagacagggtcttgctctgttgcctaggctggagtgcagtggtgcaatcatggttcactgcaacctcctcctcccaggctcaagctattatcccacttcagcctcccaagtagctggggccacaggtgtgtgccaccacacccagctaatttttgtattttttgtagagatgggattttgccatgttgcccaggttggctctcgaattcctgggctcgagcgatccacctgcctcagcctcccaaagtgctgggattataccacgcctgccctagcattcttttttttctttttcttttttttttttttgagacagagtctcaatcttgttgctcaggctggagtgcagtggcgcgatcttggctcactacagcctctgcctcccgggttcaagcaattctgcctcagcctcccgagtacctgggactacaggcacatggtgccatgcctggctaattttttgtatttttagtacagatgaggtttcaccatgttggccaggatggtcttgatctcctgacctcgtgatccacctgcctcggcctcccaaagtgctgggagtacaggcgtgagccaccatgccccgcctgcactagcattcttgcacatacctcttgcacatatttctgagtagttccttagggtagattcctagaagagaatcactgggtacaaacatttaggttcttgccaaattaccttccaaaagagttatgttaccatacatgcccacttccctgcactcttcctagcactggatttcattttaaattatttttgctaattaggaaggcaaacaatagtatctgattgttttaattacagtgtattctgagttgttgagaaaaaattccccactctggggaagatagcaactggctgttgtactgaaggacaccctccctgccccaatcctggctaaggggccgagggtacccattgaccctcagtcctgactatcgtggcccgtgcctgggtgtgggggtggtggagcacccctaccacccagtgcccataattatgtgacatatccctgtgttactccctcccccaggggttgacaatggtgaagacatcccccgagacctcctggtgggcatctaccagcgcatccaggggcgtgaactgcggaccaacgatgaccatgtgtcccaggtgcaggctgtggagcgcatgattgttggaaagaaaccagtaagtgccttgggaggctgcagaggggccagggttcaggtctgcctctgccactaagtggtaagtcactgcacctccctgagccccaggtgccctttacctgcaatacagagtgggtgataatgcattcctcagaaggctgtggtgcagagtgaatgcatcgagcacattccaaggcccatagtgggtactatataaatattagcatccttttcacctccggctttgcctgtccatcctaagtgaagagccaagctaatggttagcagaaaaccaaagtaagaacacactttaggccaggtacaatggcttgtgcctgtaatcccagcactttgggaggccgaggtgggtggatcacctcaggtcaggagttccagaccagcctggctatcatggcaaaaccctgtctctactaaaaatacaaaaattagctgcgggcgtgatggtgcatgcctggagttccagctactcaggaggctgaggcaggagaattgcttgaacccgggaggcggaggttgcagtgagctgagatcgtgccaacgcactccagcctggggccacagagcaagactccgtctcaaaaaaagaaaaaaaaaaagaaaacgctttagccaacaaacatttgtggatgcctttccactgagcccagcatttgctgggcaccagagttggtgctgggcattcatagatatgaatcagacgtgttctctatccttgggggcactcacagaccagtcggggtgtgaaacaaagacacatataatacttctgctttatggtccagtttaggagaggagaaaggagagagagaccattttcagcctggagaaatcagggaaggcttcttggaagagatcattttgggattgaatttttttttttttttttttttttttttgacatggagtttcactctgtcactcaggctggagtggagtggcatgatctcggctcattgcaacctctacctcctgggttcaaacgattctcctgcctcagcctcctgagtacctgggattgcaggcgcccaccaccacacccagctaatttttgtgtttttagtagagacggggtttcaccatgttggccaggctgatctcgaactcctgacctcaagtgatccgctcgcctcggcctcccaaagtgctgggattacaggcgtgagccactgcgcccggccgggatggaaatttgaaagggagttgaaatatgaccatgcagagctgggcaagaaagacattccagacagaagggcaaaggcaaggtagcagataagtttaggtcttagttgctgataccccttgtgtcagagtgacacacatgtatgagtggtaaacttcttgcggttgaaagttaaggtgccaggaggcctgaagctgatgggctggccttgctgacacctgtttcttcatgcctgtctaggtcctgtctctccctcaccgtcgactggtttgctgctgccagctctacgaggtgccagatccaaaccgcccccagaggctagggttgcatcagcgggaggtcttcctcttcaatgatctccttgtggtatgagcactgtgggggaggagatgggagggagagagtgagcttgacacctaagtctggtgtgaaccatattgatgtaggtgtgtggtgtgtggagtgtggcgggcgaggtgttctgccatgccatctgcatggtctcaggcaaggcccaggccttctctgcccctccttttcctcacagatgcatttggaggtagtaacagacacacagggacagaaaatatgaggaccaaaggagatgacagacttacaacctgggaagtggtaggaaatatccctgtccacctcaatagcccatagggttgtgtgaagaggggtgaacctgcgaccccccaggtcagtctggaaatcttcagtaatcaagatgcttgaagtgggctcggcactgtggctcacacctatagtcccagaactttgggaggccagggcagtttgaatcacttgagcccaggagttttgagaccagcttgggcaacatgtcgaaaccctgtctccacaaaaaatacaaaaattagccgggcatggtggtgtgcacctgtagtcccagctacttgggaggctgagtcgggaggatcacttgagcccaggaggcagaggttgcagtgtgctgtgatcgcaccactgcattccaacctgggcaacagagccagaccctgcctcaaaaataaataaataaataataaaaacaaaatttaaaaaagatgcttgggccaggcacggtggctcatgcctgtaatcccagcactttgggaggccgaggtgggtggatcacctgaggtcaggagttcaagaccagcctggccaacatggagaaacctcgtctctactaaaaatataagaaattagctgggcgcagtggcgcatgcctgtagtcccagctactggggaggccaaggcaggagaatcgcttgaacccaggaggcggaggttgcagtgagctgagatcgctccattgcactccagcctgggcgacaagtgaaactctgtctcaaaaaaaaaaaaaaaaaaagatgcttgaagtgattcttcaaactgagctcattacaagtagagatgtttgtcttttagggatgggactcttaggactttgcaggttggaagggactttcagggtccagcttcctagatggcccactggatgtatgactgcagggacagaaagccgccttcctctaaggcagccagttgccttgttaggcagctctgactgctagaatttgtctccctgtgggtttcttccagccatctgcactcaacccttggcatcacaaagaacaagtgttgtacctctgctccaagacagctctccagggatttgaggactctcttgatcctgttctccctgtggtcttctctcctttagagcagggtttctcagtctcatcactgttgacatttggggctggataattctttgcggggactgtcctgtgcactgtaggatgtttagcagcaccctggtctctacctactaggtgctagtagcaacccttcaaccaaaaatgtctccagatgttgctccgtgtcctctgggggcaatatcacccccagttgagcattgctgctttagccgaagtatttccatgctccctctgagccttagtttcctcctctgtgaaatggaactaacccctacttcacaggattgtcatgaggatgaaatgaaataagaggttatatgtggaatctgccctaccccagggagtacctggcccacacagtcaatgtgtagacatccctcaggtactgaaactggtgtatgtccagctctatgctaggcactgggtatgccaggatgaatcagacttagtccctgttctcagggagctcacagcccaaaggacctaaaaaagtgctttgcgtcattgtgccatcctgaaatcaaaacatttccttttacgagccacttgcagaccgcctgaggtgtttgcagcctgtgttagttgagtccagagtgcccaagtactcgacaaagatattgggttgttgagaggaagacttattaactctctacatgggttcagcagagattgccattaagtgcaggctctggtaaggcctggtgacagaacccgacaaccagactcctgccctccagtccagcagggggcgatcacacactcagaggactagcatagtgcctgacaagggaaaggcactgaatcaccattctggagctcagaaaaggggtttacaaatctctgtgggatgttggagcaggcttcctggaggaagcaggattcagttagtttctggaaatgtggtaaatgtctgtggtgcgtggtcattacatcaggaacttgcgttttcttccatgtctcccattctgtccctcaagcttccattctccccagcttgtgggcatgtgtgtttgtgtgtgtgtgtctgttaatggggtgggaggggagggtggttaccagaaataggtgccacgtggaaatcccccacccaaagcgctgcctcttgtctttttcccacccctgccaaaggtcaccaaaattttccagaagaagaagatcttggtgacgtacagtttccgtcagtctttccccctcgtggaaatgcacatgcagctcttccagaattcatgtgagtcccttcttggatcccagctcctgagagtctatgtcatggcccccatgctcacccgtcatctataccagctccagttttcggagtcccttacaaccggactaagggtctccaaagcacctacttggtcccaggatgaggggcaggccagggtggagtatgacttgggtctagcccctggttagctcatggtcttgcagagaaccacagtgcatgtgttctctggtgggccaaagagacggtgatcatgctgtgctctgaaggatgaaccaggaggagctttgttgcgtggtattcctggcagcagaagcaatgtgagttgaggcagaggtgagaaggaaagggtttcgagagagcagtgcatagttgtgtgcctttacatcctgcagtacagggagtaagagggccacagctaccaggagtttgagggctttggggcaaaggggagctgctaaacatgctcaagcagagaagaggcatgatcagagttagacagtagaaaaattatttcatgggctaggcatggtggctcacacctgtaatcccagcactttgggaggccaaggcaagaggatcgcttgagcccaggaattcgaaaccagcctgggcaacatagtgagaccccatctctactgaaaataaaaaaaaatctgcgcatgtggtgcgtgcccatggtcccagctacccaggaggctgaggcagaaggatcacttgagcccaggagttcaaggctgcagtgagccatgatggcaccactgcactccagcctgggtgacagagagatgttgtctcagaaaaaaaagagcagaaaagaaaaattattttatgtatgagccaccttgcaccagtcccaacagaggtgcccagtctcccctttctccacagattaccagtttgggatcaagttgctgtctgcagtacctggtggggagcgaaaagtcctcatcatcttcaatgcccccagcctccaggaccggctgcgctttacatccgacctgcgcgagtccattgcggaggtgcaggagatggagaaataccgtgtggagtgtgagtagcccagccatgtctcctccctgctctcctgaaacagtaccctgcagaaaccaagaatcctatcctcagagaatctcagagttgagggttagcttgtccaaccttcccatcctcatttcaagaattcttcagcctctgcttgaataccttcagtgacaaggggctcattacctcccaaccccattattatcctgaactctaattatgagccaactattccttctagtgaaaggtatcagggagaagaatcagagtattggaggtaggactatagttttagatcccaggtatactactcattatctgggtgaactgcagcaaattgcctaacctgccaagccccagtttcttcctatacgaaattggggtaatgaagtctccttcacagagtcatggagatgaaatgagacaaggtagccgaaatgtcccaacacatcttaggcattcaaaaaatccgtatttcctgtcccaccctctctcctcctctgcccacatatcaattcctgagctgaatcccagtgggctatcctctcagcccccaggggccacaccaagtcattttgatcatatatatataatggaaaatagtgattacatctcattcctcccgatgccctccaagttttctcttctccaggctaagcagtcacagttaagtaacatggtgttaaggagaaagaggcaggcagacagagacgaggcggcggacagctccttggtgaggccttcacagctccagggccactctacttctcagcgaggcagggatagaaatttcagttcaccagatcctttgagaccctggggaaatcctgagagagggattagtagcccaagacgaggggaggccagtagacacgtgtttctatgagctccgtggggaggtggggctgtaggaggccggaagcacccaagctctggaatcaggcagacctgcttccagaatgtcggctctgccatttccagctgtatgaccctgggcaagctctaagacttctcggatactcagtttcttcctctgcacaatgtggatgctaatactgacctcagaactgttgtgaggactgagagagatcaagtatgtgtagcgcccagcatactgcctggcacataataagaggatttgattcctgtcagtttcctgctcctgcccttccaggagcccctctgctccggagcaaggtatctgagaactgactgaactctggaaagattgccctttgccataggctagaagggccttaccatccttactgtgaaccatctgccatgaagctcttttttgaagggcaggggtgctttgggagacctgattgcaagagggcatgggaggggagaagtcagaagggtgaaaggaagggaaagggaacagggagagcaggcaccaagagggatgaagggaaggctgagcaggaagggagggtgcaagacaggagctgggcactaagggtgcttcggtgatggagctgcagttttgggggagacaagggctggtcgtccaaggggcaaaacacgaagcctggggacagagggagggaggagggaggaggaaggagaatggcccatggagggctagggtcagtcagatgggctctcactcctgttcctgacctttgctccctgtctccccgactgccacccagcggagctggagaagcagaaaggtatgatgcggcctaacgcctcacagcctggaggggccaaggactcagtgaatgggacgatggcccgcagtagcctggaggacacttacggggcaggcgatgggctcaaacggggcgcactcagcagttccctgcgagacctctctgatgcaggtaagccctctgggcccctgccctggctggggagacacgggaccgggtgtcctctttgcctcctgtcactggccgccagccttccctccacctgccacacatgcacgcaccctgccttcacccagagccctgggcgctgcgccacagggggcctgggagccaggtcagagcagggggagcccagcttttgggccagggagtgtgaagtggggccacagtcttggtccctctctctcgctgctccccctctcctcctcttctccctcttctgtctctcctgtacctccactcctccttctccatcttttcctcctctttctcctccttctccacctctcctcctccccgcctccccctcttcaatgggggaaagggataatggggtgtctgtccccgggaggggcccagtcctggtgcccagctctggagcccagcagggtagggggggggttgctgctctgacgctgggctccttgcttgtgggtgcagggaagcgggggcggcgtaacagcgtgggatcgctggacagcaccatcgaagtaagtgccagctcctgccccactcgtcctctgcatgagccctgccccggccatggagacccagaggaggaggggacctgttgctccccctcttccctgctgggaaccatgcggctgcctctcccagccaaccactctctccatctgtcctcaactctgtctgtcctcattctgcctgtctctcagtctgtcttccactctcccgtgccccctctcaaccccagggccgacggcgagtagggatgcccttggagttgggccacgagaagctcttacctccaagtcctgctctttgaccctgggcgagtcactctgcctctctgggcctaaccttttccctgcctgcaaaatggggatgaggaggaggtactgctaatttctcctctcccagctgaggctcagctgagatagtggatgtgacagccgagctttgcaagctggggagctccacatacgcgtaccggactgtgatttggtttttattacaacttggggtttgctgtctccccagctccagccctcagggacaggggtggaatttagggctgggggtttagggcatctagcctggcctgacttcccccctccccgcttccaggggtctgttattagcagtccacgccctcaccagaggatgccacctccgcccccacccccgccgccagaggagtacaagagccagaggcccgtctccaactcctcatccttcctgggctccctatttggaagcaagcggggcaaggggcccttccagatgccaccaccgccaacaggccaggcctctgcctcctcttcatctgcttcttccacgcaccaccaccaccaccaccaccatcatggccatagccacggtggcctgggggtgctgcctgatgggcagtccaagctccaggccctgcatgcccagtattgccaaggaccgggccctgccccgccaccctacctcccaccccagcagccctctcttcccccacctccccagcagcccccacccttgccccagctgggctccattccaccgcctcccgcctcagccccacctgtggggccacatcgccacttccacgcccatggcccagtcccagggccccaacactataccttgggccggccaggcagggcacccagacggggggctggaggacaccctcagtttgctccacatggccgccaccccctgcaccagcccacatccccactgcccctgtacagtcctgccccccagcaccctccagcccacaaacagggccctaagcacttcatcttcagccaccacccacagatgatgccagcagcaggcgcggctgggggccctggatcccggccaccagggggctcctactcccacccccaccacccccagtcaccattgtcaccacactcacccatcccaccccacccctcctatccacccctccccccaccctcccctcacaccccgcactcaccccttccacccacctccccccatggcccgctgcacgcctctgggccccctggcacagccaacccccccagtgcaaaccccaaggccaagccaagccggatcagcaccgtggtctgatgaatggagagagtgagctggggaacaggaaagtctggggagccacaggagagggaccttgcaccctctttgcttcctcggttttttcaaaaatatatatacacatag

SEQ ID NO: 4610 - DNA, 88464 bp, human; identical to SEQ ID NO: 3417

SEQ ID NO: 4611 - DNA, 88463 bp, human; identical to SEQ ID NO: 3418

SEQ ID NO: 4612 - DNA, 88464 bp, human; identical to SEQ ID NO: 3417

SEQ ID NO: 4613 - DNA, 88463 bp, human; identical to SEQ ID NO: 3418

SEQ ID NO: 4614 - DNA, 88464 bp, human; identical to SEQ ID NO: 3417

SEQ ID NO: 4615 - DNA, 88463 bp, human; identical to SEQ ID NO: 3418

SEQ ID NO: 4616 - DNA, 31156 bp, human
aaaagatcctgctgaggttccctctagagaggtaagcaggcattgaaatgccctgtcacggggaaagttcagcctggctgtttgaatgtttataatgggaatgcatttacattacaatgggatggaactgaatctgtgttattaaaaataaatgtttacaactgttaaatggaggtgggatgggggaggtaggcttccagggcagcctggtgctgtggcagccaggtcccatcatgggctgcatcctctgagactggaccagtccacacatttccagggcagcagccagctgcctcccatccttagcagtggcaagacttgctttgtcagcaaatctgactgcctctggttcagacccctggcagctttgcctttcctaatatcctttgtccactccccacctctcaaggacactggggaggaattttaggagtcggggtaggaaccactgtacctaggtccaatgctacctcttgtgaagcctttcctcacacacccactgaatgtgtttgaattaactgtgactgcctctttgttcccacaccacacaggttgctcaaacctctatgtagcacttagggtttgaccttttccagcctccttgttttgttaatttattagatcgtctattccctaagggtacacacagggtctctaattcaggcttggagaccctgacccccacctgtagcccacccagtcctcttgcccccatcttagggctttagcacttttttttttttttttgagatggagtcttgctctgtcgcccaggctggagtgcagtggcacaatctcggctcaccgcaagctctgcctcccgggttcacgcgattctcctgcctcagcctcctgagtagctgggactacaggcacgtgccaccacacccagctaattttttgtatttttagtagagatggggtttcaccatgttggccaggatggtctggatctcttgacctcgtgatccacccgcctcggcctcccaaagtgctgagattacaggcgtgagccaccacacccggccaacacttttgattccttttgcctttgtccctagctagctctttttgttattcaggtctcagctcctgtcaccttctctgagaacccttccttgactaccttatctaaaatagactgctttcctttcaaatcattctctatctcataactggtcttactttcctgatagcactcacctcaattggaaattctctgatttgcctcactttttatccgtctcccttgctggaaatgagtcacaggagggcggggacttgtctgttttgtttacccctaaatccccagtgcctaacagtaggtgttcaagaaaatatgtgaatgaaattcacatattaatgaaattttatttgatcattgactgtttccgccagtagactgtcagctgcatgcaggccagggccttatctggggtacctcaacatcctcagcacctagcacagtgcatgatgcatagtagattaataaagaactgttgggtgagggaattaatgttccacacacacctgaactcaacatagtccaaattaaatttagtctcctccccaccaaatctgttttctcttctgcgtagcccagttcattcagtggcaccgtcatctatgctgacactcaacccagaagtgaactcacacccctttcactcactcatctgctattatcagtttccaaacactgcctagtcaacctccaaaatatccaaattatctcatctttttctaccctttcccaaactatcctggaccaattttttccccccaacactagtgaaacagcctcattcctcctgactccttgtgaagctaagacatcttaaactgcaggacctgtcactttccatagggtcacatggtgatgtgttttataaagttcacaaaatacatttaaacaacaattggttcaaagtgctgtccctttccactgagggcctggccatactttcccttgcattaggtggtgttggagctgcctgacatttttgagatccacctaaggggaagttgatttgggggatatatttaggttgggtttcatgggatatttgttatttaaaaattcattttatttttattttgtagagacagggtttcactatgttgcccagcctggtcttgaactcctgggctcaagtgatcctcccatcctgacctcccaaagtgctgggattacagacatgcaatctgcacccggccccatggtacatttacatgtgccttgtatcacttctcttcgtaattattacccaggtgaaggaattgcttgtagaaatactcttactgcctacctttgaacctaattttgtattcataagtcattttttttttttttgagatggagtctcgctctgtcacccaggctggactgcaatgacacagtctcggatcactgcaacctccgcctcccgtgttcaagcgattctcctgcctcagcctcctgtgtacgtgggactgcaggcatgtgccaccacacacggctaatatttttatttttagtagatatggcgtttcaccatgttggccaggctggtctcgaactcctgaacttgtgatccgcccgcctcggcctcccaaagtgctaggattacagacatgagccaccgcgcccggctatttttttcttaaagacgtctcacccttcctcccccaaaccatataagcttcaggtcccattaaacctggacctttcagtgcagtggctcaggcctgtaatcccagcgcttttagaggatctgaaaccaggagtttgagaccagcctgagcaatatagcgaggcctgggctctataaaaaataaaaaataaccgagtgtggtggtgtgcgcctatagtctcagttactcatgaggctctggcggaaggaccgcttgagtccaggagttctagggtgcagtgagctatgaccgcccagcctgagttgacagagtgagaccttgtctctaaaacaacaaacataaaaaaaaaaaaaaaccctaaaccatcctctgggtaagtcacaaatatgagactaagctacccctgctcaaaaacctgtgttttctttttgctaactgcatacaatctaaactcttttgcatttcgcaatctttcatgttgtgaccctttactgtttgacctcctacctatctctcttctgttttccttgttccaacaatattcaacttctagtaaatatttttctatgtgcctccatgcatttgtacacgttgatccttttgagtacaatgttctcgcttgtttatttaagtgaacttaatcgtccatgtccccctgccgtctttcttacagcagctgcaagcagcttgtaaggctcttttgtagcttcatgttgcattttgcaaaggtcattttgcaggtggtatttgtgtgcttactgtgccttctattccaattgtttactcgcaactttgtttcctgcactggcagatgccctcccactccagaggccctgttttcaccattgcatccccagggcctaccccaccatcactggttagtaaattgtgtgcacgcacacatttcctttttaaagcaatgggaccctttaagaaaatgaaatagtaagataactcctagagaattttctagaatgtttgagaaaacctaggccatcttgaagcatatgtacgaagctccactaactcagcaaagctccactaactcagcctttcctctcatcccccctcctctcccctcccctcaggctatagtcagaaaattgtgggacaggtgcaaacaaatccttgaactgtatttgaactgaagtgaaacagtagggtcaaagaagagttcagagggagttgtggagttggcagcagctttacagaggaactacactgagggcctggggacagaacgcgggtagcacagggcacaaggttcaacgtccctgctccgggactcaagtcacttggcttctcgaagcccctgccttcatttggtgataatcacagagcttccttcacagggggaagaaccaacaacgcagagaccgtgggaaagagcccagcctatcgaaggtgctcaatgaacaggagccgcggtgagtactccgcctctaccccggctgaagcccgcccccgccgccacctattaattttgtagtttggagtcaccgagttcacctcctctcataggaggagaaggctggggaggaggagtgtgcgagtcggggtagctgaactccctgtttgcccggaggagggggaaggctaggaagtttcgggccccactcaaaatggagccaaacgtctgcctcgcctaagatggcggcttctccgcctctgggctcaaggtcttcagcggcgattgggcaccttaaagagacgagcgggtccaaaggtggctgagaaccgccctcctttctcaaggtggcgccccgcccccccgatgacgtcacccgggagccggcggctcgcggttccccgcctccgccgcgctcacctcgcgagtccagccctcataagatggcggtcgccttggttgtctgggtagcgccgccactctcaacatggtagctgtttatcccgtatttctcctcccctctccgcctcaacttcctcattgttttgaataaactttattgactactccgaattgcctaccaccgccactgggcttctcccagcgacttttcgggccgtgtgcctcggacgtggcggccggttcatctctttccccgttggtttgctcgcgagtatctcctgccggcccagcgacgacgccacttgcccgttcgccgggcggccgccagactaggcccaagccgcggtctccagtaggcccgaacggccgggccgaggggaatgttgtggaggaggctgctctgaagcaccgttgagcggctggcgccgcgcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctgtaagttttgggggctgcgaggctattactgtcagttttaggatatactgtgaggtacctgaacatttggggagactagggagctctcatcagtttgagggggggctgcaaggaaacgctgccagtttccgagcgatgcaaaagaatccttgcttagtttcgggagtgtgaggaaattctagtcagtttgaggggttttgaatagatccttttgagtttcagggatgcagccagaaccctgtcatctttaaagtacagaacgagctggtcagtttagagatttatatttatttcagttttgggggtgatgagactcctgactggtcggggaaggaatgatattgagagtgatggaaaggattatttaaactctccgaacacgaccccagaactgtgatttgagttgggcgcctagtcttgtctgtcttgttcgtgaaggctttgagtaacctgaagagactttcagggatcccttatctctctctggttggccctatttcaggtggtgagaggagggtcttgtcttgagatacccccagcctcatttttgacgctgtggtttgcgtcataatagagggagccctgtgaaacaggggtcagctaggggagggttcagtgagagatgaaagaagcttcccgaaaaggcttcaggtattttcttgaaacccggaaagaagttatcactgacaacggggccgaagaaggtggggggtggggagtggagagtgtgggggcggtgggaagcctggaaggttgagctccgttctttacgtgtgaaagaaattctaagggccgggtggactttctctggttgccccctacagccgcaccagctgtgttgcatcccggcggcggtaactctattggagaactgagggttggtgcaagggggtggggggcgggggctgattcactctgtaaaaagtgttatttgtgcctagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcaggtaaggagggcaggccaggctacacagggtgcggtggccaggtgtgttcacttgctctctcttcctttctcagctctgtttttagattccggctcaggaccccctctcccagactcaggttctgccatctctccttgcagaacaggacctagctgacattagcctctggtttctccttttcctgtgttttcccctatgtatttcttctttgcacttttcttttgagtgtttttttagatttataagacccccccccccttttctttcctgttacaaagaatcatttttatattcttctctattttattttttattttgttttatttttttcgagacggagtttcgctcgttgcccaggctggagtgcaatggcgcgatctcggctcacagcaacctctgcctcccaggttcaagcgattttcctgccccagcctccaagtagctgagattacaggcatgcaccaccacacccagctgattttgtatttttagtagagacggtgtttttccatgttgatcaggctggtctggaactcccgacctctggagatctgcctgcctcggcctcccaaagtgctgggattacaggcgtgagccaccgtgcccggtcatcatttttatagtctgacaattatgttctgcctcacacactggcttttgggaaaacagtgttgcttatttgaggtagttgagtccataaacagggatttaagttgtggctttgtacttagtttcagagtgaccatgcacaagttgctttgcttttctgagcctcattgtcttcagctataaaatgttatcaaatacatcctttctgactttgcaaagcagtttggatgtactccataaatggaggcagaaatggaagagtattttatttctacagcatttatctgcagcaccatccaactaaattgaattaagcagaatagatgctgggtaaaacaggagtaaaaccactgatgaatttccttcagttaaccgtgtgtgcacataagcacctgtcacccagaattccggagaggttagtgtgtacgataaaactaatatttcattaatgggatttaaatctcagctatggaaagacaaccttgagggggctttgtacactggagcacaacaaaacagtgtatggcaccctcctcctgttgcttgttagattctagaattttcagttgtctggtctcctccagaggggctatttctttttctttttttcttttttcttttttttttttttttatttgagacaaggtctcactcttgtcacccaggctggagtgcaatggcatgatctcagctcactgcaacctctgcctcccgggttcaagcgattctcgtgcctcagcctcccgagtagctgggattacaggtgcacgccaccacgcccggcaaatttttttgtacttttttgatagagatggagtttcaccatgttggccaggctggtctcaaactcctgacctcaagcgatccgcccgcctcagcctcccacagtgctaggattacaggcatgagccactatgcccagcaagctatttctgtttatcacactcaagaccaaactataggtgctggtgctgctaaaatcctgccctcagcagggactgcccccttgccccgtatccaaattcatgtttaactgatctctattgaatatttattgtgtgcccggcacagagttctgttttactgcctcatgttatttaagaggggacaaccctagagggtgggaccttttcctttgccctgaaaataagtggggattaagatgtctttcaggattcctggtgtctttgctagtgctgatcaagtcactcctcagcttaacattcttctttcagtggttcgtctctgggataaaattcagtatcctttatatgacagacaagaccttttgtgatctacttgtttattctcatttcctgccactcctcctctcttgttctttatgtcctagcaagactgaactacctatagttctgggaaaattttatactcctttatgcctttttgtctttgtacgtgcaaactcccactaatgccctctcccctttgcaactcacagactgtaaaaggtgtaaaagtccttcttcctcttggttcccattgcactttgtgtgcgtctttattaaaaagtaattatttaatcatatcatagttataaatatatctgtgtcattcgttagccagagcttcctgagggcagagatgtcttcttttcatttttggtatccccagaacctagttcagtgctaaacatgtaatagatgctgagtacatttttgaatgagttaatgagtcttcatgaaaaaaagctgttgcctggggcccttactttggattgtatgggaaatgtgtaggttcagacctgtaaaatgggctcctgctaactcctcactctggaaacagggaacaggaatgaatgcttcctgactgcttatgtctgccggaccccatgacagggacttgggacaaattatttagtctatatgcaagcctgaaagttggatatttctcttttaaataatgttcttaattttttcttgctcttatagtgagacctgcttgttgtagaaaacacagaaaaagaataaagaaggaaatataactcacctaagtctactactgtctggcacaatccactgttaaatttgttgttgcattaactcccatcttttgacttagaatataaacatatttttacaagatgggattgcgttataaataccattttacaacctattttttatttctagttaatgttacaatgtaattgccagttcattaaatattcagctaaacttgatttctgatatcccacaatatatatgtgtcaccggttaatttggtaatttcctttatggttggacattgtacttttttgaacattatttgtacttttttatattataaataatgtgaggaaactttgggcgttctggaaaggttttgcatcttgatatgagtgctgattaaaacaaaaacattatggaaagcatctttgcctagtagatacttgacatttatttataaggagcaccattgaggccttaaagaattctaaacttacaaatacagaaatgggcttatgggccaggcccctctttaatcacatttctgtggtgagttgtgtgtttctgtgtacactctaacacaagttaactgccttaatttttttccatgaaatacaccaaattttaaaaatctcttttgcttctctctatgggcccccactgaacaaggaagctagctgagaatcaggtccttgggggtggctgctcttgcttactcagtgcattgctcacagaaacacaccaggcttatagtgcgccatttaagtttgtacttcagcacaattggaaattactacatactgtggactttttatggttgcttgcaagagttaagccaacaaattttaaatccacagatacctagaggtgatagaaatctgttcatatctctagtgacttcttttttttttttttttttttgagacagagtctcactctgttgcccaagctgcagtgcagtggcacgatcttggttcactgcaacctctgcctcctgggttcaagtgattctcctgcctcagccttctgagtagttgggattacaggtgcgcgccaccacacccggctcatttttgtattttagtagagacagggtttcactatgttggtcaggctggtctcgaactgctgacctcgtgatccacccaccttgacctcccaaagtgctggtattacaggtgtgagccaccatgcccggcctctagtgacttttgtaggatagatttcttgaagtccagctagggattatggaatataatgccaagttactttttggaaaggttataacaagcgaggcaactattccattttgcagctgagaatctggaattcgtggaagttaagtgactttctgagtgtggatttgaactttgaattatttgattccagagcccaggttctcagaagtgcaaaaaacatggtattgcttcattcttcctgtaagaagctggattttgcaaaaacactttgatttgtacagcggtggttctcaaacttcagcatgtatcagactcacttggaagacctgatgaaacacaagttagggatgccctagctacagtatttctgattcagtaggtaagaagggcccacccttgagaaccactgatttagaacattatcctgtcttgattccttccccttctgcggagtgtgatagcttctgatactgagggatggatggactaacatatcattactgtacaccagtcattctctttttttggtacagaaaaattggaatgaacattctttttatattattcttttttaattcctaagtgagctaacacaggaggaacgaccttttttaaagtacagttcatcaactgggaatttgttcaaaatgcaatttcttgggctaggacttggactcagcagtctatattttaacaaacaagtgatcctgattcaccctaacatttgagaatcattgctgtacaatagtggagaaaactagttggcaagcatttattgatttctgggatttttagcacaaatttcactctacagttttcctgtttataaaagaaatattggttgatacatgcccaagggaataactttggtgtggatttttaactctagaggaaaggacactgatttcagatctgggttcaaattctgattctgttacatattagcaaataatttcttatctgtgaagccttagtttccctgagaggttgtgatgatttaaataaaatggttatagctatcgtttattgagcacaagctagtgttccactcactatgctaaccacttcgcctaattatctttatcttttgggggagttttaaaaattattccatttagtagttataggactattcaaattacctattttatgttggatgtgtactttccgagaattgacccatttcatctaagttgtcaaatttatgtttgtagaattgttcatagtatttctttattatccttttgatatcttcaggtgctgtagtgataattttgtttcattagtgatactaaaaatgtatcaggctgggcatgtgatgtcattcatgcctataatcccagcactttgggaggccaaggctggtggattgcttaagcccaagagttcaaaaccagcctgggcaacatggtaaaaccccgtctctacaagaaatacaaaaattagcagggtgggtggcacatgcttatagtcccagctgcccgggaggctgaggtgggaggattgcttgagcccaggaagttgaggcctcagtgaactgtgatcatgccactacactccagcctgggtgacagagcgagaccctgtctcaaaaaaaccgaaaacaaacaaacaaaaaaaatttgtcttcgtatttgtcagacttgctagaggtttgtcagttttatggatcttttcaaagaacaagctttttgtttcattgactttttctgttgtctttctgttttcaatttaatagatctctgcctttactatttttttcctcctttggtttattttgctctctatctagtttcttgaggtgggagattagattattgatttgagactttcttttctttttttttttttttttattttttctgaaacagcctgttgcccaggctggagtgcaatggcgcgatctcggctcgctgcaacctccacctcccgggttcaagtgattttcctgcctcagcctccctactagctgggattataggcgctcgccaccacgcccagctaattttttgtatttttaatagagatggggtttcaccatgttggccaggctagtctcgaactcctgacctcaggtgatccacccgcctcggcctcccaaagtgttgggattacaggcgtgacccacagcacccggcctttctttcttttctaatgtaagcctttagctgttaagtttcttctcagcaccaatagattttaatatgttacattttcccttttcatgtagttcaaggcattaaaaaaaaaaaaagtttttttttttttttttttttttttttttgagacagtgtctcagtctgttgcccaggcggtactgcagaggcaggatcatagctctcactgcagcctccagctcctgggctaaagtgatcctcctgctgcctcaaggcatttttaaattccccttgaaacttcctgtttgacccatgaagtatagaagtatgttgtttaattttgaagtttttgtagagtttcctgttatcgttctgttactgacttctagtttgatagtggtcagagaatatactttgtatgatttcaattcctttacatttattgagatttgttttatagcccagagtctatcttggtaaatgtttcatgatcactcgaaaagaatgtgtattctgccatttttgggtagagtgttctataaatgtcaattaactactgttggttaatggtgttgctgaattcttctaatccttgctgattttttcttttttcttttcttttttttttttttttttgagatggagtttcgctcttgttgcccaggctggagcgcgatttggctcaccgcaacctccggctcccaggttcaagcgattcttctgcctcagcctcctgaatagctgggactacaggcatgtgccaccacgcccagctaattttgtatttttagtagagacggggtttctccatgttcgtcaggctggtcttgaacttctgacttcaggtgatccgcctgcctcggcctcccaaagtgctgggattacaggtgtgagccactgcactcggcctactcattcattcattcatttatttttgagacagggtctctatgtcacctgggctggagtgcagtggtttgatcatggtttactgcagcctcaaattccagggcttaagcaatctcctcatgcttcagcctctacaatagctgaaactgcaagcatgtgccactgtgtgccctaatttttaaaattttttgtgtggggagggtgtgggtgtaggttggtggtacctccctttgttgcctgggatggtcttggacttctggcttcagatgatcctcccacctcagcctcccaaagtgctgggattacaggcatgaactactgctcttggcccgagttatctctgtattgcttttttcagtacttgctctaggtattacattatacatataacttaccataagcaactgctcttgacattttaccagtttgattgaagagtagaaactttacttttctttttcctttttttttttgagacagagtctcactctgtcacccaggctggagtgcaatgatgtggtctcggctcactgcaacctctgcctcctgggttcaagcgattctcccaccttagcctcccgagtagctgggactacaggtgtggtccaccatagccggctaatttttgtatttttagtagagacgagttttcactatgttgaccaggttggtctcgaactcctgacctcatgatctgcccgcctcagcctcccaaagtgctgggattacaagcgtgagccaccatgtccggttgaaactttacttttctttatatgccttaatgctcttttgtttataatctaattaatcgttttgttgttgttgagacagagtcttgctgtgttgcccaggctggagtgtagtggaacagtcacggctcacctgcagcctaaacctcctgggctcaagtgatcctcccacctcagccccccaccccccagtagctgggactacaggcatgcaccactatgcctggctgattttttttttttttttttttttttttgagacgaagtctcgctctgtcgcccaggctggagtgcagtggcgtgatctcggctcactgcaacctccgcccctccaggtttaaacaattctctgcctcagcctccagagtagctggaattacaggcgcccgccaccacgcccagctaattttttgtatttttagtagaaacggggtttcaccatcttggccaggctggtcttgaactcctgacctcaaatgatccacacgtctcggcctcccaaagtgctgggattacaggcatgagctactgtgcccagcctactcattcttttaggataagtgttggcaacagatacgtttagttttccttaatctgagaatatcttgatttcccttgaattcttaggggatcttttcacttcatatcgaactctgggtttctagttcttttatctcagcgcttgaaaactgttctgctacttccttttgccctccatggtttctgatgagagagcctctgtcattcaaattggtgttctccttgaggtaatgtgtcatttatctctcattgctttcaggatttttcctttgtcttttgcttttaggaatttgattaagccatgtcttagtgtggatttgttccggtttgtcttttgttgtagtcctgtaggttgctgaggctctgttcattttttttccaatctgttttctttctgttgttcagattggataatttctattgttctatcttcaacttactgattcttttctctgttttctccattctgctgttgaattttcatttaagttactaaagaattttcattgttactgtatttttcagttctaaaaattctgttagattcttttctatatcttctatttgtttgaagagattttctattttttgttgacactttctttttttttttatttgagacaagagtctagctctgtggcctagactggagtgcagtggtgcaatcttgggtcacttcaacctccacctcctgggttcaagtgattctcctgcctcagcctcccaagtagctgggattaaaggcacataccaccatgcctggctaatttttgctgacactttctatgtatttatttattttattatgatgatgatgatttttttctgagatggagtttcactctgttgcccaggctggagtgcaatggtgcgatctcggctcactgcaacctctgcctccctgggttcaagtgattctcctgcctcagcctcccgagtagctgggattacaggcacatgccaccacgcccagctatcttttgtatttttagtagaaatggggtttcaccgtgttggccaggctggtctcgaactcctgacctcgtgatctgcccacctcagcctcccaaagtgctgggattacaggcatgagccactgtgcccggcgacactttcaatttattcatttgtttcaggcatgttcttaattgctcattgaaacatttttatgatggcgcctttaaaattcttaaataattccaacatctgtgtcatctcagtcttaacatctgttgattttcttttcttattcgagttgtgattttccttgttcttggtatgacaaataattattttaattatattctggacatttggggcattatgtcacgagatcctggatcttatttaagacttctgtttttgcaggccttctcagacactgcgctccggtggcagaaagggggtaccacttcatgactgccaggtgggggtggaagtacaggttccccacttggtctttggtgctatccaccacctgctaggtgggtggatcctgctgtctctagtcggtctgctttcttcccttcacctttcagagttttatgtttgttttgtatatattgtccagggtttttagctgtacttggagggatagggaggagtgcatctacttcatattgttccagaaccagcagtgataggttaaataatgtgcccaaagctacacagacagctggaccacagatcaaacctgggtctcctctactttcactgtagaatacagtattatagacaatataagcactgtttaagttgttagaagttatggaagatagggaaaatcagatatgtgctatgtgccaggcattgttctggacaccggggtgggggaggggggatacggcagtgaacatgagacagtaaactaacagcttaatatatagtgtgtcaagtgataatacatggtctagagaaaagtaaagtagggtgagcaggagaaggagtaccaccccagggttgaagtagtggttactttatacaggatgattacagatgggttacctatgagcctgaaggaaagcgaggaagggaaccatgctggtaagtaggggaagagtgtttcaagtagaggacataaaggacccaagtggggagcagacctggcatgctaccagtccagtccaatgctattggaacagagtgagtgaggggagagtaatagaagctgaggttaagggtcaggggtgtgcagatcatatacagcagtgattttccaagtatggttcccagaccagcaggatcagcattatctaggaactgattaggccaattcttggatcccaccccagactgactgaatcagaaactctggagatggagccctagaatctgtggtttaacagcctttcagatgcacgctaaagtttaaaaaccatgggtatagggtgtaaggacttggtttttactctggatgggagccacagaagctttttgagcaagtgagagttgtgatctgatttaggttttggctcttgtgaggatagactaaaggtgaggagcaaggtagaagcagggagaatttcggggctactgtagatcattattccttaaagtgtggtccctggaccagcagcatcagcatcacctgagaggtcattagaaatgcacgtttataggcccaacccagtcctactgaatcaagatgtctggggatggggcctaggaatctgtattttaacaagcttaccaggtgtttctaatattccctaaaatctgagaaactttggtctagttaggcagtggtggcttaaagcagagtcagtgatgatgagaagtggttggattttgaatatatattgatacaggatttgttaatagattggattggggttgtggaagaaggaactcaagaatgactcaattttgaagaatttggtgtaaaggggactagagtaatggggcagagactgaggggatcacaaaagggttttttgtttgggttttttttttttttggagatagaacagtctgtctgtgtgcatgtcagtgcatatgaagttattccgttggtgcatccagaattcagtgaaacctgttatatgacaaactcataaaggagacacttcctaggtacgctggaacttgctgtgtcctttgcattcctttaagtcctgtgtgcctggagttggaggggtggggcggtgggaatggtggatgcttcagcttctggttttatagatggtgctctgtctggacctggatccttgggtaccctcagaaggcagaggttgaggagataagaagccagacaggatcttgagcaaaatcatcatctctcaggcatctccaagtctcagctcccactcagttccacatccctggaagagttgagtgtccattttggagtgctcataacacttgactgtattaatcaccccacattatatcctggttacatattgtagtgatatagtagagtcacaaagtcctgaatttgtatcctgctctgctacttagtagttttgtaattgccaacaatttacttaaccactcagacccagatttctcatctgttagattaggataatattaacgatgatgatgatgatagctaatacttaacatgtgccaggaactttaagtacttaactattttagctcatttaatcctcttaaccaccctgtgaagtgggtactattagtacttccatttcacagatgcagaaactgagatgcagaaaggtgaagtataaattgcttaagttcacatagctagtgagtggcagaggtgagattcaaacccaggcagtttggctcctaagcctgtactttaaacctctgcttctgtgtttaatgtctgtgaatgttgtacggaaggccctgatttgttgtggagattaaatgtgataatatgtgaagttcatagctcagtttttttctcagtgccttttatgctaacttcaaattcattcactcactatcctgttaccttgctttactgactttatagcacttacgaaactgttttgacactgcctctctgtctcccgctctaaaatgtccagtccatgagggcagtgtctgctcaatcaatatttgttgaatttatgcactcatttacttaacaaatactgcttaccgtgtgcttggctttgcagtataccatggggataactcatcttaatcacaagacctggtgctataataattatcctcttgactaaggaagctactcagagcaaatcagcatttaccacccttggtcccaggtggtaactatcgagacagtgcagccagaagcccgatttttcatttgtctgcctccctgatatgaggagttgtctagcacgttgatgtttgttgaataataagtaaggcaagactgagagatgggaaaggtgaggacttttggtaaataagatacactatctggcaaatgtagtggggacagacagcaggtaagtgagcaattccaaggcctcgtggtgaaggctgaaatagggatagtgttgtgggggtgccacagcagcagggaaaaggaagagcaggaatgttccaggtagaaggagatacctgtgatgaaacccagaggctagagctagacagagtatggcaccgagagtccgctggctttttagagcagagctggcttcatgggtgtgcaatcgttatagtcacatggtgccccatgcctgaggtttaatgttctgtggtggttgtcttgaaattcttaataattttgcctttgattttgtgattggtatgtgatggaacaatggagtgtgcgctggggatttaagagtcttggctcatatgtggttctacctcctgctgccattctacctccccgaacaggttcttggctagctgcctggggcactgggcccaggtgcaggtgtggacagagtcggttgggttcatgtaccctgtgtactaagtcaccgggcagggccccagggtacttgtgtgggcctgcactcgccccttgagttatccctatacccaagggagcgtgacagtaaatagcatattaaaactgcatggtaagttgagagagagaccatggaagaaaggaaaaagcttttctattttttgaacagggagctcccacttttcatttccattaggccccacagattgtaagtgggctatgcagtaggaatgtctcccccagcatacgctgtgtgtgaggggaaagacgtgagctcagccagagaggcaaggccttttgggccatggtaagtttatactttaccttaggaaaaatagggaccctgtgaggcattttaagcatgggttgataggatcaaatttgtgtttttaaatgatcactttggctgtagtgtggagggccgattgggtagggacagaataggggccaggagtccagttaggagggcaggacaataactgagttagagataatagtggcctgaactagcgcaggggcagtaaggatgacaaattaacacaattgatagctaataaagagagttgataggacatgctgataacttggataataacaacaaacatacacagcacttactatgggccagacactgttctaaacactttctatatatttagttcatttgcttttgataacaaccttgtgaagtaggtacagtttttatccccatcttacaatgaggaaactgaggcacagagaggttaagtaacttgtccaagatcccacagctagtaagtggcacagccaggatgcaaacccagagaatctggacctaaagtcagtgttcttaacttgatgctagaacgtctacttcagggtatagtggagggagagggctagaggtgaatcagtgatggctgccaggtttctggcttgaatgcctggtgaggttatggagccatttgcagaagtgggaaacctaagagaagggagcatgtttaggtgacagacagaaggagaaactgagtttggacatgttgaatttgaagtacgtaagtggctatccagtagaaatgtctcacccaggagacatttggagggaagggtctaatctggcttggagttatgagtgcatagagggcacatggagccctgggagtgagaacagtgaggaaaagtgaggagaaaagagtgcccaggtaagaggacctaagaaacttcaacatttaaggactgggcaggagaaaaagagttcatcgggaaaaaggaacagccaaagacatgattaaaatcacatcacatccctactcatagtggctgttactccccagttcttgtggctacccaggaaaagccagagtgctttacagtggcctacaacaccctactacatgagtctattgcctttctgacttattactgtcctcctacctctctactctagaacactctcctcctctctgctaccttcggagtctagggatgctcccaccacagggcttttgtacttgctgttcttattgggatgctcttccttcatagccacatgaggggcttgctcccttactccctttgggtctttattcaaaagccattttgtcagtctttccctgtcttccctatctaatatttcaccctcactaccattcttcctggcccccccattgtgtgtgtgtgtgtgtgtgtgtgtgtgtgtgtgtggtgtgtatagttatatattcacacatacatattcctctatatcccccttcctgtttttttttctacctaggtcttctcactatccagcatacaatgtgtttcaccaattgcattgatttatcttgtttcttgtctgcctccccactagaacatcagctctatgagggcagggatttttgtatgctttgttttttgtcttcgtctcaccagcacctagaccagagcctggcggatgctcattaaatgtcagctgaaggaatgggcaccagccagatgggacgttatagaagtcaaggatagagagcttgtcaggtggagagtgtacagggttggcagggcgaaaatggtgctaagaggttaagggagataaagcagagaagtacttattgcatatatcaacaaggaggtcaggaaaccagtgagatctattttaaagaaggtggggactaagatcagactagcaggagatgaatcacaaagtgcatatagcaaccctaaaaaagtatcgatttggctctgatagaacacctctggatactactaggcagctaagggtgggagggagactttttactgtatatacttctgtactctgagttttgcaccatgtacagctgttacttattcaaaagaggagtcattatcaagcttcgtaggtttatttacttcatttttaagctgcataggtttaaagaaagaatgtgtttggctgtgaaggggcggacagaagggagggaggatgggagggcgggtaggtcttggttttttaatttgtaaacatcaatagacttgtttaaatgctattgtgaagagaaagagagagattgaagatactgcagaaagaaggaataattgattgagaaggtaagaaaacatgtgacccaggtggaaaacttggctttagaaggaaggaaagatagtacttttgttgtgataggaaaaaaaggatgggtgtagaaggaggtagattggtgatgagaagttaaggtagttcacctctgattacttaattttctctaagaagtaggaagtgcatcgcttcttggtcttttggctaagatcaagtgtagaagtaggaagtggctggcatgatggctcacacctgtaatcccaacactttgggaggctgaggtaggaggatcacttgaggccagaagtttgagaccattctgggcaacaaagcaagaccccctctctataaaacacacgtacagacacaaattaggtgggcgtggtggtgtgtgcttgtagtcctagctacttgggaggctggggcaggaggatcacttgagcctaggagttaaaggctgcagtgaactatgattggcaccactgctctccagcctgtgcaacccagtgagaccctgactctaaacaaaacaaaacaaaaacattaaggaactcaaagaatgaaagcaaagagtgcttaacaacaacaacaacaacaacaacaaaagccaaaaccaaaaaccagaagtagtaggaagcaaggtaatttttgagagagaagaggcaggtagtggggtgagagatttgacacagccacagtagataatgagagagagttgagtggggaatttcagaaggattgtcaggcagcatgatccagatttttttttttttttttttttgagatggaatcttgctttgtcgcccaggctagagtgcagtggcatgatctcggctcactgcaacctctgcctcctgggttcaagctgttctcctgcctcagcctcctgattagctggaattataggcgcccaccaccattcccagctaatttttgtattttaagtagagatggggtttcaccatgttgaccaggctggtcttgaactcctaacttcaggtgatccacccgcctcagcctcccaaaatgctgggattacaggcgtgagccaccgtgcctggccaatccaaatattttggacagtgaatttatgatggcaccaatccaatgggttatttttctctagccacatctagtggtctagagttaggtagttgtactgagccagggttagggtttgcatatggggatgaaaggcagtggggcaagtgagggtatctgtaagagaatgattgaagtgaggaatgctggaatctcaactagatagggaaggagggtaaagtcaagaatgtgtgaataggtgaaaagtatgaggataaagagttttgagggcaaagaacaggttgtagtgaatgagagctggatagatagacttgtggtcagagagggcgatgtatgagtttcatattccagaggtacagcagttgctggtgttgacagggtctgggggatggtcatgagagttggtagctgaaatgggagtagaggtaacagtctctgaagatgagaagatcaaagaactaagtgcctggaatgttgtgtctccagatggatactgatttcatgtaggatgttgtcaggactcgggatggggaagatctgagcaggttcttcagcgagtgaaggggtgtgttggggagatgggtatgtggcagtgatgaagaggagtaggaagtggtatggctggatggtgtggaactcagaggagtgggagctcttacacaagggtagaggagagatgatctggaagtctcaccagagagtgagagggatggctacccacaacccagtcctgagttatgagggtatgggagaatgtgcagctataagggctctagcacaatgctgcttagattttctgtggcaaagaaccaaggcacttttaaaatttccaatctataatgggccgatccttttatgatataaaaaaagaattactagaaaaaaatggtatgaaccggccgggcgcagtggctcatgcctgtaatcccagcactttgggaggccgaggcgggcggatcacgaggtcaggagatcgagaccatcctggctaacatggtgaaactccatctctactaaaaatacaaaaaattagctgggcgtggtggtgggcgcctgtagtcccagctactcgggaggctgaggcaggagaatggcgtgaacccaggaggcagagcttgcagtgagccaagatcgtgccactgcactccagcctgggtgacagagcgagactctgtctcaaaaaataaataaataaataaaaatttaaaaaaatggtatgaaccaaaagacatataaaagacaagcccaaaattttattcttagattgaacggatataaaattattctgttaaattgctgtaaaaacttctgcataatagtgatgcttactcttactttctgtacttaccacagacctgtagtaaatagttcacagaccggcattagtctgtggaccacactttgagtggcaccggtgtagagaaaatgattttcccgtaggagaagctgcattcagttaagcctggaaggtgaaggagtgtttgttgaagagagtgccaatgttgagcagtttgtttaccaagttgggaaaggggatgagcagcgggtgtttagagtagagaaagcacatagccacatagggtgaaagtttaggggagagagaggtgtccagagggaacaggggtatgagatagaaagcatgcagtccagggaactgagttaatgctacaaggtctggggaatatctttgaagaagttttaggcaggtgaaaggtgaggtccggactggacttctagcacttactgtgaaaccggatacttactgtgtatcagactttatgctcactgtgctacacacattagtattatttttgtagagatggggttaccctatgttgcccaggctggtcttgaactcccggcctcaagcgatcctcccactttggccgcccaaagtactgggattacaggtgtgagctaccgcgactggccatgctgtgcactttatatacattatcttattgaatccttaaaaaccctacaaagttgatggtgatatccctagtttattgataagctgctggtttataggcatgagattattagttgggaatatatttagttgggatattgggaagattattagttgggaagtcctaatcccaggaagtccatttatgagcatgatcttggctgaaacaacttgagctctgccttaatgttctctgctgtgtgtggtaaaccaaacattttaagacttgggtcttctttttttttttttttttttttttggagacagggtcttgttctgtcacccaggctggagtgcggtagcacaatcatggcccactgtagcctcaatctcctgggttcaagggatcctcccagctcagcctccatgctcagctaaatttttttgtttgttttggtagagatgggggtctcaatttgttgcccaggctggtcttgaactcctgggctcaagtgatcctcctgcctcggcctcccaaagttctgggattataggtatgagccactgtgactggcctaggtgtttaattttagcaagaatttatttggagggctgctggtgccttccctagtaagggaaggttgaattttgtgagattaccacctcatatacatgcaaagtcaaattttcaaaattaagtaaatctttttaagtctttaaaatgtgaaataagcaacagatgtttattgtaggaaattagaagcacagataagataaaaaggattatctgtaatttttcatttagaactactgttgactataaatttttttttttagtctttttcgtttaataaagtatctcaagtttaaaaattaggttataaggctgggcgtggtggctcacacctataatcctagcacttcgggaggcagaggcaggtggatcacttgaactcaggagtttgagaccagcctggccaatgtggtgaaacctcgtctctactaaaaatacaaaaaattagccaggcatggtggcacatgcctataatcccagctaattgggaggctgaggcaggagaatcacttgaacccaggaggcagaggttgcagtgagccatgatcacaccactgcctaatacagtaacccctaaccacatgtggctgctgagcgcttgaaattttaaattttatttaattttaatggatttaaacataaatagccacatgtacttaatagctgttctactggacagcactgttctagacctcataaaaaataaaatttccataaaccttggctgtttttctctttttcagttgtgttggtgttgaagaggagaaggctgctgacattgacctctaccactgccccaactgtgaagtcttgcatgggccctccattagtaagtagatcttagggtttcctagagaagacaatccagaggagagacaaaggaaaggaaatttgggggagtgattgcttttgcctgagcacttgtgattcttcttcctcaggaaatagcagaagcctatgcaggctccacaggccagcacctatctcactaagaggacagaagttcataacttcacctccctcccttcctaaggcttatctagagaaagtacccatccatcttcaccaggaactttcctgaatctgtgagggcctcattgactccagatgctccaaggggtggttagattggaagagaaggatctgctgaggcctttgttcttggtatcatagctcatgaccgttctgactcacaatctctcatgtttttctggcttagtgaaaaaacgccgtggatcttcaaaggggcatgatacacacaaggggaaaccagtgaagaccgggagccctacgttcgtcagagagctccggagtaggacttttgacaggtgaggaaccctgcctccagtggctggtgaatgccagggctctgggaagctggaactcacctcttcccagctttcccagtggctgtcccattaggagcttccccagtttgtgagtatcttcagggctctgcaaattccttctggtttggtcaattcctggaaaacttctggtagttgggaggcagtattcacctaagttagatacttacattcatccaaggaatgctgactagaaggagtcttaggatcagaaagtttaattctctcatagagaagaagaaactcttttaatataaaaaaattattggtcatatatctcttttatgatcgaaaagaggttttatctttttaaaattaagctggccttgttaaaagtaaattacatgaaataagcaaaaataatgagttaaaaaaaggaacaaagcattctcctttgcttggttttttaattcagtagaccatgttcaggttttttaaaaataattgcaactggccgggcgcggtggctcacgcctgtaatcccagcactttgggaggccgaggcgggcggatcacgaggtcaggagattgagaccatcccggctaaaacggtgaaaccccgtctctactaaaaatacaaaaaattggccgggcgtagtggcgggcgcctgtagtcccagctactcgggaggctgaggcaggagaatggcgtgaacccgggaggcggagcttgcagtgagccgagatcccaccactgcactccagcctgggcgacagagcgagactccgtctcaaaaaaaaaaaaaaaaaaaaaaaaaaaaaaaataattgcaactttgattttagattcaggaagtacatgtgcaggtttgtttacgtgggtatattgcatgtgtgaggtttggggtgcaaatggtcccatcacccaagtagtgaacatagtacccagtagctagtttttcagccccttccctactacctccctcccaacttgagtggtccccagtatctattgttcccatctttgtctatgtgtacccaatgtttagctcctacttaaaagtgagaacaaaagcagtatttgattttctgttcctgcattaattggcttacgataatggtctccagctgcatccatgttactgaaaaggacatgatttccttctgttttatggctatgtagtattccatgatatatatgtaccacacttttctttatccattccactgttgatgggcacctagtttgattccatgttttactattgtgaatagtgctgcagacatatcagtgcattcgtctttttagtagatggtttattttcctttgggtgtaaatccagtaatgggattgctgggtcgaatggtagttctcttttaagttctttgagaaatctccaaactgctttccatggtggctgaactaatttacattcccactaacatggtataagtattccctttgctctgcaggcttatcaggatctgttatttttttttttacttcttttcaggttttctgtaaccaaagtgttaattggaataagtgttccttcaacttaatgtttcttgttttatttgtttatttaaaggcagaaacttctcctctctactctggactcctcaggttctttctccaaagtcaacccgttatttgtagatcctttcagaaatggtttttgcatatacaaacatagatttttttaattcctttttttgacacaaatggaaacaactatatattgttctgtatcttgcttttttttaaaaaaatatatatttgagatcaatccataatagcacatacagatgttctttttcatggctgtttaatattacattgcatggtgtaacatttatttaaccagtcctctactgagggacgtttaagttgattccagtattttgctattagaaagaaatactgtaatgaatatctttgcacttaagtttttgcatacgttgccagttacatccatagtggctataccatttcacactcccacagataatgtgcggagggtgccgattttcctatatcctagccaatatttgtttgtttgtttgttttattttatttatttatttattttgagacgatgtctcgctcttgtcccccaggctggagtgcaatggcgtgatctcggctcactgcaacctccgcctcctgggttcaagcgattctcctgcctcggcaccccgagtagctgggattactggcgcctgccaccacgcccggctaatttttgtatttttagtagagacggggtttttaccatgttggccaggctggtcttgaactcctgacttcaggtgatccacccgccttggcctcccaaagtcctgggattacaggtgtgagccaccgtgcccagccaccaatattatttattatcaattttttttttgcctttctgataaaataaatcgtgaaatcctgctgttcccacttgtacttcttttctttctttcttttttttttttttttttttgaggcggtgtcttgctctgttggctaggctggagtgcagtggtgcaatctcagctcactgcaccctccgcctcctgggttcaagcaattctgcctcagcctcccaagtagctgggattacaggcacgtaccaccatgcccagctaatttttgtatttttagtagagatggggtttcaccatgctggccaggctggtctcaaactcctgacctcaagggatctgcccaccttggcctcccaaagtgctgggattacaggtgtgagccactgtactcagctcacacttgtatttctttaattatgaaggaaataagtagattttttttttgagacagggtctcatttgagacaggctggagtcgggtggtgcaatcaccactcactgcagccctgacctccctagcttaatccatcttcccacctgcgcttcctgggtagctgggactacaggtgtgtgccaccacgcccagctaattttttttttgtattttttgtagagacggggttttgccatgttgcccaggctggtctccaactcctgggctcaaacaatctgccttccttggcctcccaaagtgctgggattacagttgtgagctattgcactcagccttagatttcatacatttataaaccagcttgattgttttctctgtgaactacttgcttgttttataggcattctgttgtgttactattactgatttataacagctttcttggagaaaattttaatttctatatggttaagtttattactatttttaatgactgctgggtttttcccaggtttttctactcttaaagctttattttttggaatttaatctttggaccatctaggattatgtaaagaatgagataggcaggccaggcacagtggctcatgcctgtaatcccagcactttgggaggctgaggcgggcagatcacctgaggtcgggagttcaagaccagcctgaccaacatgtagaaatcccctatctactaaaaatacaaaattagctgggcgtggtggcgcatgcctgtaatcccagctagtcgggaggctgaggtaggagaatcgcttgaaccctggaggcggaggttgtggtgagccgagattgtgccattgcactccagcctgggcaacaagagcaaaactctgtctcaaaaaaaaaaaaagaatgagataggcattgagcttgagcttaatatatttgtcccaacacaagttgtcagagttgtcaaatacaaatctttcctccaccatgatttaaaagaaaactattttctgcaccatgatttaaagaaaactattttctttcttttctttaaaaaaaaaaaaaaaaaaaagacagggactctctctgtcacccaggctggagtgcagtggcatgttcaaagcccactgtaacctcaactcctgggttcaagtgatcttcctgcctcagcctcccaagtacgtaggactgtaggcctgcaccaccatgccctgctaattttgaatttttttgtggagacgggtttagaaatgatgcccaggctgaaactcattaagtatgcacgttgagaaagttgttgtatatgcatgttgagaaagttgttgtaaaaatgttgttgttttgtttaaatcagtcttttctctttgacagtgttttaaattgggtaatgctgctcttggtttgaacaaatctgtcaaacttgtcagatgtgtcttttctttctggccaggctgttgactgatttcttcttgtcacccagagaagagcaccatgttggcagaatactccccacctctgccagtgacctggtctcttgccttggacagatcatttcttccctggcagatgaggtttttggcattagttgccagctcacattaagtcccctcataaaaaccccacctcttgggtgagtggcagcctccaataaggcctttagtgggcagggcctcaggctcaagctttctctcctgcggcccacagctcagatgaagtgattctgaagcccactggaaatcaactgac

SEQ ID NO: 4617 - DNA, 26291 bp, human
gcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctgtaagttttgggggctgcgaggctattactgtcagttttaggatatactgtgaggtacctgaacatttggggagactagggagctctcatcagtttgagggggggctgcaaggaaacgctgccagtttccgagcgatgcaaaagaatccttgcttagtttcgggagtgtgaggaaattctagtcagtttgaggggttttgaatagatccttttgagtttcagggatgcagccagaaccctgtcatctttaaagtacagaacgagctggtcagtttagagatttatatttatttcagttttgggggtgatgagactcctgactggtcggggaaggaatgatattgagagtgatggaaaggattatttaaactctccgaacacgaccccagaactgtgatttgagttgggcgcctagtcttgtctgtcttgttcgtgaaggctttgagtaacctgaagagactttcagggatcccttatctctctctggttggccctatttcaggtggtgagaggagggtcttgtcttgagatacccccagcctcatttttgacgctgtggtttgcgtcataatagagggagccctgtgaaacaggggtcagctaggggagggttcagtgagagatgaaagaagcttcccgaaaaggcttcaggtattttcttgaaacccggaaagaagttatcactgacaacggggccgaagaaggtggggggtggggagtggagagtgtgggggcggtgggaagcctggaaggttgagctccgttctttacgtgtgaaagaaattctaagggccgggtggactttctctggttgccccctacagccgcaccagctgtgttgcatcccggcggcggtaactctattggagaactgagggttggtgcaagggggtggggggcgggggctgattcactctgtaaaaagtgttatttgtgcctagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcaggtaaggagggcaggccaggctacacagggtgcggtggccaggtgtgttcacttgctctctcttcctttctcagctctgtttttagattccggctcaggaccccctctcccagactcaggttctgccatctctccttgcagaacaggacctagctgacattagcctctggtttctccttttcctgtgttttcccctatgtatttcttctttgcacttttcttttgagtgtttttttagatttataagacccccccccccttttctttcctgttacaaagaatcatttttatattcttctctattttattttttattttgttttatttttttcgagacggagtttcgctcgttgcccaggctggagtgcaatggcgcgatctcggctcacagcaacctctgcctcccaggttcaagcgattttcctgccccagcctccaagtagctgagattacaggcatgcaccaccacacccagctgattttgtatttttagtagagacggtgtttttccatgttgatcaggctggtctggaactcccgacctctggagatctgcctgcctcggcctcccaaagtgctgggattacaggcgtgagccaccgtgcccggtcatcatttttatagtctgacaattatgttctgcctcacacactggcttttgggaaaacagtgttgcttatttgaggtagttgagtccataaacagggatttaagttgtggctttgtacttagtttcagagtgaccatgcacaagttgctttgcttttctgagcctcattgtcttcagctataaaatgttatcaaatacatcctttctgactttgcaaagcagtttggatgtactccataaatggaggcagaaatggaagagtattttatttctacagcatttatctgcagcaccatccaactaaattgaattaagcagaatagatgctgggtaaaacaggagtaaaaccactgatgaatttccttcagttaaccgtgtgtgcacataagcacctgtcacccagaattccggagaggttagtgtgtacgataaaactaatatttcattaatgggatttaaatctcagctatggaaagacaaccttgagggggctttgtacactggagcacaacaaaacagtgtatggcaccctcctcctgttgcttgttagattctagaattttcagttgtctggtctcctccagaggggctatttctttttctttttttcttttttcttttttttttttttttatttgagacaaggtctcactcttgtcacccaggctggagtgcaatggcatgatctcagctcactgcaacctctgcctcccgggttcaagcgattctcgtgcctcagcctcccgagtagctgggattacaggtgcacgccaccacgcccggcaaatttttttgtacttttttgatagagatggagtttcaccatgttggccaggctggtctcaaactcctgacctcaagcgatccgcccgcctcagcctcccacagtgctaggattacaggcatgagccactatgcccagcaagctatttctgtttatcacactcaagaccaaactataggtgctggtgctgctaaaatcctgccctcagcagggactgcccccttgccccgtatccaaattcatgtttaactgatctctattgaatatttattgtgtgcccggcacagagttctgttttactgcctcatgttatttaagaggggacaaccctagagggtgggaccttttcctttgccctgaaaataagtggggattaagatgtctttcaggattcctggtgtctttgctagtgctgatcaagtcactcctcagcttaacattcttctttcagtggttcgtctctgggataaaattcagtatcctttatatgacagacaagaccttttgtgatctacttgtttattctcatttcctgccactcctcctctcttgttctttatgtcctagcaagactgaactacctatagttctgggaaaattttatactcctttatgcctttttgtctttgtacgtgcaaactcccactaatgccctctcccctttgcaactcacagactgtaaaaggtgtaaaagtccttcttcctcttggttcccattgcactttgtgtgcgtctttattaaaaagtaattatttaatcatatcatagttataaatatatctgtgtcattcgttagccagagcttcctgagggcagagatgtcttcttttcatttttggtatccccagaacctagttcagtgctaaacatgtaatagatgctgagtacatttttgaatgagttaatgagtcttcatgaaaaaaagctgttgcctggggcccttactttggattgtatgggaaatgtgtaggttcagacctgtaaaatgggctcctgctaactcctcactctggaaacagggaacaggaatgaatgcttcctgactgcttatgtctgccggaccccatgacagggacttgggacaaattatttagtctatatgcaagcctgaaagttggatatttctcttttaaataatgttcttaattttttcttgctcttatagtgagacctgcttgttgtagaaaacacagaaaaagaataaagaaggaaatataactcacctaagtctactactgtctggcacaatccactgttaaatttgttgttgcattaactcccatcttttgacttagaatataaacatatttttacaagatgggattgcgttataaataccattttacaacctattttttatttctagttaatgttacaatgtaattgccagttcattaaatattcagctaaacttgatttctgatatcccacaatatatatgtgtcaccggttaatttggtaatttcctttatggttggacattgtacttttttgaacattatttgtacttttttatattataaataatgtgaggaaactttgggcgttctggaaaggttttgcatcttgatatgagtgctgattaaaacaaaaacattatggaaagcatctttgcctagtagatacttgacatttatttataaggagcaccattgaggccttaaagaattctaaacttacaaatacagaaatgggcttatgggccaggcccctctttaatcacatttctgtggtgagttgtgtgtttctgtgtacactctaacacaagttaactgccttaatttttttccatgaaatacaccaaattttaaaaatctcttttgcttctctctatgggcccccactgaacaaggaagctagctgagaatcaggtccttgggggtggctgctcttgcttactcagtgcattgctcacagaaacacaccaggcttatagtgcgccatttaagtttgtacttcagcacaattggaaattactacatactgtggactttttatggttgcttgcaagagttaagccaacaaattttaaatccacagatacctagaggtgatagaaatctgttcatatctctagtgacttcttttttttttttttttttttgagacagagtctcactctgttgcccaagctgcagtgcagtggcacgatcttggttcactgcaacctctgcctcctgggttcaagtgattctcctgcctcagccttctgagtagttgggattacaggtgcgcgccaccacacccggctcatttttgtattttagtagagacagggtttcactatgttggtcaggctggtctcgaactgctgacctcgtgatccacccaccttgacctcccaaagtgctggtattacaggtgtgagccaccatgcccggcctctagtgacttttgtaggatagatttcttgaagtccagctagggattatggaatataatgccaagttactttttggaaaggttataacaagcgaggcaactattccattttgcagctgagaatctggaattcgtggaagttaagtgactttctgagtgtggatttgaactttgaattatttgattccagagcccaggttctcagaagtgcaaaaaacatggtattgcttcattcttcctgtaagaagctggattttgcaaaaacactttgatttgtacagcggtggttctcaaacttcagcatgtatcagactcacttggaagacctgatgaaacacaagttagggatgccctagctacagtatttctgattcagtaggtaagaagggcccacccttgagaaccactgatttagaacattatcctgtcttgattccttccccttctgcggagtgtgatagcttctgatactgagggatggatggactaacatatcattactgtacaccagtcattctctttttttggtacagaaaaattggaatgaacattctttttatattattcttttttaattcctaagtgagctaacacaggaggaacgaccttttttaaagtacagttcatcaactgggaatttgttcaaaatgcaatttcttgggctaggacttggactcagcagtctatattttaacaaacaagtgatcctgattcaccctaacatttgagaatcattgctgtacaatagtggagaaaactagttggcaagcatttattgatttctgggatttttagcacaaatttcactctacagttttcctgtttataaaagaaatattggttgatacatgcccaagggaataactttggtgtggatttttaactctagaggaaaggacactgatttcagatctgggttcaaattctgattctgttacatattagcaaataatttcttatctgtgaagccttagtttccctgagaggttgtgatgatttaaataaaatggttatagctatcgtttattgagcacaagctagtgttccactcactatgctaaccacttcgcctaattatctttatcttttgggggagttttaaaaattattccatttagtagttataggactattcaaattacctattttatgttggatgtgtactttccgagaattgacccatttcatctaagttgtcaaatttatgtttgtagaattgttcatagtatttctttattatccttttgatatcttcaggtgctgtagtgataattttgtttcattagtgatactaaaaatgtatcaggctgggcatgtgatgtcattcatgcctataatcccagcactttgggaggccaaggctggtggattgcttaagcccaagagttcaaaaccagcctgggcaacatggtaaaaccccgtctctacaagaaatacaaaaattagcagggtgggtggcacatgcttatagtcccagctgcccgggaggctgaggtgggaggattgcttgagcccaggaagttgaggcctcagtgaactgtgatcatgccactacactccagcctgggtgacagagcgagaccctgtctcaaaaaaaccgaaaacaaacaaacaaaaaaaatttgtcttcgtatttgtcagacttgctagaggtttgtcagttttatggatcttttcaaagaacaagctttttgtttcattgactttttctgttgtctttctgttttcaatttaatagatctctgcctttactatttttttcctcctttggtttattttgctctctatctagtttcttgaggtgggagattagattattgatttgagactttcttttctttttttttttttttttattttttctgaaacagcctgttgcccaggctggagtgcaatggcgcgatctcggctcgctgcaacctccacctcccgggttcaagtgattttcctgcctcagcctccctactagctgggattataggcgctcgccaccacgcccagctaattttttgtatttttaatagagatggggtttcaccatgttggccaggctagtctcgaactcctgacctcaggtgatccacccgcctcggcctcccaaagtgttgggattacaggcgtgacccacagcacccggcctttctttcttttctaatgtaagcctttagctgttaagtttcttctcagcaccaatagattttaatatgttacattttcccttttcatgtagttcaaggcattaaaaaaaaaaaaagtttttttttttttttttttttttttttttgagacagtgtctcagtctgttgcccaggcggtactgcagaggcaggatcatagctctcactgcagcctccagctcctgggctaaagtgatcctcctgctgcctcaaggcatttttaaattccccttgaaacttcctgtttgacccatgaagtatagaagtatgttgtttaattttgaagtttttgtagagtttcctgttatcgttctgttactgacttctagtttgatagtggtcagagaatatactttgtatgatttcaattcctttacatttattgagatttgttttatagcccagagtctatcttggtaaatgtttcatgatcactcgaaaagaatgtgtattctgccatttttgggtagagtgttctataaatgtcaattaactactgttggttaatggtgttgctgaattcttctaatccttgctgattttttcttttttcttttcttttttttttttttttttgagatggagtttcgctcttgttgcccaggctggagcgcgatttggctcaccgcaacctccggctcccaggttcaagcgattcttctgcctcagcctcctgaatagctgggactacaggcatgtgccaccacgcccagctaattttgtatttttagtagagacggggtttctccatgttcgtcaggctggtcttgaacttctgacttcaggtgatccgcctgcctcggcctcccaaagtgctgggattacaggtgtgagccactgcactcggcctactcattcattcattcatttatttttgagacagggtctctatgtcacctgggctggagtgcagtggtttgatcatggtttactgcagcctcaaattccagggcttaagcaatctcctcatgcttcagcctctacaatagctgaaactgcaagcatgtgccactgtgtgccctaatttttaaaattttttgtgtggggagggtgtgggtgtaggttggtggtacctccctttgttgcctgggatggtcttggacttctggcttcagatgatcctcccacctcagcctcccaaagtgctgggattacaggcatgaactactgctcttggcccgagttatctctgtattgcttttttcagtacttgctctaggtattacattatacatataacttaccataagcaactgctcttgacattttaccagtttgattgaagagtagaaactttacttttctttttcctttttttttttgagacagagtctcactctgtcacccaggctggagtgcaatgatgtggtctcggctcactgcaacctctgcctcctgggttcaagcgattctcccaccttagcctcccgagtagctgggactacaggtgtggtccaccatagccggctaatttttgtatttttagtagagacgagttttcactatgttgaccaggttggtctcgaactcctgacctcatgatctgcccgcctcagcctcccaaagtgctgggattacaagcgtgagccaccatgtccggttgaaactttacttttctttatatgccttaatgctcttttgtttataatctaattaatcgttttgttgttgttgagacagagtcttgctgtgttgcccaggctggagtgtagtggaacagtcacggctcacctgcagcctaaacctcctgggctcaagtgatcctcccacctcagccccccaccccccagtagctgggactacaggcatgcaccactatgcctggctgattttttttttttttttttttttttttgagacgaagtctcgctctgtcgcccaggctggagtgcagtggcgtgatctcggctcactgcaacctccgcccctccaggtttaaacaattctctgcctcagcctccagagtagctggaattacaggcgcccgccaccacgcccagctaattttttgtatttttagtagaaacggggtttcaccatcttggccaggctggtcttgaactcctgacctcaaatgatccacacgtctcggcctcccaaagtgctgggattacaggcatgagctactgtgcccagcctactcattcttttaggataagtgttggcaacagatacgtttagttttccttaatctgagaatatcttgatttcccttgaattcttaggggatcttttcacttcatatcgaactctgggtttctagttcttttatctcagcgcttgaaaactgttctgctacttccttttgccctccatggtttctgatgagagagcctctgtcattcaaattggtgttctccttgaggtaatgtgtcatttatctctcattgctttcaggatttttcctttgtcttttgcttttaggaatttgattaagccatgtcttagtgtggatttgttccggtttgtcttttgttgtagtcctgtaggttgctgaggctctgttcattttttttccaatctgttttctttctgttgttcagattggataatttctattgttctatcttcaacttactgattcttttctctgttttctccattctgctgttgaattttcatttaagttactaaagaattttcattgttactgtatttttcagttctaaaaattctgttagattcttttctatatcttctatttgtttgaagagattttctattttttgttgacactttctttttttttttatttgagacaagagtctagctctgtggcctagactggagtgcagtggtgcaatcttgggtcacttcaacctccacctcctgggttcaagtgattctcctgcctcagcctcccaagtagctgggattaaaggcacataccaccatgcctggctaatttttgctgacactttctatgtatttatttattttattatgatgatgatgatttttttctgagatggagtttcactctgttgcccaggctggagtgcaatggtgcgatctcggctcactgcaacctctgcctccctgggttcaagtgattctcctgcctcagcctcccgagtagctgggattacaggcacatgccaccacgcccagctatcttttgtatttttagtagaaatggggtttcaccgtgttggccaggctggtctcgaactcctgacctcgtgatctgcccacctcagcctcccaaagtgctgggattacaggcatgagccactgtgcccggcgacactttcaatttattcatttgtttcaggcatgttcttaattgctcattgaaacatttttatgatggcgcctttaaaattcttaaataattccaacatctgtgtcatctcagtcttaacatctgttgattttcttttcttattcgagttgtgattttccttgttcttggtatgacaaataattattttaattatattctggacatttggggcattatgtcacgagatcctggatcttatttaagacttctgtttttgcaggccttctcagacactgcgctccggtggcagaaagggggtaccacttcatgactgccaggtgggggtggaagtacaggttccccacttggtctttggtgctatccaccacctgctaggtgggtggatcctgctgtctctagtcggtctgctttcttcccttcacctttcagagttttatgtttgttttgtatatattgtccagggtttttagctgtacttggagggatagggaggagtgcatctacttcatattgttccagaaccagcagtgataggttaaataatgtgcccaaagctacacagacagctggaccacagatcaaacctgggtctcctctactttcactgtagaatacagtattatagacaatataagcactgtttaagttgttagaagttatggaagatagggaaaatcagatatgtgctatgtgccaggcattgttctggacaccggggtgggggaggggggatacggcagtgaacatgagacagtaaactaacagcttaatatatagtgtgtcaagtgataatacatggtctagagaaaagtaaagtagggtgagcaggagaaggagtaccaccccagggttgaagtagtggttactttatacaggatgattacagatgggttacctatgagcctgaaggaaagcgaggaagggaaccatgctggtaagtaggggaagagtgtttcaagtagaggacataaaggacccaagtggggagcagacctggcatgctaccagtccagtccaatgctattggaacagagtgagtgaggggagagtaatagaagctgaggttaagggtcaggggtgtgcagatcatatacagcagtgattttccaagtatggttcccagaccagcaggatcagcattatctaggaactgattaggccaattcttggatcccaccccagactgactgaatcagaaactctggagatggagccctagaatctgtggtttaacagcctttcagatgcacgctaaagtttaaaaaccatgggtatagggtgtaaggacttggtttttactctggatgggagccacagaagctttttgagcaagtgagagttgtgatctgatttaggttttggctcttgtgaggatagactaaaggtgaggagcaaggtagaagcagggagaatttcggggctactgtagatcattattccttaaagtgtggtccctggaccagcagcatcagcatcacctgagaggtcattagaaatgcacgtttataggcccaacccagtcctactgaatcaagatgtctggggatggggcctaggaatctgtattttaacaagcttaccaggtgtttctaatattccctaaaatctgagaaactttggtctagttaggcagtggtggcttaaagcagagtcagtgatgatgagaagtggttggattttgaatatatattgatacaggatttgttaatagattggattggggttgtggaagaaggaactcaagaatgactcaattttgaagaatttggtgtaaaggggactagagtaatggggcagagactgaggggatcacaaaagggttttttgtttgggttttttttttttttggagatagaacagtctgtctgtgtgcatgtcagtgcatatgaagttattccgttggtgcatccagaattcagtgaaacctgttatatgacaaactcataaaggagacacttcctaggtacgctggaacttgctgtgtcctttgcattcctttaagtcctgtgtgcctggagttggaggggtggggcggtgggaatggtggatgcttcagcttctggttttatagatggtgctctgtctggacctggatccttgggtaccctcagaaggcagaggttgaggagataagaagccagacaggatcttgagcaaaatcatcatctctcaggcatctccaagtctcagctcccactcagttccacatccctggaagagttgagtgtccattttggagtgctcataacacttgactgtattaatcaccccacattatatcctggttacatattgtagtgatatagtagagtcacaaagtcctgaatttgtatcctgctctgctacttagtagttttgtaattgccaacaatttacttaaccactcagacccagatttctcatctgttagattaggataatattaacgatgatgatgatgatagctaatacttaacatgtgccaggaactttaagtacttaactattttagctcatttaatcctcttaaccaccctgtgaagtgggtactattagtacttccatttcacagatgcagaaactgagatgcagaaaggtgaagtataaattgcttaagttcacatagctagtgagtggcagaggtgagattcaaacccaggcagtttggctcctaagcctgtactttaaacctctgcttctgtgtttaatgtctgtgaatgttgtacggaaggccctgatttgttgtggagattaaatgtgataatatgtgaagttcatagctcagtttttttctcagtgccttttatgctaacttcaaattcattcactcactatcctgttaccttgctttactgactttatagcacttacgaaactgttttgacactgcctctctgtctcccgctctaaaatgtccagtccatgagggcagtgtctgctcaatcaatatttgttgaatttatgcactcatttacttaacaaatactgcttaccgtgtgcttggctttgcagtataccatggggataactcatcttaatcacaagacctggtgctataataattatcctcttgactaaggaagctactcagagcaaatcagcatttaccacccttggtcccaggtggtaactatcgagacagtgcagccagaagcccgatttttcatttgtctgcctccctgatatgaggagttgtctagcacgttgatgtttgttgaataataagtaaggcaagactgagagatgggaaaggtgaggacttttggtaaataagatacactatctggcaaatgtagtggggacagacagcaggtaagtgagcaattccaaggcctcgtggtgaaggctgaaatagggatagtgttgtgggggtgccacagcagcagggaaaaggaagagcaggaatgttccaggtagaaggagatacctgtgatgaaacccagaggctagagctagacagagtatggcaccgagagtccgctggctttttagagcagagctggcttcatgggtgtgcaatcgttatagtcacatggtgccccatgcctgaggtttaatgttctgtggtggttgtcttgaaattcttaataattttgcctttgattttgtgattggtatgtgatggaacaatggagtgtgcgctggggatttaagagtcttggctcatatgtggttctacctcctgctgccattctacctccccgaacaggttcttggctagctgcctggggcactgggcccaggtgcaggtgtggacagagtcggttgggttcatgtaccctgtgtactaagtcaccgggcagggccccagggtacttgtgtgggcctgcactcgccccttgagttatccctatacccaagggagcgtgacagtaaatagcatattaaaactgcatggtaagttgagagagagaccatggaagaaaggaaaaagcttttctattttttgaacagggagctcccacttttcatttccattaggccccacagattgtaagtgggctatgcagtaggaatgtctcccccagcatacgctgtgtgtgaggggaaagacgtgagctcagccagagaggcaaggccttttgggccatggtaagtttatactttaccttaggaaaaatagggaccctgtgaggcattttaagcatgggttgataggatcaaatttgtgtttttaaatgatcactttggctgtagtgtggagggccgattgggtagggacagaataggggccaggagtccagttaggagggcaggacaataactgagttagagataatagtggcctgaactagcgcaggggcagtaaggatgacaaattaacacaattgatagctaataaagagagttgataggacatgctgataacttggataataacaacaaacatacacagcacttactatgggccagacactgttctaaacactttctatatatttagttcatttgcttttgataacaaccttgtgaagtaggtacagtttttatccccatcttacaatgaggaaactgaggcacagagaggttaagtaacttgtccaagatcccacagctagtaagtggcacagccaggatgcaaacccagagaatctggacctaaagtcagtgttcttaacttgatgctagaacgtctacttcagggtatagtggagggagagggctagaggtgaatcagtgatggctgccaggtttctggcttgaatgcctggtgaggttatggagccatttgcagaagtgggaaacctaagagaagggagcatgtttaggtgacagacagaaggagaaactgagtttggacatgttgaatttgaagtacgtaagtggctatccagtagaaatgtctcacccaggagacatttggagggaagggtctaatctggcttggagttatgagtgcatagagggcacatggagccctgggagtgagaacagtgaggaaaagtgaggagaaaagagtgcccaggtaagaggacctaagaaacttcaacatttaaggactgggcaggagaaaaagagttcatcgggaaaaaggaacagccaaagacatgattaaaatcacatcacatccctactcatagtggctgttactccccagttcttgtggctacccaggaaaagccagagtgctttacagtggcctacaacaccctactacatgagtctattgcctttctgacttattactgtcctcctacctctctactctagaacactctcctcctctctgctaccttcggagtctagggatgctcccaccacagggcttttgtacttgctgttcttattgggatgctcttccttcatagccacatgaggggcttgctcccttactccctttgggtctttattcaaaagccattttgtcagtctttccctgtcttccctatctaatatttcaccctcactaccattcttcctggcccccccattgtgtgtgtgtgtgtgtgtgtgtgtgtgtgtgtgtggtgtgtatagttatatattcacacatacatattcctctatatcccccttcctgtttttttttctacctaggtcttctcactatccagcatacaatgtgtttcaccaattgcattgatttatcttgtttcttgtctgcctccccactagaacatcagctctatgagggcagggatttttgtatgctttgttttttgtcttcgtctcaccagcacctagaccagagcctggcggatgctcattaaatgtcagctgaaggaatgggcaccagccagatgggacgttatagaagtcaaggatagagagcttgtcaggtggagagtgtacagggttggcagggcgaaaatggtgctaagaggttaagggagataaagcagagaagtacttattgcatatatcaacaaggaggtcaggaaaccagtgagatctattttaaagaaggtggggactaagatcagactagcaggagatgaatcacaaagtgcatatagcaaccctaaaaaagtatcgatttggctctgatagaacacctctggatactactaggcagctaagggtgggagggagactttttactgtatatacttctgtactctgagttttgcaccatgtacagctgttacttattcaaaagaggagtcattatcaagcttcgtaggtttatttacttcatttttaagctgcataggtttaaagaaagaatgtgtttggctgtgaaggggcggacagaagggagggaggatgggagggcgggtaggtcttggttttttaatttgtaaacatcaatagacttgtttaaatgctattgtgaagagaaagagagagattgaagatactgcagaaagaaggaataattgattgagaaggtaagaaaacatgtgacccaggtggaaaacttggctttagaaggaaggaaagatagtacttttgttgtgataggaaaaaaaggatgggtgtagaaggaggtagattggtgatgagaagttaaggtagttcacctctgattacttaattttctctaagaagtaggaagtgcatcgcttcttggtcttttggctaagatcaagtgtagaagtaggaagtggctggcatgatggctcacacctgtaatcccaacactttgggaggctgaggtaggaggatcacttgaggccagaagtttgagaccattctgggcaacaaagcaagaccccctctctataaaacacacgtacagacacaaattaggtgggcgtggtggtgtgtgcttgtagtcctagctacttgggaggctggggcaggaggatcacttgagcctaggagttaaaggctgcagtgaactatgattggcaccactgctctccagcctgtgcaacccagtgagaccctgactctaaacaaaacaaaacaaaaacattaaggaactcaaagaatgaaagcaaagagtgcttaacaacaacaacaacaacaacaacaaaagccaaaaccaaaaaccagaagtagtaggaagcaaggtaatttttgagagagaagaggcaggtagtggggtgagagatttgacacagccacagtagataatgagagagagttgagtggggaatttcagaaggattgtcaggcagcatgatccagatttttttttttttttttttttgagatggaatcttgctttgtcgcccaggctagagtgcagtggcatgatctcggctcactgcaacctctgcctcctgggttcaagctgttctcctgcctcagcctcctgattagctggaattataggcgcccaccaccattcccagctaatttttgtattttaagtagagatggggtttcaccatgttgaccaggctggtcttgaactcctaacttcaggtgatccacccgcctcagcctcccaaaatgctgggattacaggcgtgagccaccgtgcctggccaatccaaatattttggacagtgaatttatgatggcaccaatccaatgggttatttttctctagccacatctagtggtctagagttaggtagttgtactgagccagggttagggtttgcatatggggatgaaaggcagtggggcaagtgagggtatctgtaagagaatgattgaagtgaggaatgctggaatctcaactagatagggaaggagggtaaagtcaagaatgtgtgaataggtgaaaagtatgaggataaagagttttgagggcaaagaacaggttgtagtgaatgagagctggatagatagacttgtggtcagagagggcgatgtatgagtttcatattccagaggtacagcagttgctggtgttgacagggtctgggggatggtcatgagagttggtagctgaaatgggagtagaggtaacagtctctgaagatgagaagatcaaagaactaagtgcctggaatgttgtgtctccagatggatactgatttcatgtaggatgttgtcaggactcgggatggggaagatctgagcaggttcttcagcgagtgaaggggtgtgttggggagatgggtatgtggcagtgatgaagaggagtaggaagtggtatggctggatggtgtggaactcagaggagtgggagctcttacacaagggtagaggagagatgatctggaagtctcaccagagagtgagagggatggctacccacaacccagtcctgagttatgagggtatgggagaatgtgcagctataagggctctagcacaatgctgcttagattttctgtggcaaagaaccaaggcacttttaaaatttccaatctataatgggccgatccttttatgatataaaaaaagaattactagaaaaaaatggtatgaaccggccgggcgcagtggctcatgcctgtaatcccagcactttgggaggccgaggcgggcggatcacgaggtcaggagatcgagaccatcctggctaacatggtgaaactccatctctactaaaaatacaaaaaattagctgggcgtggtggtgggcgcctgtagtcccagctactcgggaggctgaggcaggagaatggcgtgaacccaggaggcagagcttgcagtgagccaagatcgtgccactgcactccagcctgggtgacagagcgagactctgtctcaaaaaataaataaataaataaaaatttaaaaaaatggtatgaaccaaaagacatataaaagacaagcccaaaattttattcttagattgaacggatataaaattattctgttaaattgctgtaaaaacttctgcataatagtgatgcttactcttactttctgtacttaccacagacctgtagtaaatagttcacagaccggcattagtctgtggaccacactttgagtggcaccggtgtagagaaaatgattttcccgtaggagaagctgcattcagttaagcctggaaggtgaaggagtgtttgttgaagagagtgccaatgttgagcagtttgtttaccaagttgggaaaggggatgagcagcgggtgtttagagtagagaaagcacatagccacatagggtgaaagtttaggggagagagaggtgtccagagggaacaggggtatgagatagaaagcatgcagtccagggaactgagttaatgctacaaggtctggggaatatctttgaagaagttttaggcaggtgaaaggtgaggtccggactggacttctagcacttactgtgaaaccggatacttactgtgtatcagactttatgctcactgtgctacacacattagtattatttttgtagagatggggttaccctatgttgcccaggctggtcttgaactcccggcctcaagcgatcctcccactttggccgcccaaagtactgggattacaggtgtgagctaccgcgactggccatgctgtgcactttatatacattatcttattgaatccttaaaaaccctacaaagttgatggtgatatccctagtttattgataagctgctggtttataggcatgagattattagttgggaatatatttagttgggatattgggaagattattagttgggaagtcctaatcccaggaagtccatttatgagcatgatcttggctgaaacaacttgagctctgccttaatgttctctgctgtgtgtggtaaaccaaacattttaagacttgggtcttctttttttttttttttttttttttggagacagggtcttgttctgtcacccaggctggagtgcggtagcacaatcatggcccactgtagcctcaatctcctgggttcaagggatcctcccagctcagcctccatgctcagctaaatttttttgtttgttttggtagagatgggggtctcaatttgttgcccaggctggtcttgaactcctgggctcaagtgatcctcctgcctcggcctcccaaagttctgggattataggtatgagccactgtgactggcctaggtgtttaattttagcaagaatttatttggagggctgctggtgccttccctagtaagggaaggttgaattttgtgagattaccacctcatatacatgcaaagtcaaattttcaaaattaagtaaatctttttaagtctttaaaatgtgaaataagcaacagatgtttattgtaggaaattagaagcacagataagataaaaaggattatctgtaatttttcatttagaactactgttgactataaatttttttttttagtctttttcgtttaataaagtatctcaagtttaaaaattaggttataaggctgggcgtggtggctcacacctataatcctagcacttcgggaggcagaggcaggtggatcacttgaactcaggagtttgagaccagcctggccaatgtggtgaaacctcgtctctactaaaaatacaaaaaattagccaggcatggtggcacatgcctataatcccagctaattgggaggctgaggcaggagaatcacttgaacccaggaggcagaggttgcagtgagccatgatcacaccactgcctaatacagtaacccctaaccacatgtggctgctgagcgcttgaaattttaaattttatttaattttaatggatttaaacataaatagccacatgtacttaatagctgttctactggacagcactgttctagacctcataaaaaataaaatttccataaaccttggctgtttttctctttttcagttgtgttggtgttgaagaggagaaggctgctgacattgacctctaccactgccccaactgtgaagtcttgcatgggccctccattagtaagtagatcttagggtttcctagagaagacaatccagaggagagacaaaggaaaggaaatttgggggagtgattgcttttgcctgagcacttgtgattcttcttcctcaggaaatagcagaagcctatgcaggctccacaggccagcacctatctcactaagaggacagaagttcataacttcacctccctcccttcctaaggcttatctagagaaagtacccatccatcttcaccaggaactttcctgaatctgtgagggcctcattgactccagatgctccaaggggtggttagattggaagagaaggatctgctgaggcctttgttcttggtatcatagctcatgaccgttctgactcacaatctctcatgtttttctggcttagtgaaaaaacgccgtggatcttcaaaggggcatgatacacacaaggggaaaccagtgaagaccgggagccctacgttcgtcagagagctccggagtaggacttttgacaggtgaggaaccctgcctccagtggctggtgaatgccagggctctgggaagctggaactcacctcttcccagctttcccagtggctgtcccattaggagcttccccagtttgtgagtatcttcagggctctgcaaattccttctggtttggtcaattcctggaaaacttctggtagttgggaggcagtattcacctaagttagatacttacattcatccaaggaatgctgactagaaggagtcttaggatcagaaagtttaattctctcatagagaagaagaaactcttttaatataaaaaaattattggtcatatatctcttttatgatcgaaaagaggttttatctttttaaaattaagctggccttgttaaaagtaaattacatgaaataagcaaaaataatgagttaaaaaaaggaacaaagcattctcctttgcttggttttttaattcagtagaccatgttcaggttttttaaaaataattgcaactggccgggcgcggtggctcacgcctgtaatcccagcactttgggaggccgaggcgggcggatcacgaggtcaggagattgagaccatcccggctaaaacggtgaaaccccgtctctactaaaaatacaaaaaattggccgggcgtagtggcgggcgcctgtagtcccagctactcgggaggctgaggcaggagaatggcgtgaacccgggaggcggagcttgcagtgagccgagatcccaccactgcactccagcctgggcgacagagcgagactccgtctcaaaaaaaaaaaaaaaaaaaaaaaaaaaaaaaataattgcaactttgattttagattcaggaagtacatgtgcaggtttgtttacgtgggtatattgcatgtgtgaggtttggggtgcaaatggtcccatcacccaagtagtgaacatagtacccagtagctagtttttcagccccttccctactacctccctcccaacttgagtggtccccagtatctattgttcccatctttgtctatgtgtacccaatgtttagctcctacttaaaagtgagaacaaaagcagtatttgattttctgttcctgcattaattggcttacgataatggtctccagctgcatccatgttactgaaaaggacatgatttccttctgttttatggctatgtagtattccatgatatatatgtaccacacttttctttatccattccactgttgatgggcacctagtttgattccatgttttactattgtgaatagtgctgcagacatatcagtgcattcgtctttttagtagatggtttattttcctttgggtgtaaatccagtaatgggattgctgggtcgaatggtagttctcttttaagttctttgagaaatctccaaactgctttccatggtggctgaactaatttacattcccactaacatggtataagtattccctttgctctgcaggcttatcaggatctgttatttttttttttacttcttttcaggttttctgtaaccaaagtgttaattggaataagtgttccttcaacttaatgtttcttgttttatttgtttatttaaaggcagaaacttctcctctctactctggactcctcaggttctttctccaaagtcaacccgttatttgtagatcctttcagaaatggtttttgcatatacaaacatagatttttttaattcctttttttgacacaaatggaaacaactatatattgttctgtatcttgcttttttttaaaaaaatatatatttgagatcaatccataatagcacatacagatgttctttttcatggctgtttaatattacattgcatggtgtaacatttatttaaccagtcctctactgagggacgtttaagttgattccagtattttgctattagaaagaaatactgtaatgaatatctttgcacttaagtttttgcatacgttgccagttacatccatagtggctataccatttcacactcccacagataatgtgcggagggtgccgattttcctatatcctagccaatatttgtttgtttgtttgttttattttatttatttatttattttgagacgatgtctcgctcttgtcccccaggctggagtgcaatggcgtgatctcggctcactgcaacctccgcctcctgggttcaagcgattctcctgcctcggcaccccgagtagctgggattactggcgcctgccaccacgcccggctaatttttgtatttttagtagagacggggtttttaccatgttggccaggctggtcttgaactcctgacttcaggtgatccacccgccttggcctcccaaagtcctgggattacaggtgtgagccaccgtgcccagccaccaatattatttattatcaattttttttttgcctttctgataaaataaatcgtgaaatcctgctgttcccacttgtacttcttttctttctttcttttttttttttttttttttgaggcggtgtcttgctctgttggctaggctggagtgcagtggtgcaatctcagctcactgcaccctccgcctcctgggttcaagcaattctgcctcagcctcccaagtagctgggattacaggcacgtaccaccatgcccagctaatttttgtatttttagtagagatggggtttcaccatgctggccaggctggtctcaaactcctgacctcaagggatctgcccaccttggcctcccaaagtgctgggattacaggtgtgagccactgtactcagctcacacttgtatttctttaattatgaaggaaataagtagattttttttttgagacagggtctcatttgagacaggctggagtcgggtggtgcaatcaccactcactgcagccctgacctccctagcttaatccatcttcccacctgcgcttcctgggtagctgggactacaggtgtgtgccaccacgcccagctaattttttttttgtattttttgtagagacggggttttgccatgttgcccaggctggtctccaactcctgggctcaaacaatctgccttccttggcctcccaaagtgctgggattacagttgtgagctattgcactcagccttagatttcatacatttataaaccagcttgattgttttctctgtgaactacttgcttgttttataggcattctgttgtgttactattactgatttataacagctttcttggagaaaattttaatttctatatggttaagtttattactatttttaatgactgctgggtttttcccaggtttttctactcttaaagctttattttttggaatttaatctttggaccatctaggattatgtaaagaatgagataggcaggccaggcacagtggctcatgcctgtaatcccagcactttgggaggctgaggcgggcagatcacctgaggtcgggagttcaagaccagcctgaccaacatgtagaaatcccctatctactaaaaatacaaaattagctgggcgtggtggcgcatgcctgtaatcccagctagtcgggaggctgaggtaggagaatcgcttgaaccctggaggcggaggttgtggtgagccgagattgtgccattgcactccagcctgggcaacaagagcaaaactctgtctcaaaaaaaaaaaaagaatgagataggcattgagcttgagcttaatatatttgtcccaacacaagttgtcagagttgtcaaatacaaatctttcctccaccatgatttaaaagaaaactattttctgcaccatgatttaaagaaaactattttctttcttttctttaaaaaaaaaaaaaaaaaaaagacagggactctctctgtcacccaggctggagtgcagtggcatgttcaaagcccactgtaacctcaactcctgggttcaagtgatcttcctgcctcagcctcccaagtacgtaggactgtaggcctgcaccaccatgccctgctaattttgaatttttttgtggagacgggtttagaaatgatgcccaggctgaaactcattaagtatgcacgttgagaaagttgttgtatatgcatgttgagaaagttgttgtaaaaatgttgttgttttgtttaaatcagtcttttctctttgacagtgttttaaattgggtaatgctgctcttggtttgaacaaatctgtcaaacttgtcagatgtgtcttttctttctggccaggctgttgactgatttcttcttgtcacccagagaagagcaccatgttggcagaatactccccacctctgccagtgacctggtctcttgccttggacagatcatttcttccctggcagatgaggtttttggcattagttgccagctcacattaagtcccctcataaaaaccccacctcttgggtgagtggcagcctccaataaggcctttagtgggcagggcctcaggctcaagctttctctcctgcggcccacagctcagatgaagtgattctgaagcccactggaaatcaactgaccgtggaat

SEQ ID NO: 4618 - DNA, 31188 bp, human
atatatgtagagaaatgaattggaaaagatcctgctgaggttccctctagagaggtaagcaggcattgaaatgccctgtcacggggaaagttcagcctggctgtttgaatgtttataatgggaatgcatttacattacaatgggatggaactgaatctgtgttattaaaaataaatgtttacaactgttaaatggaggtgggatgggggaggtaggcttccagggcagcctggtgctgtggcagccaggtcccatcatgggctgcatcctctgagactggaccagtccacacatttccagggcagcagccagctgcctcccatccttagcagtggcaagacttgctttgtcagcaaatctgactgcctctggttcagacccctggcagctttgcctttcctaatatcctttgtccactccccacctctcaaggacactggggaggaattttaggagtcggggtaggaaccactgtacctaggtccaatgctacctcttgtgaagcctttcctcacacacccactgaatgtgtttgaattaactgtgactgcctctttgttcccacaccacacaggttgctcaaacctctatgtagcacttagggtttgaccttttccagcctccttgttttgttaatttattagatcgtctattccctaagggtacacacagggtctctaattcaggcttggagaccctgacccccacctgtagcccacccagtcctcttgcccccatcttagggctttagcacttttttttttttttttgagatggagtcttgctctgtcgcccaggctggagtgcagtggcacaatctcggctcaccgcaagctctgcctcccgggttcacgcgattctcctgcctcagcctcctgagtagctgggactacaggcacgtgccaccacacccagctaattttttgtatttttagtagagatggggtttcaccatgttggccaggatggtctggatctcttgacctcgtgatccacccgcctcggcctcccaaagtgctgagattacaggcgtgagccaccacacccggccaacacttttgattccttttgcctttgtccctagctagctctttttgttattcaggtctcagctcctgtcaccttctctgagaacccttccttgactaccttatctaaaatagactgctttcctttcaaatcattctctatctcataactggtcttactttcctgatagcactcacctcaattggaaattctctgatttgcctcactttttatccgtctcccttgctggaaatgagtcacaggagggcggggacttgtctgttttgtttacccctaaatccccagtgcctaacagtaggtgttcaagaaaatatgtgaatgaaattcacatattaatgaaattttatttgatcattgactgtttccgccagtagactgtcagctgcatgcaggccagggccttatctggggtacctcaacatcctcagcacctagcacagtgcatgatgcatagtagattaataaagaactgttgggtgagggaattaatgttccacacacacctgaactcaacatagtccaaattaaatttagtctcctccccaccaaatctgttttctcttctgcgtagcccagttcattcagtggcaccgtcatctatgctgacactcaacccagaagtgaactcacacccctttcactcactcatctgctattatcagtttccaaacactgcctagtcaacctccaaaatatccaaattatctcatctttttctaccctttcccaaactatcctggaccaattttttccccccaacactagtgaaacagcctcattcctcctgactccttgtgaagctaagacatcttaaactgcaggacctgtcactttccatagggtcacatggtgatgtgttttataaagttcacaaaatacatttaaacaacaattggttcaaagtgctgtccctttccactgagggcctggccatactttcccttgcattaggtggtgttggagctgcctgacatttttgagatccacctaaggggaagttgatttgggggatatatttaggttgggtttcatgggatatttgttatttaaaaattcattttatttttattttgtagagacagggtttcactatgttgcccagcctggtcttgaactcctgggctcaagtgatcctcccatcctgacctcccaaagtgctgggattacagacatgcaatctgcacccggccccatggtacatttacatgtgccttgtatcacttctcttcgtaattattacccaggtgaaggaattgcttgtagaaatactcttactgcctacctttgaacctaattttgtattcataagtcattttttttttttttgagatggagtctcgctctgtcacccaggctggactgcaatgacacagtctcggatcactgcaacctccgcctcccgtgttcaagcgattctcctgcctcagcctcctgtgtacgtgggactgcaggcatgtgccaccacacacggctaatatttttatttttagtagatatggcgtttcaccatgttggccaggctggtctcgaactcctgaacttgtgatccgcccgcctcggcctcccaaagtgctaggattacagacatgagccaccgcgcccggctatttttttcttaaagacgtctcacccttcctcccccaaaccatataagcttcaggtcccattaaacctggacctttcagtgcagtggctcaggcctgtaatcccagcgcttttagaggatctgaaaccaggagtttgagaccagcctgagcaatatagcgaggcctgggctctataaaaaataaaaaataaccgagtgtggtggtgtgcgcctatagtctcagttactcatgaggctctggcggaaggaccgcttgagtccaggagttctagggtgcagtgagctatgaccgcccagcctgagttgacagagtgagaccttgtctctaaaacaacaaacataaaaaaaaaaaaaaaccctaaaccatcctctgggtaagtcacaaatatgagactaagctacccctgctcaaaaacctgtgttttctttttgctaactgcatacaatctaaactcttttgcatttcgcaatctttcatgttgtgaccctttactgtttgacctcctacctatctctcttctgttttccttgttccaacaatattcaacttctagtaaatatttttctatgtgcctccatgcatttgtacacgttgatccttttgagtacaatgttctcgcttgtttatttaagtgaacttaatcgtccatgtccccctgccgtctttcttacagcagctgcaagcagcttgtaaggctcttttgtagcttcatgttgcattttgcaaaggtcattttgcaggtggtatttgtgtgcttactgtgccttctattccaattgtttactcgcaactttgtttcctgcactggcagatgccctcccactccagaggccctgttttcaccattgcatccccagggcctaccccaccatcactggttagtaaattgtgtgcacgcacacatttcctttttaaagcaatgggaccctttaagaaaatgaaatagtaagataactcctagagaattttctagaatgtttgagaaaacctaggccatcttgaagcatatgtacgaagctccactaactcagcaaagctccactaactcagcctttcctctcatcccccctcctctcccctcccctcaggctatagtcagaaaattgtgggacaggtgcaaacaaatccttgaactgtatttgaactgaagtgaaacagtagggtcaaagaagagttcagagggagttgtggagttggcagcagctttacagaggaactacactgagggcctggggacagaacgcgggtagcacagggcacaaggttcaacgtccctgctccgggactcaagtcacttggcttctcgaagcccctgccttcatttggtgataatcacagagcttccttcacagggggaagaaccaacaacgcagagaccgtgggaaagagcccagcctatcgaaggtgctcaatgaacaggagccgcggtgagtactccgcctctaccccggctgaagcccgcccccgccgccacctattaattttgtagtttggagtcaccgagttcacctcctctcataggaggagaaggctggggaggaggagtgtgcgagtcggggtagctgaactccctgtttgcccggaggagggggaaggctaggaagtttcgggccccactcaaaatggagccaaacgtctgcctcgcctaagatggcggcttctccgcctctgggctcaaggtcttcagcggcgattgggcaccttaaagagacgagcgggtccaaaggtggctgagaaccgccctcctttctcaaggtggcgccccgcccccccgatgacgtcacccgggagccggcggctcgcggttccccgcctccgccgcgctcacctcgcgagtccagccctcataagatggcggtcgccttggttgtctgggtagcgccgccactctcaacatggtagctgtttatcccgtatttctcctcccctctccgcctcaacttcctcattgttttgaataaactttattgactactccgaattgcctaccaccgccactgggcttctcccagcgacttttcgggccgtgtgcctcggacgtggcggccggttcatctctttccccgttggtttgctcgcgagtatctcctgccggcccagcgacgacgccacttgcccgttcgccgggcggccgccagactaggcccaagccgcggtctccagtaggcccgaacggccgggccgaggggaatgttgtggaggaggctgctctgaagcaccgttgagcggctggcgccgcgcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctgtaagttttgggggctgcgaggctattactgtcagttttaggatatactgtgaggtacctgaacatttggggagactagggagctctcatcagtttgagggggggctgcaaggaaacgctgccagtttccgagcgatgcaaaagaatccttgcttagtttcgggagtgtgaggaaattctagtcagtttgaggggttttgaatagatccttttgagtttcagggatgcagccagaaccctgtcatctttaaagtacagaacgagctggtcagtttagagatttatatttatttcagttttgggggtgatgagactcctgactggtcggggaaggaatgatattgagagtgatggaaaggattatttaaactctccgaacacgaccccagaactgtgatttgagttgggcgcctagtcttgtctgtcttgttcgtgaaggctttgagtaacctgaagagactttcagggatcccttatctctctctggttggccctatttcaggtggtgagaggagggtcttgtcttgagatacccccagcctcatttttgacgctgtggtttgcgtcataatagagggagccctgtgaaacaggggtcagctaggggagggttcagtgagagatgaaagaagcttcccgaaaaggcttcaggtattttcttgaaacccggaaagaagttatcactgacaacggggccgaagaaggtggggggtggggagtggagagtgtgggggcggtgggaagcctggaaggttgagctccgttctttacgtgtgaaagaaattctaagggccgggtggactttctctggttgccccctacagccgcaccagctgtgttgcatcccggcggcggtaactctattggagaactgagggttggtgcaagggggtggggggcgggggctgattcactctgtaaaaagtgttatttgtgcctagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcaggtaaggagggcaggccaggctacacagggtgcggtggccaggtgtgttcacttgctctctcttcctttctcagctctgtttttagattccggctcaggaccccctctcccagactcaggttctgccatctctccttgcagaacaggacctagctgacattagcctctggtttctccttttcctgtgttttcccctatgtatttcttctttgcacttttcttttgagtgtttttttagatttataagacccccccccccttttctttcctgttacaaagaatcatttttatattcttctctattttattttttattttgttttatttttttcgagacggagtttcgctcgttgcccaggctggagtgcaatggcgcgatctcggctcacagcaacctctgcctcccaggttcaagcgattttcctgccccagcctccaagtagctgagattacaggcatgcaccaccacacccagctgattttgtatttttagtagagacggtgtttttccatgttgatcaggctggtctggaactcccgacctctggagatctgcctgcctcggcctcccaaagtgctgggattacaggcgtgagccaccgtgcccggtcatcatttttatagtctgacaattatgttctgcctcacacactggcttttgggaaaacagtgttgcttatttgaggtagttgagtccataaacagggatttaagttgtggctttgtacttagtttcagagtgaccatgcacaagttgctttgcttttctgagcctcattgtcttcagctataaaatgttatcaaatacatcctttctgactttgcaaagcagtttggatgtactccataaatggaggcagaaatggaagagtattttatttctacagcatttatctgcagcaccatccaactaaattgaattaagcagaatagatgctgggtaaaacaggagtaaaaccactgatgaatttccttcagttaaccgtgtgtgcacataagcacctgtcacccagaattccggagaggttagtgtgtacgataaaactaatatttcattaatgggatttaaatctcagctatggaaagacaaccttgagggggctttgtacactggagcacaacaaaacagtgtatggcaccctcctcctgttgcttgttagattctagaattttcagttgtctggtctcctccagaggggctatttctttttctttttttcttttttcttttttttttttttttatttgagacaaggtctcactcttgtcacccaggctggagtgcaatggcatgatctcagctcactgcaacctctgcctcccgggttcaagcgattctcgtgcctcagcctcccgagtagctgggattacaggtgcacgccaccacgcccggcaaatttttttgtacttttttgatagagatggagtttcaccatgttggccaggctggtctcaaactcctgacctcaagcgatccgcccgcctcagcctcccacagtgctaggattacaggcatgagccactatgcccagcaagctatttctgtttatcacactcaagaccaaactataggtgctggtgctgctaaaatcctgccctcagcagggactgcccccttgccccgtatccaaattcatgtttaactgatctctattgaatatttattgtgtgcccggcacagagttctgttttactgcctcatgttatttaagaggggacaaccctagagggtgggaccttttcctttgccctgaaaataagtggggattaagatgtctttcaggattcctggtgtctttgctagtgctgatcaagtcactcctcagcttaacattcttctttcagtggttcgtctctgggataaaattcagtatcctttatatgacagacaagaccttttgtgatctacttgtttattctcatttcctgccactcctcctctcttgttctttatgtcctagcaagactgaactacctatagttctgggaaaattttatactcctttatgcctttttgtctttgtacgtgcaaactcccactaatgccctctcccctttgcaactcacagactgtaaaaggtgtaaaagtccttcttcctcttggttcccattgcactttgtgtgcgtctttattaaaaagtaattatttaatcatatcatagttataaatatatctgtgtcattcgttagccagagcttcctgagggcagagatgtcttcttttcatttttggtatccccagaacctagttcagtgctaaacatgtaatagatgctgagtacatttttgaatgagttaatgagtcttcatgaaaaaaagctgttgcctggggcccttactttggattgtatgggaaatgtgtaggttcagacctgtaaaatgggctcctgctaactcctcactctggaaacagggaacaggaatgaatgcttcctgactgcttatgtctgccggaccccatgacagggacttgggacaaattatttagtctatatgcaagcctgaaagttggatatttctcttttaaataatgttcttaattttttcttgctcttatagtgagacctgcttgttgtagaaaacacagaaaaagaataaagaaggaaatataactcacctaagtctactactgtctggcacaatccactgttaaatttgttgttgcattaactcccatcttttgacttagaatataaacatatttttacaagatgggattgcgttataaataccattttacaacctattttttatttctagttaatgttacaatgtaattgccagttcattaaatattcagctaaacttgatttctgatatcccacaatatatatgtgtcaccggttaatttggtaatttcctttatggttggacattgtacttttttgaacattatttgtacttttttatattataaataatgtgaggaaactttgggcgttctggaaaggttttgcatcttgatatgagtgctgattaaaacaaaaacattatggaaagcatctttgcctagtagatacttgacatttatttataaggagcaccattgaggccttaaagaattctaaacttacaaatacagaaatgggcttatgggccaggcccctctttaatcacatttctgtggtgagttgtgtgtttctgtgtacactctaacacaagttaactgccttaatttttttccatgaaatacaccaaattttaaaaatctcttttgcttctctctatgggcccccactgaacaaggaagctagctgagaatcaggtccttgggggtggctgctcttgcttactcagtgcattgctcacagaaacacaccaggcttatagtgcgccatttaagtttgtacttcagcacaattggaaattactacatactgtggactttttatggttgcttgcaagagttaagccaacaaattttaaatccacagatacctagaggtgatagaaatctgttcatatctctagtgacttcttttttttttttttttttttgagacagagtctcactctgttgcccaagctgcagtgcagtggcacgatcttggttcactgcaacctctgcctcctgggttcaagtgattctcctgcctcagccttctgagtagttgggattacaggtgcgcgccaccacacccggctcatttttgtattttagtagagacagggtttcactatgttggtcaggctggtctcgaactgctgacctcgtgatccacccaccttgacctcccaaagtgctggtattacaggtgtgagccaccatgcccggcctctagtgacttttgtaggatagatttcttgaagtccagctagggattatggaatataatgccaagttactttttggaaaggttataacaagcgaggcaactattccattttgcagctgagaatctggaattcgtggaagttaagtgactttctgagtgtggatttgaactttgaattatttgattccagagcccaggttctcagaagtgcaaaaaacatggtattgcttcattcttcctgtaagaagctggattttgcaaaaacactttgatttgtacagcggtggttctcaaacttcagcatgtatcagactcacttggaagacctgatgaaacacaagttagggatgccctagctacagtatttctgattcagtaggtaagaagggcccacccttgagaaccactgatttagaacattatcctgtcttgattccttccccttctgcggagtgtgatagcttctgatactgagggatggatggactaacatatcattactgtacaccagtcattctctttttttggtacagaaaaattggaatgaacattctttttatattattcttttttaattcctaagtgagctaacacaggaggaacgaccttttttaaagtacagttcatcaactgggaatttgttcaaaatgcaatttcttgggctaggacttggactcagcagtctatattttaacaaacaagtgatcctgattcaccctaacatttgagaatcattgctgtacaatagtggagaaaactagttggcaagcatttattgatttctgggatttttagcacaaatttcactctacagttttcctgtttataaaagaaatattggttgatacatgcccaagggaataactttggtgtggatttttaactctagaggaaaggacactgatttcagatctgggttcaaattctgattctgttacatattagcaaataatttcttatctgtgaagccttagtttccctgagaggttgtgatgatttaaataaaatggttatagctatcgtttattgagcacaagctagtgttccactcactatgctaaccacttcgcctaattatctttatcttttgggggagttttaaaaattattccatttagtagttataggactattcaaattacctattttatgttggatgtgtactttccgagaattgacccatttcatctaagttgtcaaatttatgtttgtagaattgttcatagtatttctttattatccttttgatatcttcaggtgctgtagtgataattttgtttcattagtgatactaaaaatgtatcaggctgggcatgtgatgtcattcatgcctataatcccagcactttgggaggccaaggctggtggattgcttaagcccaagagttcaaaaccagcctgggcaacatggtaaaaccccgtctctacaagaaatacaaaaattagcagggtgggtggcacatgcttatagtcccagctgcccgggaggctgaggtgggaggattgcttgagcccaggaagttgaggcctcagtgaactgtgatcatgccactacactccagcctgggtgacagagcgagaccctgtctcaaaaaaaccgaaaacaaacaaacaaaaaaaatttgtcttcgtatttgtcagacttgctagaggtttgtcagttttatggatcttttcaaagaacaagctttttgtttcattgactttttctgttgtctttctgttttcaatttaatagatctctgcctttactatttttttcctcctttggtttattttgctctctatctagtttcttgaggtgggagattagattattgatttgagactttcttttctttttttttttttttttattttttctgaaacagcctgttgcccaggctggagtgcaatggcgcgatctcggctcgctgcaacctccacctcccgggttcaagtgattttcctgcctcagcctccctactagctgggattataggcgctcgccaccacgcccagctaattttttgtatttttaatagagatggggtttcaccatgttggccaggctagtctcgaactcctgacctcaggtgatccacccgcctcggcctcccaaagtgttgggattacaggcgtgacccacagcacccggcctttctttcttttctaatgtaagcctttagctgttaagtttcttctcagcaccaatagattttaatatgttacattttcccttttcatgtagttcaaggcattaaaaaaaaaaaaagtttttttttttttttttttttttttttttgagacagtgtctcagtctgttgcccaggcggtactgcagaggcaggatcatagctctcactgcagcctccagctcctgggctaaagtgatcctcctgctgcctcaaggcatttttaaattccccttgaaacttcctgtttgacccatgaagtatagaagtatgttgtttaattttgaagtttttgtagagtttcctgttatcgttctgttactgacttctagtttgatagtggtcagagaatatactttgtatgatttcaattcctttacatttattgagatttgttttatagcccagagtctatcttggtaaatgtttcatgatcactcgaaaagaatgtgtattctgccatttttgggtagagtgttctataaatgtcaattaactactgttggttaatggtgttgctgaattcttctaatccttgctgattttttcttttttcttttcttttttttttttttttttgagatggagtttcgctcttgttgcccaggctggagcgcgatttggctcaccgcaacctccggctcccaggttcaagcgattcttctgcctcagcctcctgaatagctgggactacaggcatgtgccaccacgcccagctaattttgtatttttagtagagacggggtttctccatgttcgtcaggctggtcttgaacttctgacttcaggtgatccgcctgcctcggcctcccaaagtgctgggattacaggtgtgagccactgcactcggcctactcattcattcattcatttatttttgagacagggtctctatgtcacctgggctggagtgcagtggtttgatcatggtttactgcagcctcaaattccagggcttaagcaatctcctcatgcttcagcctctacaatagctgaaactgcaagcatgtgccactgtgtgccctaatttttaaaattttttgtgtggggagggtgtgggtgtaggttggtggtacctccctttgttgcctgggatggtcttggacttctggcttcagatgatcctcccacctcagcctcccaaagtgctgggattacaggcatgaactactgctcttggcccgagttatctctgtattgcttttttcagtacttgctctaggtattacattatacatataacttaccataagcaactgctcttgacattttaccagtttgattgaagagtagaaactttacttttctttttcctttttttttttgagacagagtctcactctgtcacccaggctggagtgcaatgatgtggtctcggctcactgcaacctctgcctcctgggttcaagcgattctcccaccttagcctcccgagtagctgggactacaggtgtggtccaccatagccggctaatttttgtatttttagtagagacgagttttcactatgttgaccaggttggtctcgaactcctgacctcatgatctgcccgcctcagcctcccaaagtgctgggattacaagcgtgagccaccatgtccggttgaaactttacttttctttatatgccttaatgctcttttgtttataatctaattaatcgttttgttgttgttgagacagagtcttgctgtgttgcccaggctggagtgtagtggaacagtcacggctcacctgcagcctaaacctcctgggctcaagtgatcctcccacctcagccccccaccccccagtagctgggactacaggcatgcaccactatgcctggctgattttttttttttttttttttttttttgagacgaagtctcgctctgtcgcccaggctggagtgcagtggcgtgatctcggctcactgcaacctccgcccctccaggtttaaacaattctctgcctcagcctccagagtagctggaattacaggcgcccgccaccacgcccagctaattttttgtatttttagtagaaacggggtttcaccatcttggccaggctggtcttgaactcctgacctcaaatgatccacacgtctcggcctcccaaagtgctgggattacaggcatgagctactgtgcccagcctactcattcttttaggataagtgttggcaacagatacgtttagttttccttaatctgagaatatcttgatttcccttgaattcttaggggatcttttcacttcatatcgaactctgggtttctagttcttttatctcagcgcttgaaaactgttctgctacttccttttgccctccatggtttctgatgagagagcctctgtcattcaaattggtgttctccttgaggtaatgtgtcatttatctctcattgctttcaggatttttcctttgtcttttgcttttaggaatttgattaagccatgtcttagtgtggatttgttccggtttgtcttttgttgtagtcctgtaggttgctgaggctctgttcattttttttccaatctgttttctttctgttgttcagattggataatttctattgttctatcttcaacttactgattcttttctctgttttctccattctgctgttgaattttcatttaagttactaaagaattttcattgttactgtatttttcagttctaaaaattctgttagattcttttctatatcttctatttgtttgaagagattttctattttttgttgacactttctttttttttttatttgagacaagagtctagctctgtggcctagactggagtgcagtggtgcaatcttgggtcacttcaacctccacctcctgggttcaagtgattctcctgcctcagcctcccaagtagctgggattaaaggcacataccaccatgcctggctaatttttgctgacactttctatgtatttatttattttattatgatgatgatgatttttttctgagatggagtttcactctgttgcccaggctggagtgcaatggtgcgatctcggctcactgcaacctctgcctccctgggttcaagtgattctcctgcctcagcctcccgagtagctgggattacaggcacatgccaccacgcccagctatcttttgtatttttagtagaaatggggtttcaccgtgttggccaggctggtctcgaactcctgacctcgtgatctgcccacctcagcctcccaaagtgctgggattacaggcatgagccactgtgcccggcgacactttcaatttattcatttgtttcaggcatgttcttaattgctcattgaaacatttttatgatggcgcctttaaaattcttaaataattccaacatctgtgtcatctcagtcttaacatctgttgattttcttttcttattcgagttgtgattttccttgttcttggtatgacaaataattattttaattatattctggacatttggggcattatgtcacgagatcctggatcttatttaagacttctgtttttgcaggccttctcagacactgcgctccggtggcagaaagggggtaccacttcatgactgccaggtgggggtggaagtacaggttccccacttggtctttggtgctatccaccacctgctaggtgggtggatcctgctgtctctagtcggtctgctttcttcccttcacctttcagagttttatgtttgttttgtatatattgtccagggtttttagctgtacttggagggatagggaggagtgcatctacttcatattgttccagaaccagcagtgataggttaaataatgtgcccaaagctacacagacagctggaccacagatcaaacctgggtctcctctactttcactgtagaatacagtattatagacaatataagcactgtttaagttgttagaagttatggaagatagggaaaatcagatatgtgctatgtgccaggcattgttctggacaccggggtgggggaggggggatacggcagtgaacatgagacagtaaactaacagcttaatatatagtgtgtcaagtgataatacatggtctagagaaaagtaaagtagggtgagcaggagaaggagtaccaccccagggttgaagtagtggttactttatacaggatgattacagatgggttacctatgagcctgaaggaaagcgaggaagggaaccatgctggtaagtaggggaagagtgtttcaagtagaggacataaaggacccaagtggggagcagacctggcatgctaccagtccagtccaatgctattggaacagagtgagtgaggggagagtaatagaagctgaggttaagggtcaggggtgtgcagatcatatacagcagtgattttccaagtatggttcccagaccagcaggatcagcattatctaggaactgattaggccaattcttggatcccaccccagactgactgaatcagaaactctggagatggagccctagaatctgtggtttaacagcctttcagatgcacgctaaagtttaaaaaccatgggtatagggtgtaaggacttggtttttactctggatgggagccacagaagctttttgagcaagtgagagttgtgatctgatttaggttttggctcttgtgaggatagactaaaggtgaggagcaaggtagaagcagggagaatttcggggctactgtagatcattattccttaaagtgtggtccctggaccagcagcatcagcatcacctgagaggtcattagaaatgcacgtttataggcccaacccagtcctactgaatcaagatgtctggggatggggcctaggaatctgtattttaacaagcttaccaggtgtttctaatattccctaaaatctgagaaactttggtctagttaggcagtggtggcttaaagcagagtcagtgatgatgagaagtggttggattttgaatatatattgatacaggatttgttaatagattggattggggttgtggaagaaggaactcaagaatgactcaattttgaagaatttggtgtaaaggggactagagtaatggggcagagactgaggggatcacaaaagggttttttgtttgggttttttttttttttggagatagaacagtctgtctgtgtgcatgtcagtgcatatgaagttattccgttggtgcatccagaattcagtgaaacctgttatatgacaaactcataaaggagacacttcctaggtacgctggaacttgctgtgtcctttgcattcctttaagtcctgtgtgcctggagttggaggggtggggcggtgggaatggtggatgcttcagcttctggttttatagatggtgctctgtctggacctggatccttgggtaccctcagaaggcagaggttgaggagataagaagccagacaggatcttgagcaaaatcatcatctctcaggcatctccaagtctcagctcccactcagttccacatccctggaagagttgagtgtccattttggagtgctcataacacttgactgtattaatcaccccacattatatcctggttacatattgtagtgatatagtagagtcacaaagtcctgaatttgtatcctgctctgctacttagtagttttgtaattgccaacaatttacttaaccactcagacccagatttctcatctgttagattaggataatattaacgatgatgatgatgatagctaatacttaacatgtgccaggaactttaagtacttaactattttagctcatttaatcctcttaaccaccctgtgaagtgggtactattagtacttccatttcacagatgcagaaactgagatgcagaaaggtgaagtataaattgcttaagttcacatagctagtgagtggcagaggtgagattcaaacccaggcagtttggctcctaagcctgtactttaaacctctgcttctgtgtttaatgtctgtgaatgttgtacggaaggccctgatttgttgtggagattaaatgtgataatatgtgaagttcatagctcagtttttttctcagtgccttttatgctaacttcaaattcattcactcactatcctgttaccttgctttactgactttatagcacttacgaaactgttttgacactgcctctctgtctcccgctctaaaatgtccagtccatgagggcagtgtctgctcaatcaatatttgttgaatttatgcactcatttacttaacaaatactgcttaccgtgtgcttggctttgcagtataccatggggataactcatcttaatcacaagacctggtgctataataattatcctcttgactaaggaagctactcagagcaaatcagcatttaccacccttggtcccaggtggtaactatcgagacagtgcagccagaagcccgatttttcatttgtctgcctccctgatatgaggagttgtctagcacgttgatgtttgttgaataataagtaaggcaagactgagagatgggaaaggtgaggacttttggtaaataagatacactatctggcaaatgtagtggggacagacagcaggtaagtgagcaattccaaggcctcgtggtgaaggctgaaatagggatagtgttgtgggggtgccacagcagcagggaaaaggaagagcaggaatgttccaggtagaaggagatacctgtgatgaaacccagaggctagagctagacagagtatggcaccgagagtccgctggctttttagagcagagctggcttcatgggtgtgcaatcgttatagtcacatggtgccccatgcctgaggtttaatgttctgtggtggttgtcttgaaattcttaataattttgcctttgattttgtgattggtatgtgatggaacaatggagtgtgcgctggggatttaagagtcttggctcatatgtggttctacctcctgctgccattctacctccccgaacaggttcttggctagctgcctggggcactgggcccaggtgcaggtgtggacagagtcggttgggttcatgtaccctgtgtactaagtcaccgggcagggccccagggtacttgtgtgggcctgcactcgccccttgagttatccctatacccaagggagcgtgacagtaaatagcatattaaaactgcatggtaagttgagagagagaccatggaagaaaggaaaaagcttttctattttttgaacagggagctcccacttttcatttccattaggccccacagattgtaagtgggctatgcagtaggaatgtctcccccagcatacgctgtgtgtgaggggaaagacgtgagctcagccagagaggcaaggccttttgggccatggtaagtttatactttaccttaggaaaaatagggaccctgtgaggcattttaagcatgggttgataggatcaaatttgtgtttttaaatgatcactttggctgtagtgtggagggccgattgggtagggacagaataggggccaggagtccagttaggagggcaggacaataactgagttagagataatagtggcctgaactagcgcaggggcagtaaggatgacaaattaacacaattgatagctaataaagagagttgataggacatgctgataacttggataataacaacaaacatacacagcacttactatgggccagacactgttctaaacactttctatatatttagttcatttgcttttgataacaaccttgtgaagtaggtacagtttttatccccatcttacaatgaggaaactgaggcacagagaggttaagtaacttgtccaagatcccacagctagtaagtggcacagccaggatgcaaacccagagaatctggacctaaagtcagtgttcttaacttgatgctagaacgtctacttcagggtatagtggagggagagggctagaggtgaatcagtgatggctgccaggtttctggcttgaatgcctggtgaggttatggagccatttgcagaagtgggaaacctaagagaagggagcatgtttaggtgacagacagaaggagaaactgagtttggacatgttgaatttgaagtacgtaagtggctatccagtagaaatgtctcacccaggagacatttggagggaagggtctaatctggcttggagttatgagtgcatagagggcacatggagccctgggagtgagaacagtgaggaaaagtgaggagaaaagagtgcccaggtaagaggacctaagaaacttcaacatttaaggactgggcaggagaaaaagagttcatcgggaaaaaggaacagccaaagacatgattaaaatcacatcacatccctactcatagtggctgttactccccagttcttgtggctacccaggaaaagccagagtgctttacagtggcctacaacaccctactacatgagtctattgcctttctgacttattactgtcctcctacctctctactctagaacactctcctcctctctgctaccttcggagtctagggatgctcccaccacagggcttttgtacttgctgttcttattgggatgctcttccttcatagccacatgaggggcttgctcccttactccctttgggtctttattcaaaagccattttgtcagtctttccctgtcttccctatctaatatttcaccctcactaccattcttcctggcccccccattgtgtgtgtgtgtgtgtgtgtgtgtgtgtgtgtgtggtgtgtatagttatatattcacacatacatattcctctatatcccccttcctgtttttttttctacctaggtcttctcactatccagcatacaatgtgtttcaccaattgcattgatttatcttgtttcttgtctgcctccccactagaacatcagctctatgagggcagggatttttgtatgctttgttttttgtcttcgtctcaccagcacctagaccagagcctggcggatgctcattaaatgtcagctgaaggaatgggcaccagccagatgggacgttatagaagtcaaggatagagagcttgtcaggtggagagtgtacagggttggcagggcgaaaatggtgctaagaggttaagggagataaagcagagaagtacttattgcatatatcaacaaggaggtcaggaaaccagtgagatctattttaaagaaggtggggactaagatcagactagcaggagatgaatcacaaagtgcatatagcaaccctaaaaaagtatcgatttggctctgatagaacacctctggatactactaggcagctaagggtgggagggagactttttactgtatatacttctgtactctgagttttgcaccatgtacagctgttacttattcaaaagaggagtcattatcaagcttcgtaggtttatttacttcatttttaagctgcataggtttaaagaaagaatgtgtttggctgtgaaggggcggacagaagggagggaggatgggagggcgggtaggtcttggttttttaatttgtaaacatcaatagacttgtttaaatgctattgtgaagagaaagagagagattgaagatactgcagaaagaaggaataattgattgagaaggtaagaaaacatgtgacccaggtggaaaacttggctttagaaggaaggaaagatagtacttttgttgtgataggaaaaaaaggatgggtgtagaaggaggtagattggtgatgagaagttaaggtagttcacctctgattacttaattttctctaagaagtaggaagtgcatcgcttcttggtcttttggctaagatcaagtgtagaagtaggaagtggctggcatgatggctcacacctgtaatcccaacactttgggaggctgaggtaggaggatcacttgaggccagaagtttgagaccattctgggcaacaaagcaagaccccctctctataaaacacacgtacagacacaaattaggtgggcgtggtggtgtgtgcttgtagtcctagctacttgggaggctggggcaggaggatcacttgagcctaggagttaaaggctgcagtgaactatgattggcaccactgctctccagcctgtgcaacccagtgagaccctgactctaaacaaaacaaaacaaaaacattaaggaactcaaagaatgaaagcaaagagtgcttaacaacaacaacaacaacaacaacaaaagccaaaaccaaaaaccagaagtagtaggaagcaaggtaatttttgagagagaagaggcaggtagtggggtgagagatttgacacagccacagtagataatgagagagagttgagtggggaatttcagaaggattgtcaggcagcatgatccagatttttttttttttttttttttgagatggaatcttgctttgtcgcccaggctagagtgcagtggcatgatctcggctcactgcaacctctgcctcctgggttcaagctgttctcctgcctcagcctcctgattagctggaattataggcgcccaccaccattcccagctaatttttgtattttaagtagagatggggtttcaccatgttgaccaggctggtcttgaactcctaacttcaggtgatccacccgcctcagcctcccaaaatgctgggattacaggcgtgagccaccgtgcctggccaatccaaatattttggacagtgaatttatgatggcaccaatccaatgggttatttttctctagccacatctagtggtctagagttaggtagttgtactgagccagggttagggtttgcatatggggatgaaaggcagtggggcaagtgagggtatctgtaagagaatgattgaagtgaggaatgctggaatctcaactagatagggaaggagggtaaagtcaagaatgtgtgaataggtgaaaagtatgaggataaagagttttgagggcaaagaacaggttgtagtgaatgagagctggatagatagacttgtggtcagagagggcgatgtatgagtttcatattccagaggtacagcagttgctggtgttgacagggtctgggggatggtcatgagagttggtagctgaaatgggagtagaggtaacagtctctgaagatgagaagatcaaagaactaagtgcctggaatgttgtgtctccagatggatactgatttcatgtaggatgttgtcaggactcgggatggggaagatctgagcaggttcttcagcgagtgaaggggtgtgttggggagatgggtatgtggcagtgatgaagaggagtaggaagtggtatggctggatggtgtggaactcagaggagtgggagctcttacacaagggtagaggagagatgatctggaagtctcaccagagagtgagagggatggctacccacaacccagtcctgagttatgagggtatgggagaatgtgcagctataagggctctagcacaatgctgcttagattttctgtggcaaagaaccaaggcacttttaaaatttccaatctataatgggccgatccttttatgatataaaaaaagaattactagaaaaaaatggtatgaaccggccgggcgcagtggctcatgcctgtaatcccagcactttgggaggccgaggcgggcggatcacgaggtcaggagatcgagaccatcctggctaacatggtgaaactccatctctactaaaaatacaaaaaattagctgggcgtggtggtgggcgcctgtagtcccagctactcgggaggctgaggcaggagaatggcgtgaacccaggaggcagagcttgcagtgagccaagatcgtgccactgcactccagcctgggtgacagagcgagactctgtctcaaaaaataaataaataaataaaaatttaaaaaaatggtatgaaccaaaagacatataaaagacaagcccaaaattttattcttagattgaacggatataaaattattctgttaaattgctgtaaaaacttctgcataatagtgatgcttactcttactttctgtacttaccacagacctgtagtaaatagttcacagaccggcattagtctgtggaccacactttgagtggcaccggtgtagagaaaatgattttcccgtaggagaagctgcattcagttaagcctggaaggtgaaggagtgtttgttgaagagagtgccaatgttgagcagtttgtttaccaagttgggaaaggggatgagcagcgggtgtttagagtagagaaagcacatagccacatagggtgaaagtttaggggagagagaggtgtccagagggaacaggggtatgagatagaaagcatgcagtccagggaactgagttaatgctacaaggtctggggaatatctttgaagaagttttaggcaggtgaaaggtgaggtccggactggacttctagcacttactgtgaaaccggatacttactgtgtatcagactttatgctcactgtgctacacacattagtattatttttgtagagatggggttaccctatgttgcccaggctggtcttgaactcccggcctcaagcgatcctcccactttggccgcccaaagtactgggattacaggtgtgagctaccgcgactggccatgctgtgcactttatatacattatcttattgaatccttaaaaaccctacaaagttgatggtgatatccctagtttattgataagctgctggtttataggcatgagattattagttgggaatatatttagttgggatattgggaagattattagttgggaagtcctaatcccaggaagtccatttatgagcatgatcttggctgaaacaacttgagctctgccttaatgttctctgctgtgtgtggtaaaccaaacattttaagacttgggtcttctttttttttttttttttttttttggagacagggtcttgttctgtcacccaggctggagtgcggtagcacaatcatggcccactgtagcctcaatctcctgggttcaagggatcctcccagctcagcctccatgctcagctaaatttttttgtttgttttggtagagatgggggtctcaatttgttgcccaggctggtcttgaactcctgggctcaagtgatcctcctgcctcggcctcccaaagttctgggattataggtatgagccactgtgactggcctaggtgtttaattttagcaagaatttatttggagggctgctggtgccttccctagtaagggaaggttgaattttgtgagattaccacctcatatacatgcaaagtcaaattttcaaaattaagtaaatctttttaagtctttaaaatgtgaaataagcaacagatgtttattgtaggaaattagaagcacagataagataaaaaggattatctgtaatttttcatttagaactactgttgactataaatttttttttttagtctttttcgtttaataaagtatctcaagtttaaaaattaggttataaggctgggcgtggtggctcacacctataatcctagcacttcgggaggcagaggcaggtggatcacttgaactcaggagtttgagaccagcctggccaatgtggtgaaacctcgtctctactaaaaatacaaaaaattagccaggcatggtggcacatgcctataatcccagctaattgggaggctgaggcaggagaatcacttgaacccaggaggcagaggttgcagtgagccatgatcacaccactgcctaatacagtaacccctaaccacatgtggctgctgagcgcttgaaattttaaattttatttaattttaatggatttaaacataaatagccacatgtacttaatagctgttctactggacagcactgttctagacctcataaaaaataaaatttccataaaccttggctgtttttctctttttcagttgtgttggtgttgaagaggagaaggctgctgacattgacctctaccactgccccaactgtgaagtcttgcatgggccctccattagtaagtagatcttagggtttcctagagaagacaatccagaggagagacaaaggaaaggaaatttgggggagtgattgcttttgcctgagcacttgtgattcttcttcctcaggaaatagcagaagcctatgcaggctccacaggccagcacctatctcactaagaggacagaagttcataacttcacctccctcccttcctaaggcttatctagagaaagtacccatccatcttcaccaggaactttcctgaatctgtgagggcctcattgactccagatgctccaaggggtggttagattggaagagaaggatctgctgaggcctttgttcttggtatcatagctcatgaccgttctgactcacaatctctcatgtttttctggcttagtgaaaaaacgccgtggatcttcaaaggggcatgatacacacaaggggaaaccagtgaagaccgggagccctacgttcgtcagagagctccggagtaggacttttgacaggtgaggaaccctgcctccagtggctggtgaatgccagggctctgggaagctggaactcacctcttcccagctttcccagtggctgtcccattaggagcttccccagtttgtgagtatcttcagggctctgcaaattccttctggtttggtcaattcctggaaaacttctggtagttgggaggcagtattcacctaagttagatacttacattcatccaaggaatgctgactagaaggagtcttaggatcagaaagtttaattctctcatagagaagaagaaactcttttaatataaaaaaattattggtcatatatctcttttatgatcgaaaagaggttttatctttttaaaattaagctggccttgttaaaagtaaattacatgaaataagcaaaaataatgagttaaaaaaaggaacaaagcattctcctttgcttggttttttaattcagtagaccatgttcaggttttttaaaaataattgcaactggccgggcgcggtggctcacgcctgtaatcccagcactttgggaggccgaggcgggcggatcacgaggtcaggagattgagaccatcccggctaaaacggtgaaaccccgtctctactaaaaatacaaaaaattggccgggcgtagtggcgggcgcctgtagtcccagctactcgggaggctgaggcaggagaatggcgtgaacccgggaggcggagcttgcagtgagccgagatcccaccactgcactccagcctgggcgacagagcgagactccgtctcaaaaaaaaaaaaaaaaaaaaaaaaaaaaaaaataattgcaactttgattttagattcaggaagtacatgtgcaggtttgtttacgtgggtatattgcatgtgtgaggtttggggtgcaaatggtcccatcacccaagtagtgaacatagtacccagtagctagtttttcagccccttccctactacctccctcccaacttgagtggtccccagtatctattgttcccatctttgtctatgtgtacccaatgtttagctcctacttaaaagtgagaacaaaagcagtatttgattttctgttcctgcattaattggcttacgataatggtctccagctgcatccatgttactgaaaaggacatgatttccttctgttttatggctatgtagtattccatgatatatatgtaccacacttttctttatccattccactgttgatgggcacctagtttgattccatgttttactattgtgaatagtgctgcagacatatcagtgcattcgtctttttagtagatggtttattttcctttgggtgtaaatccagtaatgggattgctgggtcgaatggtagttctcttttaagttctttgagaaatctccaaactgctttccatggtggctgaactaatttacattcccactaacatggtataagtattccctttgctctgcaggcttatcaggatctgttatttttttttttacttcttttcaggttttctgtaaccaaagtgttaattggaataagtgttccttcaacttaatgtttcttgttttatttgtttatttaaaggcagaaacttctcctctctactctggactcctcaggttctttctccaaagtcaacccgttatttgtagatcctttcagaaatggtttttgcatatacaaacatagatttttttaattcctttttttgacacaaatggaaacaactatatattgttctgtatcttgcttttttttaaaaaaatatatatttgagatcaatccataatagcacatacagatgttctttttcatggctgtttaatattacattgcatggtgtaacatttatttaaccagtcctctactgagggacgtttaagttgattccagtattttgctattagaaagaaatactgtaatgaatatctttgcacttaagtttttgcatacgttgccagttacatccatagtggctataccatttcacactcccacagataatgtgcggagggtgccgattttcctatatcctagccaatatttgtttgtttgtttgttttattttatttatttatttattttgagacgatgtctcgctcttgtcccccaggctggagtgcaatggcgtgatctcggctcactgcaacctccgcctcctgggttcaagcgattctcctgcctcggcaccccgagtagctgggattactggcgcctgccaccacgcccggctaatttttgtatttttagtagagacggggtttttaccatgttggccaggctggtcttgaactcctgacttcaggtgatccacccgccttggcctcccaaagtcctgggattacaggtgtgagccaccgtgcccagccaccaatattatttattatcaattttttttttgcctttctgataaaataaatcgtgaaatcctgctgttcccacttgtacttcttttctttctttcttttttttttttttttttttgaggcggtgtcttgctctgttggctaggctggagtgcagtggtgcaatctcagctcactgcaccctccgcctcctgggttcaagcaattctgcctcagcctcccaagtagctgggattacaggcacgtaccaccatgcccagctaatttttgtatttttagtagagatggggtttcaccatgctggccaggctggtctcaaactcctgacctcaagggatctgcccaccttggcctcccaaagtgctgggattacaggtgtgagccactgtactcagctcacacttgtatttctttaattatgaaggaaataagtagattttttttttgagacagggtctcatttgagacaggctggagtcgggtggtgcaatcaccactcactgcagccctgacctccctagcttaatccatcttcccacctgcgcttcctgggtagctgggactacaggtgtgtgccaccacgcccagctaattttttttttgtattttttgtagagacggggttttgccatgttgcccaggctggtctccaactcctgggctcaaacaatctgccttccttggcctcccaaagtgctgggattacagttgtgagctattgcactcagccttagatttcatacatttataaaccagcttgattgttttctctgtgaactacttgcttgttttataggcattctgttgtgttactattactgatttataacagctttcttggagaaaattttaatttctatatggttaagtttattactatttttaatgactgctgggtttttcccaggtttttctactcttaaagctttattttttggaatttaatctttggaccatctaggattatgtaaagaatgagataggcaggccaggcacagtggctcatgcctgtaatcccagcactttgggaggctgaggcgggcagatcacctgaggtcgggagttcaagaccagcctgaccaacatgtagaaatcccctatctactaaaaatacaaaattagctgggcgtggtggcgcatgcctgtaatcccagctagtcgggaggctgaggtaggagaatcgcttgaaccctggaggcggaggttgtggtgagccgagattgtgccattgcactccagcctgggcaacaagagcaaaactctgtctcaaaaaaaaaaaaagaatgagataggcattgagcttgagcttaatatatttgtcccaacacaagttgtcagagttgtcaaatacaaatctttcctccaccatgatttaaaagaaaactattttctgcaccatgatttaaagaaaactattttctttcttttctttaaaaaaaaaaaaaaaaaaaagacagggactctctctgtcacccaggctggagtgcagtggcatgttcaaagcccactgtaacctcaactcctgggttcaagtgatcttcctgcctcagcctcccaagtacgtaggactgtaggcctgcaccaccatgccctgctaattttgaatttttttgtggagacgggtttagaaatgatgcccaggctgaaactcattaagtatgcacgttgagaaagttgttgtatatgcatgttgagaaagttgttgtaaaaatgttgttgttttgtttaaatcagtcttttctctttgacagtgttttaaattgggtaatgctgctcttggtttgaacaaatctgtcaaacttgtcagatgtgtcttttctttctggccaggctgttgactgatttcttcttgtcacccagagaagagcaccatgttggcagaatactccccacctctgccagtgacctggtctcttgccttggacagatcatttcttccctggcagatgaggtttttggcattagttgccagctcacattaagtcccctcataaaaaccccacctcttgggtgagtggcagcctccaataaggcctttagtgggcagggcctcaggctcaagctttctctcctgcggcccacagctcagatgaagtgattctgaagcccactggaaatcaactgaccgtggaatt

SEQ ID NO: 4619 - DNA, 107498 bp, human
gcggccgccagactaggcccaagccgcggtctccagtaggcccgaacggccgggccgaggggaatgttgtggaggaggctgctctgaagcaccgttgagcggctggcgccgcgcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctgtaagttttgggggctgcgaggctattactgtcagttttaggatatactgtgaggtacctgaacatttggggagactagggagctctcatcagtttgagggggggctgcaaggaaacgctgccagtttccgagcgatgcaaaagaatccttgcttagtttcgggagtgtgaggaaattctagtcagtttgaggggttttgaatagatccttttgagtttcagggatgcagccagaaccctgtcatctttaaagtacagaacgagctggtcagtttagagatttatatttatttcagttttgggggtgatgagactcctgactggtcggggaaggaatgatattgagagtgatggaaaggattatttaaactctccgaacacgaccccagaactgtgatttgagttgggcgcctagtcttgtctgtcttgttcgtgaaggctttgagtaacctgaagagactttcagggatcccttatctctctctggttggccctatttcaggtggtgagaggagggtcttgtcttgagatacccccagcctcatttttgacgctgtggtttgcgtcataatagagggagccctgtgaaacaggggtcagctaggggagggttcagtgagagatgaaagaagcttcccgaaaaggcttcaggtattttcttgaaacccggaaagaagttatcactgacaacggggccgaagaaggtggggggtggggagtggagagtgtgggggcggtgggaagcctggaaggttgagctccgttctttacgtgtgaaagaaattctaagggccgggtggactttctctggttgccccctacagccgcaccagctgtgttgcatcccggcggcggtaactctattggagaactgagggttggtgcaagggggtggggggcgggggctgattcactctgtaaaaagtgttatttgtgcctagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcaggtaaggagggcaggccaggctacacagggtgcggtggccaggtgtgttcacttgctctctcttcctttctcagctctgtttttagattccggctcaggaccccctctcccagactcaggttctgccatctctccttgcagaacaggacctagctgacattagcctctggtttctccttttcctgtgttttcccctatgtatttcttctttgcacttttcttttgagtgtttttttagatttataagacccccccccccttttctttcctgttacaaagaatcatttttatattcttctctattttattttttattttgttttatttttttcgagacggagtttcgctcgttgcccaggctggagtgcaatggcgcgatctcggctcacagcaacctctgcctcccaggttcaagcgattttcctgccccagcctccaagtagctgagattacaggcatgcaccaccacacccagctgattttgtatttttagtagagacggtgtttttccatgttgatcaggctggtctggaactcccgacctctggagatctgcctgcctcggcctcccaaagtgctgggattacaggcgtgagccaccgtgcccggtcatcatttttatagtctgacaattatgttctgcctcacacactggcttttgggaaaacagtgttgcttatttgaggtagttgagtccataaacagggatttaagttgtggctttgtacttagtttcagagtgaccatgcacaagttgctttgcttttctgagcctcattgtcttcagctataaaatgttatcaaatacatcctttctgactttgcaaagcagtttggatgtactccataaatggaggcagaaatggaagagtattttatttctacagcatttatctgcagcaccatccaactaaattgaattaagcagaatagatgctgggtaaaacaggagtaaaaccactgatgaatttccttcagttaaccgtgtgtgcacataagcacctgtcacccagaattccggagaggttagtgtgtacgataaaactaatatttcattaatgggatttaaatctcagctatggaaagacaaccttgagggggctttgtacactggagcacaacaaaacagtgtatggcaccctcctcctgttgcttgttagattctagaattttcagttgtctggtctcctccagaggggctatttctttttctttttttcttttttcttttttttttttttttatttgagacaaggtctcactcttgtcacccaggctggagtgcaatggcatgatctcagctcactgcaacctctgcctcccgggttcaagcgattctcgtgcctcagcctcccgagtagctgggattacaggtgcacgccaccacgcccggcaaatttttttgtacttttttgatagagatggagtttcaccatgttggccaggctggtctcaaactcctgacctcaagcgatccgcccgcctcagcctcccacagtgctaggattacaggcatgagccactatgcccagcaagctatttctgtttatcacactcaagaccaaactataggtgctggtgctgctaaaatcctgccctcagcagggactgcccccttgccccgtatccaaattcatgtttaactgatctctattgaatatttattgtgtgcccggcacagagttctgttttactgcctcatgttatttaagaggggacaaccctagagggtgggaccttttcctttgccctgaaaataagtggggattaagatgtctttcaggattcctggtgtctttgctagtgctgatcaagtcactcctcagcttaacattcttctttcagtggttcgtctctgggataaaattcagtatcctttatatgacagacaagaccttttgtgatctacttgtttattctcatttcctgccactcctcctctcttgttctttatgtcctagcaagactgaactacctatagttctgggaaaattttatactcctttatgcctttttgtctttgtacgtgcaaactcccactaatgccctctcccctttgcaactcacagactgtaaaaggtgtaaaagtccttcttcctcttggttcccattgcactttgtgtgcgtctttattaaaaagtaattatttaatcatatcatagttataaatatatctgtgtcattcgttagccagagcttcctgagggcagagatgtcttcttttcatttttggtatccccagaacctagttcagtgctaaacatgtaatagatgctgagtacatttttgaatgagttaatgagtcttcatgaaaaaaagctgttgcctggggcccttactttggattgtatgggaaatgtgtaggttcagacctgtaaaatgggctcctgctaactcctcactctggaaacagggaacaggaatgaatgcttcctgactgcttatgtctgccggaccccatgacagggacttgggacaaattatttagtctatatgcaagcctgaaagttggatatttctcttttaaataatgttcttaattttttcttgctcttatagtgagacctgcttgttgtagaaaacacagaaaaagaataaagaaggaaatataactcacctaagtctactactgtctggcacaatccactgttaaatttgttgttgcattaactcccatcttttgacttagaatataaacatatttttacaagatgggattgcgttataaataccattttacaacctattttttatttctagttaatgttacaatgtaattgccagttcattaaatattcagctaaacttgatttctgatatcccacaatatatatgtgtcaccggttaatttggtaatttcctttatggttggacattgtacttttttgaacattatttgtacttttttatattataaataatgtgaggaaactttgggcgttctggaaaggttttgcatcttgatatgagtgctgattaaaacaaaaacattatggaaagcatctttgcctagtagatacttgacatttatttataaggagcaccattgaggccttaaagaattctaaacttacaaatacagaaatgggcttatgggccaggcccctctttaatcacatttctgtggtgagttgtgtgtttctgtgtacactctaacacaagttaactgccttaatttttttccatgaaatacaccaaattttaaaaatctcttttgcttctctctatgggcccccactgaacaaggaagctagctgagaatcaggtccttgggggtggctgctcttgcttactcagtgcattgctcacagaaacacaccaggcttatagtgcgccatttaagtttgtacttcagcacaattggaaattactacatactgtggactttttatggttgcttgcaagagttaagccaacaaattttaaatccacagatacctagaggtgatagaaatctgttcatatctctagtgacttcttttttttttttttttttttgagacagagtctcactctgttgcccaagctgcagtgcagtggcacgatcttggttcactgcaacctctgcctcctgggttcaagtgattctcctgcctcagccttctgagtagttgggattacaggtgcgcgccaccacacccggctcatttttgtattttagtagagacagggtttcactatgttggtcaggctggtctcgaactgctgacctcgtgatccacccaccttgacctcccaaagtgctggtattacaggtgtgagccaccatgcccggcctctagtgacttttgtaggatagatttcttgaagtccagctagggattatggaatataatgccaagttactttttggaaaggttataacaagcgaggcaactattccattttgcagctgagaatctggaattcgtggaagttaagtgactttctgagtgtggatttgaactttgaattatttgattccagagcccaggttctcagaagtgcaaaaaacatggtattgcttcattcttcctgtaagaagctggattttgcaaaaacactttgatttgtacagcggtggttctcaaacttcagcatgtatcagactcacttggaagacctgatgaaacacaagttagggatgccctagctacagtatttctgattcagtaggtaagaagggcccacccttgagaaccactgatttagaacattatcctgtcttgattccttccccttctgcggagtgtgatagcttctgatactgagggatggatggactaacatatcattactgtacaccagtcattctctttttttggtacagaaaaattggaatgaacattctttttatattattcttttttaattcctaagtgagctaacacaggaggaacgaccttttttaaagtacagttcatcaactgggaatttgttcaaaatgcaatttcttgggctaggacttggactcagcagtctatattttaacaaacaagtgatcctgattcaccctaacatttgagaatcattgctgtacaatagtggagaaaactagttggcaagcatttattgatttctgggatttttagcacaaatttcactctacagttttcctgtttataaaagaaatattggttgatacatgcccaagggaataactttggtgtggatttttaactctagaggaaaggacactgatttcagatctgggttcaaattctgattctgttacatattagcaaataatttcttatctgtgaagccttagtttccctgagaggttgtgatgatttaaataaaatggttatagctatcgtttattgagcacaagctagtgttccactcactatgctaaccacttcgcctaattatctttatcttttgggggagttttaaaaattattccatttagtagttataggactattcaaattacctattttatgttggatgtgtactttccgagaattgacccatttcatctaagttgtcaaatttatgtttgtagaattgttcatagtatttctttattatccttttgatatcttcaggtgctgtagtgataattttgtttcattagtgatactaaaaatgtatcaggctgggcatgtgatgtcattcatgcctataatcccagcactttgggaggccaaggctggtggattgcttaagcccaagagttcaaaaccagcctgggcaacatggtaaaaccccgtctctacaagaaatacaaaaattagcagggtgggtggcacatgcttatagtcccagctgcccgggaggctgaggtgggaggattgcttgagcccaggaagttgaggcctcagtgaactgtgatcatgccactacactccagcctgggtgacagagcgagaccctgtctcaaaaaaaccgaaaacaaacaaacaaaaaaaatttgtcttcgtatttgtcagacttgctagaggtttgtcagttttatggatcttttcaaagaacaagctttttgtttcattgactttttctgttgtctttctgttttcaatttaatagatctctgcctttactatttttttcctcctttggtttattttgctctctatctagtttcttgaggtgggagattagattattgatttgagactttcttttctttttttttttttttttattttttctgaaacagcctgttgcccaggctggagtgcaatggcgcgatctcggctcgctgcaacctccacctcccgggttcaagtgattttcctgcctcagcctccctactagctgggattataggcgctcgccaccacgcccagctaattttttgtatttttaatagagatggggtttcaccatgttggccaggctagtctcgaactcctgacctcaggtgatccacccgcctcggcctcccaaagtgttgggattacaggcgtgacccacagcacccggcctttctttcttttctaatgtaagcctttagctgttaagtttcttctcagcaccaatagattttaatatgttacattttcccttttcatgtagttcaaggcattaaaaaaaaaaaaagtttttttttttttttttttttttttttttgagacagtgtctcagtctgttgcccaggcggtactgcagaggcaggatcatagctctcactgcagcctccagctcctgggctaaagtgatcctcctgctgcctcaaggcatttttaaattccccttgaaacttcctgtttgacccatgaagtatagaagtatgttgtttaattttgaagtttttgtagagtttcctgttatcgttctgttactgacttctagtttgatagtggtcagagaatatactttgtatgatttcaattcctttacatttattgagatttgttttatagcccagagtctatcttggtaaatgtttcatgatcactcgaaaagaatgtgtattctgccatttttgggtagagtgttctataaatgtcaattaactactgttggttaatggtgttgctgaattcttctaatccttgctgattttttcttttttcttttcttttttttttttttttttgagatggagtttcgctcttgttgcccaggctggagcgcgatttggctcaccgcaacctccggctcccaggttcaagcgattcttctgcctcagcctcctgaatagctgggactacaggcatgtgccaccacgcccagctaattttgtatttttagtagagacggggtttctccatgttcgtcaggctggtcttgaacttctgacttcaggtgatccgcctgcctcggcctcccaaagtgctgggattacaggtgtgagccactgcactcggcctactcattcattcattcatttatttttgagacagggtctctatgtcacctgggctggagtgcagtggtttgatcatggtttactgcagcctcaaattccagggcttaagcaatctcctcatgcttcagcctctacaatagctgaaactgcaagcatgtgccactgtgtgccctaatttttaaaattttttgtgtggggagggtgtgggtgtaggttggtggtacctccctttgttgcctgggatggtcttggacttctggcttcagatgatcctcccacctcagcctcccaaagtgctgggattacaggcatgaactactgctcttggcccgagttatctctgtattgcttttttcagtacttgctctaggtattacattatacatataacttaccataagcaactgctcttgacattttaccagtttgattgaagagtagaaactttacttttctttttcctttttttttttgagacagagtctcactctgtcacccaggctggagtgcaatgatgtggtctcggctcactgcaacctctgcctcctgggttcaagcgattctcccaccttagcctcccgagtagctgggactacaggtgtggtccaccatagccggctaatttttgtatttttagtagagacgagttttcactatgttgaccaggttggtctcgaactcctgacctcatgatctgcccgcctcagcctcccaaagtgctgggattacaagcgtgagccaccatgtccggttgaaactttacttttctttatatgccttaatgctcttttgtttataatctaattaatcgttttgttgttgttgagacagagtcttgctgtgttgcccaggctggagtgtagtggaacagtcacggctcacctgcagcctaaacctcctgggctcaagtgatcctcccacctcagccccccaccccccagtagctgggactacaggcatgcaccactatgcctggctgattttttttttttttttttttttttttgagacgaagtctcgctctgtcgcccaggctggagtgcagtggcgtgatctcggctcactgcaacctccgcccctccaggtttaaacaattctctgcctcagcctccagagtagctggaattacaggcgcccgccaccacgcccagctaattttttgtatttttagtagaaacggggtttcaccatcttggccaggctggtcttgaactcctgacctcaaatgatccacacgtctcggcctcccaaagtgctgggattacaggcatgagctactgtgcccagcctactcattcttttaggataagtgttggcaacagatacgtttagttttccttaatctgagaatatcttgatttcccttgaattcttaggggatcttttcacttcatatcgaactctgggtttctagttcttttatctcagcgcttgaaaactgttctgctacttccttttgccctccatggtttctgatgagagagcctctgtcattcaaattggtgttctccttgaggtaatgtgtcatttatctctcattgctttcaggatttttcctttgtcttttgcttttaggaatttgattaagccatgtcttagtgtggatttgttccggtttgtcttttgttgtagtcctgtaggttgctgaggctctgttcattttttttccaatctgttttctttctgttgttcagattggataatttctattgttctatcttcaacttactgattcttttctctgttttctccattctgctgttgaattttcatttaagttactaaagaattttcattgttactgtatttttcagttctaaaaattctgttagattcttttctatatcttctatttgtttgaagagattttctattttttgttgacactttctttttttttttatttgagacaagagtctagctctgtggcctagactggagtgcagtggtgcaatcttgggtcacttcaacctccacctcctgggttcaagtgattctcctgcctcagcctcccaagtagctgggattaaaggcacataccaccatgcctggctaatttttgctgacactttctatgtatttatttattttattatgatgatgatgatttttttctgagatggagtttcactctgttgcccaggctggagtgcaatggtgcgatctcggctcactgcaacctctgcctccctgggttcaagtgattctcctgcctcagcctcccgagtagctgggattacaggcacatgccaccacgcccagctatcttttgtatttttagtagaaatggggtttcaccgtgttggccaggctggtctcgaactcctgacctcgtgatctgcccacctcagcctcccaaagtgctgggattacaggcatgagccactgtgcccggcgacactttcaatttattcatttgtttcaggcatgttcttaattgctcattgaaacatttttatgatggcgcctttaaaattcttaaataattccaacatctgtgtcatctcagtcttaacatctgttgattttcttttcttattcgagttgtgattttccttgttcttggtatgacaaataattattttaattatattctggacatttggggcattatgtcacgagatcctggatcttatttaagacttctgtttttgcaggccttctcagacactgcgctccggtggcagaaagggggtaccacttcatgactgccaggtgggggtggaagtacaggttccccacttggtctttggtgctatccaccacctgctaggtgggtggatcctgctgtctctagtcggtctgctttcttcccttcacctttcagagttttatgtttgttttgtatatattgtccagggtttttagctgtacttggagggatagggaggagtgcatctacttcatattgttccagaaccagcagtgataggttaaataatgtgcccaaagctacacagacagctggaccacagatcaaacctgggtctcctctactttcactgtagaatacagtattatagacaatataagcactgtttaagttgttagaagttatggaagatagggaaaatcagatatgtgctatgtgccaggcattgttctggacaccggggtgggggaggggggatacggcagtgaacatgagacagtaaactaacagcttaatatatagtgtgtcaagtgataatacatggtctagagaaaagtaaagtagggtgagcaggagaaggagtaccaccccagggttgaagtagtggttactttatacaggatgattacagatgggttacctatgagcctgaaggaaagcgaggaagggaaccatgctggtaagtaggggaagagtgtttcaagtagaggacataaaggacccaagtggggagcagacctggcatgctaccagtccagtccaatgctattggaacagagtgagtgaggggagagtaatagaagctgaggttaagggtcaggggtgtgcagatcatatacagcagtgattttccaagtatggttcccagaccagcaggatcagcattatctaggaactgattaggccaattcttggatcccaccccagactgactgaatcagaaactctggagatggagccctagaatctgtggtttaacagcctttcagatgcacgctaaagtttaaaaaccatgggtatagggtgtaaggacttggtttttactctggatgggagccacagaagctttttgagcaagtgagagttgtgatctgatttaggttttggctcttgtgaggatagactaaaggtgaggagcaaggtagaagcagggagaatttcggggctactgtagatcattattccttaaagtgtggtccctggaccagcagcatcagcatcacctgagaggtcattagaaatgcacgtttataggcccaacccagtcctactgaatcaagatgtctggggatggggcctaggaatctgtattttaacaagcttaccaggtgtttctaatattccctaaaatctgagaaactttggtctagttaggcagtggtggcttaaagcagagtcagtgatgatgagaagtggttggattttgaatatatattgatacaggatttgttaatagattggattggggttgtggaagaaggaactcaagaatgactcaattttgaagaatttggtgtaaaggggactagagtaatggggcagagactgaggggatcacaaaagggttttttgtttgggttttttttttttttggagatagaacagtctgtctgtgtgcatgtcagtgcatatgaagttattccgttggtgcatccagaattcagtgaaacctgttatatgacaaactcataaaggagacacttcctaggtacgctggaacttgctgtgtcctttgcattcctttaagtcctgtgtgcctggagttggaggggtggggcggtgggaatggtggatgcttcagcttctggttttatagatggtgctctgtctggacctggatccttgggtaccctcagaaggcagaggttgaggagataagaagccagacaggatcttgagcaaaatcatcatctctcaggcatctccaagtctcagctcccactcagttccacatccctggaagagttgagtgtccattttggagtgctcataacacttgactgtattaatcaccccacattatatcctggttacatattgtagtgatatagtagagtcacaaagtcctgaatttgtatcctgctctgctacttagtagttttgtaattgccaacaatttacttaaccactcagacccagatttctcatctgttagattaggataatattaacgatgatgatgatgatagctaatacttaacatgtgccaggaactttaagtacttaactattttagctcatttaatcctcttaaccaccctgtgaagtgggtactattagtacttccatttcacagatgcagaaactgagatgcagaaaggtgaagtataaattgcttaagttcacatagctagtgagtggcagaggtgagattcaaacccaggcagtttggctcctaagcctgtactttaaacctctgcttctgtgtttaatgtctgtgaatgttgtacggaaggccctgatttgttgtggagattaaatgtgataatatgtgaagttcatagctcagtttttttctcagtgccttttatgctaacttcaaattcattcactcactatcctgttaccttgctttactgactttatagcacttacgaaactgttttgacactgcctctctgtctcccgctctaaaatgtccagtccatgagggcagtgtctgctcaatcaatatttgttgaatttatgcactcatttacttaacaaatactgcttaccgtgtgcttggctttgcagtataccatggggataactcatcttaatcacaagacctggtgctataataattatcctcttgactaaggaagctactcagagcaaatcagcatttaccacccttggtcccaggtggtaactatcgagacagtgcagccagaagcccgatttttcatttgtctgcctccctgatatgaggagttgtctagcacgttgatgtttgttgaataataagtaaggcaagactgagagatgggaaaggtgaggacttttggtaaataagatacactatctggcaaatgtagtggggacagacagcaggtaagtgagcaattccaaggcctcgtggtgaaggctgaaatagggatagtgttgtgggggtgccacagcagcagggaaaaggaagagcaggaatgttccaggtagaaggagatacctgtgatgaaacccagaggctagagctagacagagtatggcaccgagagtccgctggctttttagagcagagctggcttcatgggtgtgcaatcgttatagtcacatggtgccccatgcctgaggtttaatgttctgtggtggttgtcttgaaattcttaataattttgcctttgattttgtgattggtatgtgatggaacaatggagtgtgcgctggggatttaagagtcttggctcatatgtggttctacctcctgctgccattctacctccccgaacaggttcttggctagctgcctggggcactgggcccaggtgcaggtgtggacagagtcggttgggttcatgtaccctgtgtactaagtcaccgggcagggccccagggtacttgtgtgggcctgcactcgccccttgagttatccctatacccaagggagcgtgacagtaaatagcatattaaaactgcatggtaagttgagagagagaccatggaagaaaggaaaaagcttttctattttttgaacagggagctcccacttttcatttccattaggccccacagattgtaagtgggctatgcagtaggaatgtctcccccagcatacgctgtgtgtgaggggaaagacgtgagctcagccagagaggcaaggccttttgggccatggtaagtttatactttaccttaggaaaaatagggaccctgtgaggcattttaagcatgggttgataggatcaaatttgtgtttttaaatgatcactttggctgtagtgtggagggccgattgggtagggacagaataggggccaggagtccagttaggagggcaggacaataactgagttagagataatagtggcctgaactagcgcaggggcagtaaggatgacaaattaacacaattgatagctaataaagagagttgataggacatgctgataacttggataataacaacaaacatacacagcacttactatgggccagacactgttctaaacactttctatatatttagttcatttgcttttgataacaaccttgtgaagtaggtacagtttttatccccatcttacaatgaggaaactgaggcacagagaggttaagtaacttgtccaagatcccacagctagtaagtggcacagccaggatgcaaacccagagaatctggacctaaagtcagtgttcttaacttgatgctagaacgtctacttcagggtatagtggagggagagggctagaggtgaatcagtgatggctgccaggtttctggcttgaatgcctggtgaggttatggagccatttgcagaagtgggaaacctaagagaagggagcatgtttaggtgacagacagaaggagaaactgagtttggacatgttgaatttgaagtacgtaagtggctatccagtagaaatgtctcacccaggagacatttggagggaagggtctaatctggcttggagttatgagtgcatagagggcacatggagccctgggagtgagaacagtgaggaaaagtgaggagaaaagagtgcccaggtaagaggacctaagaaacttcaacatttaaggactgggcaggagaaaaagagttcatcgggaaaaaggaacagccaaagacatgattaaaatcacatcacatccctactcatagtggctgttactccccagttcttgtggctacccaggaaaagccagagtgctttacagtggcctacaacaccctactacatgagtctattgcctttctgacttattactgtcctcctacctctctactctagaacactctcctcctctctgctaccttcggagtctagggatgctcccaccacagggcttttgtacttgctgttcttattgggatgctcttccttcatagccacatgaggggcttgctcccttactccctttgggtctttattcaaaagccattttgtcagtctttccctgtcttccctatctaatatttcaccctcactaccattcttcctggcccccccattgtgtgtgtgtgtgtgtgtgtgtgtgtgtgtgtgtggtgtgtatagttatatattcacacatacatattcctctatatcccccttcctgtttttttttctacctaggtcttctcactatccagcatacaatgtgtttcaccaattgcattgatttatcttgtttcttgtctgcctccccactagaacatcagctctatgagggcagggatttttgtatgctttgttttttgtcttcgtctcaccagcacctagaccagagcctggcggatgctcattaaatgtcagctgaaggaatgggcaccagccagatgggacgttatagaagtcaaggatagagagcttgtcaggtggagagtgtacagggttggcagggcgaaaatggtgctaagaggttaagggagataaagcagagaagtacttattgcatatatcaacaaggaggtcaggaaaccagtgagatctattttaaagaaggtggggactaagatcagactagcaggagatgaatcacaaagtgcatatagcaaccctaaaaaagtatcgatttggctctgatagaacacctctggatactactaggcagctaagggtgggagggagactttttactgtatatacttctgtactctgagttttgcaccatgtacagctgttacttattcaaaagaggagtcattatcaagcttcgtaggtttatttacttcatttttaagctgcataggtttaaagaaagaatgtgtttggctgtgaaggggcggacagaagggagggaggatgggagggcgggtaggtcttggttttttaatttgtaaacatcaatagacttgtttaaatgctattgtgaagagaaagagagagattgaagatactgcagaaagaaggaataattgattgagaaggtaagaaaacatgtgacccaggtggaaaacttggctttagaaggaaggaaagatagtacttttgttgtgataggaaaaaaaggatgggtgtagaaggaggtagattggtgatgagaagttaaggtagttcacctctgattacttaattttctctaagaagtaggaagtgcatcgcttcttggtcttttggctaagatcaagtgtagaagtaggaagtggctggcatgatggctcacacctgtaatcccaacactttgggaggctgaggtaggaggatcacttgaggccagaagtttgagaccattctgggcaacaaagcaagaccccctctctataaaacacacgtacagacacaaattaggtgggcgtggtggtgtgtgcttgtagtcctagctacttgggaggctggggcaggaggatcacttgagcctaggagttaaaggctgcagtgaactatgattggcaccactgctctccagcctgtgcaacccagtgagaccctgactctaaacaaaacaaaacaaaaacattaaggaactcaaagaatgaaagcaaagagtgcttaacaacaacaacaacaacaacaacaaaagccaaaaccaaaaaccagaagtagtaggaagcaaggtaatttttgagagagaagaggcaggtagtggggtgagagatttgacacagccacagtagataatgagagagagttgagtggggaatttcagaaggattgtcaggcagcatgatccagatttttttttttttttttttttgagatggaatcttgctttgtcgcccaggctagagtgcagtggcatgatctcggctcactgcaacctctgcctcctgggttcaagctgttctcctgcctcagcctcctgattagctggaattataggcgcccaccaccattcccagctaatttttgtattttaagtagagatggggtttcaccatgttgaccaggctggtcttgaactcctaacttcaggtgatccacccgcctcagcctcccaaaatgctgggattacaggcgtgagccaccgtgcctggccaatccaaatattttggacagtgaatttatgatggcaccaatccaatgggttatttttctctagccacatctagtggtctagagttaggtagttgtactgagccagggttagggtttgcatatggggatgaaaggcagtggggcaagtgagggtatctgtaagagaatgattgaagtgaggaatgctggaatctcaactagatagggaaggagggtaaagtcaagaatgtgtgaataggtgaaaagtatgaggataaagagttttgagggcaaagaacaggttgtagtgaatgagagctggatagatagacttgtggtcagagagggcgatgtatgagtttcatattccagaggtacagcagttgctggtgttgacagggtctgggggatggtcatgagagttggtagctgaaatgggagtagaggtaacagtctctgaagatgagaagatcaaagaactaagtgcctggaatgttgtgtctccagatggatactgatttcatgtaggatgttgtcaggactcgggatggggaagatctgagcaggttcttcagcgagtgaaggggtgtgttggggagatgggtatgtggcagtgatgaagaggagtaggaagtggtatggctggatggtgtggaactcagaggagtgggagctcttacacaagggtagaggagagatgatctggaagtctcaccagagagtgagagggatggctacccacaacccagtcctgagttatgagggtatgggagaatgtgcagctataagggctctagcacaatgctgcttagattttctgtggcaaagaaccaaggcacttttaaaatttccaatctataatgggccgatccttttatgatataaaaaaagaattactagaaaaaaatggtatgaaccggccgggcgcagtggctcatgcctgtaatcccagcactttgggaggccgaggcgggcggatcacgaggtcaggagatcgagaccatcctggctaacatggtgaaactccatctctactaaaaatacaaaaaattagctgggcgtggtggtgggcgcctgtagtcccagctactcgggaggctgaggcaggagaatggcgtgaacccaggaggcagagcttgcagtgagccaagatcgtgccactgcactccagcctgggtgacagagcgagactctgtctcaaaaaataaataaataaataaaaatttaaaaaaatggtatgaaccaaaagacatataaaagacaagcccaaaattttattcttagattgaacggatataaaattattctgttaaattgctgtaaaaacttctgcataatagtgatgcttactcttactttctgtacttaccacagacctgtagtaaatagttcacagaccggcattagtctgtggaccacactttgagtggcaccggtgtagagaaaatgattttcccgtaggagaagctgcattcagttaagcctggaaggtgaaggagtgtttgttgaagagagtgccaatgttgagcagtttgtttaccaagttgggaaaggggatgagcagcgggtgtttagagtagagaaagcacatagccacatagggtgaaagtttaggggagagagaggtgtccagagggaacaggggtatgagatagaaagcatgcagtccagggaactgagttaatgctacaaggtctggggaatatctttgaagaagttttaggcaggtgaaaggtgaggtccggactggacttctagcacttactgtgaaaccggatacttactgtgtatcagactttatgctcactgtgctacacacattagtattatttttgtagagatggggttaccctatgttgcccaggctggtcttgaactcccggcctcaagcgatcctcccactttggccgcccaaagtactgggattacaggtgtgagctaccgcgactggccatgctgtgcactttatatacattatcttattgaatccttaaaaaccctacaaagttgatggtgatatccctagtttattgataagctgctggtttataggcatgagattattagttgggaatatatttagttgggatattgggaagattattagttgggaagtcctaatcccaggaagtccatttatgagcatgatcttggctgaaacaacttgagctctgccttaatgttctctgctgtgtgtggtaaaccaaacattttaagacttgggtcttctttttttttttttttttttttttggagacagggtcttgttctgtcacccaggctggagtgcggtagcacaatcatggcccactgtagcctcaatctcctgggttcaagggatcctcccagctcagcctccatgctcagctaaatttttttgtttgttttggtagagatgggggtctcaatttgttgcccaggctggtcttgaactcctgggctcaagtgatcctcctgcctcggcctcccaaagttctgggattataggtatgagccactgtgactggcctaggtgtttaattttagcaagaatttatttggagggctgctggtgccttccctagtaagggaaggttgaattttgtgagattaccacctcatatacatgcaaagtcaaattttcaaaattaagtaaatctttttaagtctttaaaatgtgaaataagcaacagatgtttattgtaggaaattagaagcacagataagataaaaaggattatctgtaatttttcatttagaactactgttgactataaatttttttttttagtctttttcgtttaataaagtatctcaagtttaaaaattaggttataaggctgggcgtggtggctcacacctataatcctagcacttcgggaggcagaggcaggtggatcacttgaactcaggagtttgagaccagcctggccaatgtggtgaaacctcgtctctactaaaaatacaaaaaattagccaggcatggtggcacatgcctataatcccagctaattgggaggctgaggcaggagaatcacttgaacccaggaggcagaggttgcagtgagccatgatcacaccactgcctaatacagtaacccctaaccacatgtggctgctgagcgcttgaaattttaaattttatttaattttaatggatttaaacataaatagccacatgtacttaatagctgttctactggacagcactgttctagacctcataaaaaataaaatttccataaaccttggctgtttttctctttttcagttgtgttggtgttgaagaggagaaggctgctgacattgacctctaccactgccccaactgtgaagtcttgcatgggccctccattagtaagtagatcttagggtttcctagagaagacaatccagaggagagacaaaggaaaggaaatttgggggagtgattgcttttgcctgagcacttgtgattcttcttcctcaggaaatagcagaagcctatgcaggctccacaggccagcacctatctcactaagaggacagaagttcataacttcacctccctcccttcctaaggcttatctagagaaagtacccatccatcttcaccaggaactttcctgaatctgtgagggcctcattgactccagatgctccaaggggtggttagattggaagagaaggatctgctgaggcctttgttcttggtatcatagctcatgaccgttctgactcacaatctctcatgtttttctggcttagtgaaaaaacgccgtggatcttcaaaggggcatgatacacacaaggggaaaccagtgaagaccgggagccctacgttcgtcagagagctccggagtaggacttttgacaggtgaggaaccctgcctccagtggctggtgaatgccagggctctgggaagctggaactcacctcttcccagctttcccagtggctgtcccattaggagcttccccagtttgtgagtatcttcagggctctgcaaattccttctggtttggtcaattcctggaaaacttctggtagttgggaggcagtattcacctaagttagatacttacattcatccaaggaatgctgactagaaggagtcttaggatcagaaagtttaattctctcatagagaagaagaaactcttttaatataaaaaaattattggtcatatatctcttttatgatcgaaaagaggttttatctttttaaaattaagctggccttgttaaaagtaaattacatgaaataagcaaaaataatgagttaaaaaaaggaacaaagcattctcctttgcttggttttttaattcagtagaccatgttcaggttttttaaaaataattgcaactggccgggcgcggtggctcacgcctgtaatcccagcactttgggaggccgaggcgggcggatcacgaggtcaggagattgagaccatcccggctaaaacggtgaaaccccgtctctactaaaaatacaaaaaattggccgggcgtagtggcgggcgcctgtagtcccagctactcgggaggctgaggcaggagaatggcgtgaacccgggaggcggagcttgcagtgagccgagatcccaccactgcactccagcctgggcgacagagcgagactccgtctcaaaaaaaaaaaaaaaaaaaaaaaaaaaaaaaataattgcaactttgattttagattcaggaagtacatgtgcaggtttgtttacgtgggtatattgcatgtgtgaggtttggggtgcaaatggtcccatcacccaagtagtgaacatagtacccagtagctagtttttcagccccttccctactacctccctcccaacttgagtggtccccagtatctattgttcccatctttgtctatgtgtacccaatgtttagctcctacttaaaagtgagaacaaaagcagtatttgattttctgttcctgcattaattggcttacgataatggtctccagctgcatccatgttactgaaaaggacatgatttccttctgttttatggctatgtagtattccatgatatatatgtaccacacttttctttatccattccactgttgatgggcacctagtttgattccatgttttactattgtgaatagtgctgcagacatatcagtgcattcgtctttttagtagatggtttattttcctttgggtgtaaatccagtaatgggattgctgggtcgaatggtagttctcttttaagttctttgagaaatctccaaactgctttccatggtggctgaactaatttacattcccactaacatggtataagtattccctttgctctgcaggcttatcaggatctgttatttttttttttacttcttttcaggttttctgtaaccaaagtgttaattggaataagtgttccttcaacttaatgtttcttgttttatttgtttatttaaaggcagaaacttctcctctctactctggactcctcaggttctttctccaaagtcaacccgttatttgtagatcctttcagaaatggtttttgcatatacaaacatagatttttttaattcctttttttgacacaaatggaaacaactatatattgttctgtatcttgcttttttttaaaaaaatatatatttgagatcaatccataatagcacatacagatgttctttttcatggctgtttaatattacattgcatggtgtaacatttatttaaccagtcctctactgagggacgtttaagttgattccagtattttgctattagaaagaaatactgtaatgaatatctttgcacttaagtttttgcatacgttgccagttacatccatagtggctataccatttcacactcccacagataatgtgcggagggtgccgattttcctatatcctagccaatatttgtttgtttgtttgttttattttatttatttatttattttgagacgatgtctcgctcttgtcccccaggctggagtgcaatggcgtgatctcggctcactgcaacctccgcctcctgggttcaagcgattctcctgcctcggcaccccgagtagctgggattactggcgcctgccaccacgcccggctaatttttgtatttttagtagagacggggtttttaccatgttggccaggctggtcttgaactcctgacttcaggtgatccacccgccttggcctcccaaagtcctgggattacaggtgtgagccaccgtgcccagccaccaatattatttattatcaattttttttttgcctttctgataaaataaatcgtgaaatcctgctgttcccacttgtacttcttttctttctttcttttttttttttttttttttgaggcggtgtcttgctctgttggctaggctggagtgcagtggtgcaatctcagctcactgcaccctccgcctcctgggttcaagcaattctgcctcagcctcccaagtagctgggattacaggcacgtaccaccatgcccagctaatttttgtatttttagtagagatggggtttcaccatgctggccaggctggtctcaaactcctgacctcaagggatctgcccaccttggcctcccaaagtgctgggattacaggtgtgagccactgtactcagctcacacttgtatttctttaattatgaaggaaataagtagattttttttttgagacagggtctcatttgagacaggctggagtcgggtggtgcaatcaccactcactgcagccctgacctccctagcttaatccatcttcccacctgcgcttcctgggtagctgggactacaggtgtgtgccaccacgcccagctaattttttttttgtattttttgtagagacggggttttgccatgttgcccaggctggtctccaactcctgggctcaaacaatctgccttccttggcctcccaaagtgctgggattacagttgtgagctattgcactcagccttagatttcatacatttataaaccagcttgattgttttctctgtgaactacttgcttgttttataggcattctgttgtgttactattactgatttataacagctttcttggagaaaattttaatttctatatggttaagtttattactatttttaatgactgctgggtttttcccaggtttttctactcttaaagctttattttttggaatttaatctttggaccatctaggattatgtaaagaatgagataggcaggccaggcacagtggctcatgcctgtaatcccagcactttgggaggctgaggcgggcagatcacctgaggtcgggagttcaagaccagcctgaccaacatgtagaaatcccctatctactaaaaatacaaaattagctgggcgtggtggcgcatgcctgtaatcccagctagtcgggaggctgaggtaggagaatcgcttgaaccctggaggcggaggttgtggtgagccgagattgtgccattgcactccagcctgggcaacaagagcaaaactctgtctcaaaaaaaaaaaaagaatgagataggcattgagcttgagcttaatatatttgtcccaacacaagttgtcagagttgtcaaatacaaatctttcctccaccatgatttaaaagaaaactattttctgcaccatgatttaaagaaaactattttctttcttttctttaaaaaaaaaaaaaaaaaaaagacagggactctctctgtcacccaggctggagtgcagtggcatgttcaaagcccactgtaacctcaactcctgggttcaagtgatcttcctgcctcagcctcccaagtacgtaggactgtaggcctgcaccaccatgccctgctaattttgaatttttttgtggagacgggtttagaaatgatgcccaggctgaaactcattaagtatgcacgttgagaaagttgttgtatatgcatgttgagaaagttgttgtaaaaatgttgttgttttgtttaaatcagtcttttctctttgacagtgttttaaattgggtaatgctgctcttggtttgaacaaatctgtcaaacttgtcagatgtgtcttttctttctggccaggctgttgactgatttcttcttgtcacccagagaagagcaccatgttggcagaatactccccacctctgccagtgacctggtctcttgccttggacagatcatttcttccctggcagatgaggtttttggcattagttgccagctcacattaagtcccctcataaaaaccccacctcttgggtgagtggcagcctccaataaggcctttagtgggcagggcctcaggctcaagctttctctcctgcggcccacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggtaagacactacagacccttttaactgtaacattgttcattcctgtcaagatctgtgtcccttcccctccaatctgtttttgcatttcctctgtaaccatcttgggaatctcaggtgaaatgccttgtccaaagtcattctttggcagagatagagtcaaaatcctagtctcctctttgttctcctttcatgcattcactcattcgtttatcagagacagggtctcgccctgttgcccaggctggagtacagtggcgcaattaactcactgcagcctccacctcctcctgggctccagggatcctcaaacctcaacctcctgagtagctgagactacagggatgcaccaccatgcctagctagttttgtttattttttgtagagatgatgtcacactatgttgcccaggctgatctccaactactgggctcaagcgatctttctgcctcggcctcccaactgggattacaggcgtgagccaccacgcccagccccttctccttttaatagtccataaaaccccaggttgagctccgttttttacctgggaagttctagggatcattgtctgtcttctgttgaaatgagaaagcttttgactgttgttctcacatgccacttgttgtctgggcatgagtttctggggagaggaagagaagaaatggagaagcaaggcccaggcagatggactactatgtgtgaggctgtgtgtctggtagttccattgccctagcagggcacatagatctaaggaaagtgcgatgggttccttcccctgccccccaaacaaacacacacatatatgtacagtgtcagtggagagaagctttgagtgtaaggccattctagggactgatgaggggacaagagagtcttccacagtccctgagactacttggtgcagaacctatctctttactccaggttctgacaaagagattgatgtgattgatgtgacccgccaggctgactgcaagatgaagcttggtgattttgtgaaatactattacagcgggaagagggagaaagtcctcaatgtcattagtttggaattctctgataccaggtaagaggtgcaggaataacaaaaaaacctgacaaagtgcctgaaacttgtgtgatatatctagtgtatattcgtgtttctctctctttttttttttttttgagacagagtcttgctctgtcgcccaggctggagtacagtggcacgatcttggctcactgcaacctccgcctcttgggttcaagcaattctcctgcctcagcctcctgagtagctaggattacaggcgcccgccaccatgcctggctaatttttgtatgtttagtagagatggggtttcaccatgttggccaggctggtctcgaactccctacctcaggtgatctgcccgccttggcctcccaaagtactaggattacaggcatgagccaccgcaccttgcctcgtgttcctttctcttcttcctggtggtttcttcctttgggatggcgagctgggttatattttctagggtagctgctcacgttgtaacagttgagtcatatttctcctccacagtttctagcattggatagattacatagtagctattttaattaatttttgtctcctttttcaagaccttaggacacccttctttgaccttttcctcctatatacaacagtgccacagtcactgtgtaactggtgggataggtcctcagttcctggaaatagatttactaaaattacccccatgtaggtttcttacatttaaaaagaaaaagagaaacctatttacctttaaatgattctatctggactcacacacacagtagatacgtatatagtcttctctttgggtcagaaatgtgggaaataccaagaaatcataatgtatctttttgcccttaggaaacttactgtctgattatttacatttttaacttttaatttgtagattgataggaagttgcaaaaaagtgtacagggaggtcctgtgtactctttagccactttccctcaatggtaacgtattatgtaattacggtacaatattaagacccttgctgttgtgttttttttttttttttttttttgagacggagtttcgctctgtcacccaggctggagtgcagtggcatgatctcggctcactgcaagctccgcctccctggttcacgccattctcctgcctcagcctcccgagtagctgggaccacaggcacctgcgaccacacccggctaattttttatgtttttagtagagacggggtttcactgtgttagccaggatggtctcgatctcctgacctcgtgatccacccacctcggcctcccaaagcgctgggattacaggtgtgagccaccgcgcccggcgctgttgtttttaagatgcaaggttaaacaacctgagagtgtttaaaaactgtatttgtttgtttatacttcacttcatcctgaaagactattcaaggtagcttacagagatgtggagaagccaaaaaaaaaagagagaaaactagaacaaaagtgaaataagattgggaaatagaatgcatgtggtgggtgctcagcacatttcccggttggtggaaatggactatagagttttcagtgaatttcctgaaggtcagaacaaagagaggagtgcagtattgtaagatttgtggctttacgtaggataaaagcaacagatgtttcagagaaacatttctttacctggaactgagccctgtgaggttgctctagtggtttctcataaagaagacactatgagatggggatagtgcaataacttctataatccacatgccaagtgagtagtctggagtggggctggggagtatgagcatttagtggaggaaatgaacacctttgactggagaagcctgtggagcttggacttgggacttctggagatgagtagaatgaggatactgaccagacttacagaacagaaataagtgtcctatgtgcctttggggattctgtggagggaacttgttctctgacttatctgaccctcactgaactgtggggtattttattcaggcctcaatcttctcttcctaatcagctgacatctgctctccaccccttccttggtagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaaggtaggaatgcgcatggcttctggaggcagccaggccttgggcctccctgtacgtgtcacatggcagcacagaaacattttgaatcagtttgatttacattttgaataaaaaaaatttgatttggccgggcgcggtggctcacgcctgtaatcccagcactttgggaggccgaggcgggcggatcacgaggtcaggagattgagaccatcctggctaacacggtgaaaccccatctctactaaaaataaaaaaaattagccgggcttggtggcaggcgcctgtagtcccagctacttgggaggctgaggcaggagaatggcatgaacctgggaggtggagctttcagtgagccgagattgtgccactgcactccagcctgggcgacagaacgagattccatcttaaaaaaaaaaattgattcaaaaatgtttgacgaatcaaacgtttttgaataatagcagatgcctgaggttttcctggttgttaccttcttttttgttgttgttgaggcagagtaaaaacaaagattttatttatttatttgagatggagttttgctctgtcacctaagatgacagttgccagtgctggactgcagtggcgtgatctcagctcactgcaacctctgcctcccgggttcaggcgattcttctgcctcagcctcccaagtagctaggattataagcgcccaccaccacgcctagctaatttttgtatttttagtagagacggggtttcaccatgttggccaggctggtctcgaacgcctgacctgaagtgatctgcttgcctccacctcccaaagtgttgggattacagtcgtgagccactgcacccagccgttcttaccttcttaattgaaccagtttatactcatatcagcatgtatggaaatgtccacatttactttggaaattcctggtaacatgagaaacttccctttctccaacattattgaggtataatttatatactataaaattcatccattttaattgtacaatttgatgaattttgtcagttgtatatagtcatttaactgccaccacagtcaagataaaacctgtatgagaagtctttttaaagtcaggatttccatagtttcatttttagtaattgttacaattttgtaattagtgtattgtcagtgactatgaaggatttttgaggtctggaaaacaaatttcttaaatgattttggttttcaccattgttcagattatttagttttcttttttattattattatttttttcttagaaacagaatctgtctctgtcacccaagctggagtgtggtggtgcagtcataactcactgcagcctctcactcctgggctcaagggatcctcccacctcagcctcctgagtagctgggactataggtgcatgccatcactcccagctaattttttttaccttttttttttttttttttgagacagtctctcactttgtcacccaggctggagtgcagtggcatgatcatggctcactgcagcctcgacctgctgtgcttaagctgtcctcccacttcagcctcccaagtagctgggactacaggtgtgcaccaccacttctggctaattaaaaaaaattatttttgtagagactagctctcactatgttgcccaggctggtctcaaactcctgagctccagcagtcttcccaccttggccctcaaagtgctaggattacagacgtgagccactgtgtccagacaatttttttactttattttttgtagagacagagtcccactgtgttgcccaggctggactcgaactcctgggttcaagtgatcttcctgcctcaacctcccaaagtgctgagatttcaggcttgagccaacatgcctggcctagttttcttatcagaaaagtcaaaggaaagaatggaaaacttggattgtggctcttgtccaagtgatcacaagtccttacctagttgtttccattggtttatcatttaggaagtagaatgtgtaaatgaaagtgctattatgcaaatgttaggtttaactcttttattttaaaataatttcattttatagaaaagttaaaaaataatgggaagaatgtctgtctgcccttccctgagattcctcaaatgttaccattttattatattctctctctaaagcaaacacaataaaatggttatatatatatttttttcctgagacatttgtgcgtaaagacataatatttctttatatcttaataattcagttgtagttcttaactacaagtttgtcttaaaactttgtcttaaaaacaaagacaaagtcttaaataatttgtatagttatcaaaatcaggaagttaacattgatatactagtacctaatctacagacctgattcaaaattctccggttgtacacctgatatttctagtgttacttttctacattgaaatttattatcatgaaatactggttaaaccaatcatgctgtgagaatatatttgtgctactgggtttttgtttctttctttttttttttttttttttgccaaattatctttctggtgtttatccaggcaaaacacaattaggaaataaatgttcttccaaaagataatcacataacatataatcttccagaagtccttgggcgattactgaacttttaaacttttattagctttgattgcaggtgtgggaaggaacactctgtaaatggcatttgaaggcaaattcaattttcttctcatcagtaatgtggccttaaattctcctaaggctactagtattgatctactcatctgtagaggccattctttatttggcattgtgtctaaaataggaacacttggtgtacatatgtcttaacttgaacaattttgtttgaaatgccctttccaatttgtttttgtcaagtttatagaaacttaaaagtacaaaaagcaaagtgaccttttgaagttttccaaatccacaaagaaatgataattggatgggtttgggcaagaactctggcatattgccatcgttttggagcatgggagaaatacccctttggagtacccgttaaggacttttctggaaacccttggtatttttgtcacttcaacctctttttgtttcagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacaggtcttcccttgggtgcttctgggagggtttggggagggtggaaagaagaagggagcttttggccccacagcatattaatctgattacgtgggatgtctttctcatatcagcgaaaggcgcagaactgggcttcaagaaatttcatgtggtagtcagtgggcagcatggtcacctggggaggctgaaagtggggaatgtccaggaggaggctgatggacttctttgtcctgggttgatgtcatctgggtgaacagagaacatgactctaagccccgtaactctagggatagtgcctgggaggctggcattctaggctctaagtcagaatgacctgtggtggggatagtgctttttttccctaaacagtttgtacctgggcttcactcttagaattatgaattcttaggtcttgggtgggatctgagtatatttattgtgaaaaaatcccccagttgtctcaatttggggagagttgacatctttacttgattaggtcttatatgaatacagggtatctctccatttatttagattttctttgatttctttaatcagaattagtgttaaattttcttaaaatgtatagtagaattctctagtgcaatcacatatgcctggagatttgttttcttgggaagttttaaattaacattcaatttaaaaaatctttaaggttattcagattttctatttcatattaaataagttgcgatcatctgctcttcaaggaattggtctatttaatctaaattgtcaaatatatgtgtggagttgttcatagtgttttcttttttttgagatggagtttcactcttgtcacccaggctggagtgcagtgatgcgatctcgtctcactgtgaccactgcctgcatcccaggctcaagagattctcttgcctcagcctcctgggtagctgggattacaggcttgcactaccacgcccggctaatttttgtatttttagtagagatggggttttaccatgttggccatggctggtctcgaacttctgaccttgacctcaggtgatccacccgcctcagtctcccaaagcgctgggattataggcgtgagccaccgcacccagccatagtattttcttattacccttttgatgtcttccaagtctctagtggtattctttgtatcattcctgacgttagttatttgtgctttctcttttgtttgtgtcaattttctataggttggtcaattttattgatctttccaaagagccactttttttttttttttttttttttttttttttttttttctgagacagagtctcactctgtcacccaggctggagtgtagtggtgcgatcccggctcactgcaacctccgcctcccaggttcaggtgattctcttgcctcagcctcctgagtagctgggattacaggtgcctgctgccacgcctggctaatttttgtatttttggtagagttggggtttcaccgtgttggccaggatggtcttgatctcctgacctcatgatctgcctgccttggcctcccaaagtgctgggattacaggggtgagccaccgcacccggcccacttttggttttattgatttttctctgttgtctttttgttttcagttgtgttgatttctgcttttatctttatttttccttccctctgcttgctttgggtttattttgttctttttctagtcttgagatgagagcttagtttattgatttcaggctttccctaaatttccctctcagcattgatttaggtgtgtcacacaaatattgacatgttgtattttcattaagttaaatgaggttttgaaaaattgagatacatcttaaatattgtaaaatttaccattttaaagggtacaattcagttctttgtatatttacaaggttgtgcaacatcactgctatttaataccagagaatgttcattatgttatttatctcctttttgagatggagtctcactctgttacccaggctggagtgcagtggcacaatctcggcttactgcaacttccgcctcccgggttcaagtgattctcctgcctcagcctcccgagtagctgggactacaggcttgtgctaccacacccggctaatttttgtgtttttaatagagatggggtttcacccatgttggccaagctggtcttgaactcctgacctcaggtgatccacccgtctcagcctcccaaagtgctgggattacaggcgtgagccactgtgcccggcccgaatgttcattgttttttaaaaaaaccctatactcattagcagtcactctttattcatttgtctgccagcccttgacaacccctttttcacttcatttgtgtatggatttgcccttctgaatatttcatatagatggaatgttgtaatatgttgtcttttgtgtctagcttctttcacttgtaatgttttcaagaatcatccatgttacagcatttatcagtatgtccaggctggagtgcagtggcgcgatcttggctcactgcaacctctacctcccaagctgaagcgattctcctgcctcagcctcctgaatagctgggattacaggcacctgccaccactggcctgggtaatttttgtatttttagtagagatggggtttcaccatattggccaggctggtctcgaactcccaacctcaggtgatccacccacctaggcctcccagagtgctgggattacaggcgtgagctactcctgctccctggcgagtgcatctttttttttttttttttttttttgacggagtattgctctgttgccaggctggagtgcagtggtgcagtggcgcgatctccactcactgcaacctccgcctcccaggttcaagcgattctctggcctcagcctcccgcatagccgggactacaggcatgcgccaccatgcccagctaatttttgtgtttttagtagagacggggttttaccatgttggccaggatggtctcaatctgttgaccacgtgatctgtctgcctcagcctcccaaagtgctgggattacaggtgtgagccactgcgccgaccacttcgttctttttaacagctgaataatattctgtggtgtggatatgccacattttgtttatccattagtcagttgatagacatttgagttgtttgcactttttggctgttatgaatagtgttgctatgaacattcgtgtacgagttattgtgtgaacgtaagttttcatttctcttgggtatatatctaggaggggaattgctgagtcatatgtaactctgtgtttaactttttgaggaactgacaaactgttttcaaagcagctacatgtaccattttatattctcaacagtaatgtatgagaatttcagtgtcttcacatcttcccccaatgcttattgctgtctctttatgattatagccatcctaatgggcgtaaagtggtatctcattgaggttttgatttctgttttctggatgacctttgatgtttaacatctttccaaatgttcattggacacttgtatagttttttttggagaaatatctatttaaatcttttgcccattctttaattagattgtctcttcattgttgagttacaagaatttatatactttggatactagacttttaccagatatgtgatttgcaaatattttctctcattcttggggttgtcttgtcacttttttgatagtgtcctatgaaggacaaaagttacaaattttgatgcccaatttatctatttttttttctttatttgcttatgcttttggtgtctaagaggcttgcttaattcaaggtcatgaagatttatgcctatgttttcttctaagcattttatagttttagttcttacatttagatctttcatccattttgatttatattgattttgtgtatggtatgaggtaagggtccaatttctttcttttgtatgtagttctagttgtcccagaaccttttgaaaagactgttctttccccattgaattgtcttgacacctgtgtcaaaaatctgttgaccaaagataagggtttatttctggaccttgaattctattctgttgatccttctaacagtgtcacaccatctcaattattgtacatttgtagtaagttttgaaattgggaagtgccagtgctccaactttttctttttcaggattatttggccccttgaatttttttttttttttttttttgagatgaagttttgttcttgttgctgaggctggagtgcaatggttgcggtctcagctcactgcaacctcagcctcctgggttcaagcgattctcctgccttagcctcccgagtagctgggattacaggcacccgtcaccatgcccggctaattttttcgtatttgcagtagagacggggtttcaccatgttggctcagctggtctcgaactctagacctcaggtgatccacctgccttggcctcccaaagtgctgggattacaggcgtcagccacagggcccagccggtcccctgaattttcataagaattttttggttcagctttcatataggttttctagttattttgtagtgtttgctctaattattactttatacatacatagcatatcacagtctactagtatttacatattacctgtttgagggaagggttgaaaccatacctcttttttttgagacagaatctcattctgtcacccagcctggaatgcagtggtaagatgacagctcaccacagccttgacctcccaggctcaagcaatcctcccacctcagcctcccaagtagctgggaccacagatgtacactaccacgtctggctgatttttttagttttagtggagatggggttttgccatgttgcccaggctggtcttgaactcctgagctcaagtgatccacccacctcggcttcctaaagtgctgggattataggcgtgagtcaccgcaccgggcccaaaaccttacctctttttacatccctttatccttcgcatttttctacaattagtcatgttttacatttttccatgtatttgtcttaaatatttctcttcatacattgattatgagattgacgtgctacccactacaccaagagggctactatcctctgcgtatgttgagaactgtatcacaaagttttataatttttgctttccctatgaaacataatttagaaaactcaagagaaggaaattctatggtattcacccatgtttttactcatctgtttattctgttttcctttctggtctttagagtttcagggtaggtctactgtcgacaagttcttagtttttttccatcagtaaatgtcttgattttttttttctttcattcctgaaggatatttttctggatatagaactctgggttaatagttcttttctttcaacacctaaagaatgttttgctgtttcgttctggcctctgtggtttctgatgagattttggctatcatctgaattgtttttcccctatagataatgtatcatttcttgatgctttcattcttttttttttttttttttaagttttctgcagtttggccatgctgtgttttttttggtgtggatttctttgggtttataatgctgaatgtgttcactgagcttcttgaatgtgtaggtttatgtcttttgctgtatatgtgaaatttttagccattatttcttttcctttttttttcttttctttctttctttcttttttttttttgagagggagtgtcactctgttgctcaggctggagtgtagtggagcgatctcggctcactgcagtgtccgcctcccgagcagctgggattacaggcatgtgccaccatgccctgctaatttttgtatttttagtacagacagggtttcaccatattggccatgctggtcttgaactcctgacctcaggtgatctgcctgccttggcctcccaaagtgctgggattacaggcatgagccaccgcgccaggctgccattatttcttgaaatacttttttagactcatgctctaacttctgctggatctctgattacatgaatgttttgtatcttgtcttagtcccgcaagtccttgagtttatttttctgtgtcttttttctctttgttcaagttcagattgggtaatttcggtttctctgtctttgcattttctgtttctttcttctgttgtctccattcttctgttgagtttgtcaattgcattaattttagatacagtatttttttttttttgacacagagtttctctctagcacccaggctggagtgcagtggcgtgatctcaactcactgcaacctctgcctcctgggttccagtgattctcctgcctcagcctcccaagtagattacaggcacgcaccaccatgcccggctaatttttatatttttagtagagacagggtttcaccatgctgatcaggctggtctgaagctcctgacctcgtgatatacccacctcggcctcccaaagtgctgggattacaggcgtgagccaccacagctggcccagatacagtacttttcatttctaaaattttcttttgtttcttgtgtatttctttgctgagaatttctatttcctatttttgtgtcaagcatgtttggaattgctcactaaggtattcttatgatgatttcttatgatgatttctttcaaattcttgttacataattctatatttgtctaaccatatattgtcttatatatattggattgtctattgttttacaagtctgtttttctcttcaattatcaatattattgatacgatttcattggttttttagaatgtttaatacatggtgaggcaggtcattcactcccacccaactcccacccccatctgcttttctcttttatagttttctgttcccaggcatttattcatccatctttgaatcctttgcctggtctagtccataatgacttttctatactgggcatttagtaactgatggattgaatttgcccattagcggtttgagttaattaattgacatcttggtagaaatgcccacacaccgggtgcaatctacttagggccacaagcattgagtgtctactgtgtgccctggtattgggctaagtgctaaggacaaaagattgataggctgtttcagtataatattctactagccacaatagcaccaataggggtattcaccactagttttggaagcacagagaagagtgcttagtctagccataggtttgtgaaagtcttaggagagcaacactagaagggtgagtagggattaactatgaaaagaaagacaggaatggcatttcagacatagggaaaggtggaagaaaaccaaaactgtgtgaagcagcttatggatactagagcttaaagagcaagggctggggtggatgaaagtgaaaaggtaggccgactgaacttaccacagaggcgattgagggccattgaaggtttatttagtttctaatgaaatatttcagatgtaccaaaagatataaagaacaatataggccgggtgcagtggctcatgcctgtcgctgaggctggagtgcaatggtgcgatctcggctcactgcaacctctgcctcccgggttcaagtgattctcctgcctcagcctcccgagtagctgggattacaggtgcctgccaccatgcccagctagtttttgtatttttagtagagacggggtttcgccatgttggtcaggctggtctcaaactcctgacctcaggtgacccacccgcctcggcctcccaaaatgctgggattacaggcatgagccactgtgcctgaccctaatttatattttagatatatcgcttaggaatggatgtgaaggatagatttgagattattgtagagcagtggtttgcaaacagtcggtattcctttatactcttaaaaactattaaggacccagaagagctttttattatgtggtttatatttatcaatttttaccatataaattaaaatagaaaatttaaaagtacttgttaacttattaaaaaataattataagcccattacatgttagcataaataaaattttttttatgaaaactgttttcaaaaatgtttagtgggaagaatgacattgttttacatctttgcaaatctctataatatctaggttaatcaaaaattgttagaaccccagatctgcttttgctttcattctgttggatgtcacatcatgtacttcctggaaaactccactgtatacccatgagaataagggtgaaaaaggcaaagaacatcataatattctcatgaatatagttctgagtggcatctcagcttctctcaaagagtctcagggagcctaaggattccttggaccacaccttgagaacatctggtgttgggaagccagtttggaggctaactgctcttaaggagttgggtttgagatgagtaggtagtggagataatcagaggaagaaaggccctcttccagctttgattttgccttgttacactgcagggtggatccatgctgtgctgacgcctgtggactgccttgcctttggagggaacttcttacacagccttaacatcgagatgcagctcaagtgagtactgaaactgtggtgattctatgttggccattcctgtctgctagagtgaggagtataatgtagaaggaggggacatggccagaaaggaatggttcctcgttcctgatcatgttcagctgaagattaacaccttttctgcacttagtagttatttgactttgggcaagttatataacctttgaacccaagtttcctaatgtgtaaagtcagatcttgcagagtcattttgaggattagagatacaaagcatccagaacaaaacctgattcatagtaggtgctcagtaaatgaatccttgtttttgttgttggtgtttcctccttctagagcctatgagattgagaagcggctgagcacagcagacctcttcagattccccaactttgagaccatctgttggtatgtgggaaagcacatcctggacatctttcgcggtatggagccctttgccaactgtcctttttgcccctctcccctgagtgaatgagtatgtgtgtatgtgtaagtaacgcagtcaagacatgatactatttcattaccagaaagatctcagtatataaattaaaatcatgttgtgtaccgtaaatatgttcaatttttaaaaagtgataattagtgctttaaaaaaaatctccctagtgctacccgcccagccccgagccccttcttttttgagataggatttcactcagtcacccaggctggagtgcagtggtgtgatcatggctcactgcagcttcaaactcctgggctcaggcaatcctcctgcctcagtttgccgagtagctaagactacaggcatgggcccccacacctggataattttgtaaattttttgtatgaacagggtcttgttatgttgaccagattggtctcaaactcctggcctcgagtgattctcccacctcagactccttttgctggggttacaggcatgagccacagtacccagcaatgctacccctttatagtccctttatagtttcacccactctcctcccttgtaccatccgtaacttctggaaaccactaatctgttttccatttctataattttgtcatttcttttttctttttttccgagacacagtctcactcttgtcacccaggctggagtgcagtggcgtgatcttggctcactgcaacctccatctcctgggttcaagctttgcctacctcagccttctgagtagctgggattacagacacccgccaccacactcggctagtttttatactttttttttttctttttcttttttttgagatggagtctcgctctgtcaccaggctggagtgcagtggtgcagtctctgctcactgcaaactctgcctcctgggttcaagtgattcttctgcctcagcctccagagtagctgggactataggcacgcgccactgtgcccagctaatttttgtatttttagtagagacggggtttcaccatgttggccaggatggtctcaatctcttgacctcgtgatccgcccgcctcagtctcccaatgtgctgggattacaggcgtgagccaccacgcctggccaaatttgtcatttcaaaaatattgtataaatggaatcattatagtacgtgaccttcttagattcacttttttactcagcataatacatggcaaggcatggattttaacctttttgtttagcaagtgtgactgaaaatattggatcacagtgaaatgatctctatttcctgctggttaagataaaaagttcaatttggatagtctgagagtttcctggatctgcttcccctggggataaggcccagtcctgaccgtcctggcatcattgttttggttcctgggcgttagcccagttggaagccactttacttactgggtttcctctttccttgtctgatccagaatagaatgggtcccttacttaggcctgagattcttcaagttgacttggccaggagaaatcagtattgatgagttataaagaatctcaggggccatgagtacagcctcgtagccaatacctcaagctcttattctgccacctagactgtcacttaagtgttcaatcagatgctggatgactaactgctcattacttattctaaacagcttggttcagtagaaaattatttatagagcctaaatctggctgtttgtagtagcctcctgacataaggcagaacacagctaatccatcttctacattaatggcccttaaagtctgtgtaggtagagctcatagtcctcctgagtgttctcattttgaaacccaggaggcacagtaatgtcatggaaggggcccaagcctcagattcaaatacacatggttttagtcatggctctagcacttgctaggtgtgtgccctgggtcttgactttgcctctctgaacctcaattttctgggctgtataatgaagataataccttgcttacaggataggtataagtgttaaatgagataatagatatcacattcctagcacttagtaggtactcagtgaatgaacactatcagaagaactgagatctgcagttgtgctcagaaccttgagcattttctctggttgtcttaacaaaagtcccaagtccttcactttcctgcatggctttgttgacactctgctttcctctttcctcctttaggtttgcgagagaacaggagacaccctgcctcctacctggtccatggtggcaaagccttgaacttggcctttagagcctggacaaggaaagaagtaaatatgcatatttctctacctcctctggagttttgccctttgtagggactggatttgggtagatgttttggagagacagaagagaccagagaagcttgtgggctcctgggtgtagagtggaggtgtgggctaggattcctttgattacattttaaaatctttctttctgatgataaaaagtaatacaacatcacactagagaattagaaaaatgaggaaaagcataaagaaggaaaattatcacctatgatttttacactcagcgggaactgctattaacacttgtgtacatttccttctggtcttttttatgtgcattttaaaaacataattactgtcacactgtgtggttgacccttgaacaatgtggaggttggggtgcagaccctgccccccaatgcagtcaaaaatccacatataacttttgcctccctaaaaccttaactgctaacagcctactgttgaccagaagccttaccagtaatatagtcaacacatattttgtatatgttatttgtgttgtatactgtattattacaataaagtaagctgaaaacatgtgtttactgttcataaagtggaaatgaatcctcataaagggcttcatccttgtcttcacatggagtaggctgaggaggaagaaaaaggagaggggttggtcttgctgtcccgggtggcccaggcagaagaaaatctgcatataaacggacccatacatttcaaacccatgttgttcaagggtcaactgtatatccagttttgtgtttgaatctattggtttgtcttaattttcctgtgtcaccaaagttctccagaaacatttaatagttatgtgatattcttttgcaggaatgtaccatccttgcctaactacttgcttattgctgcttcctttttatttctttgaggggatagttttaaagaatcagacagtaaatatcagtctttgtccctcatttcttgattgtttcttcaggatggattcctggaagaacaattactgaatcaaagtatatgaaaaaatgtaaggctcttgatgcatactgccaaagtgggttttagaaatgtacaaatgtccatttatccaactgaacattaatcaactataaaaaaaaataagaaagctctgtatgtactgatttggaaagatctccaaaatttgtcaaggtgcacaaccgtgtgtatagtgtgccactttatatgtaaaaaggggagaaataagaattatgttagtatatacttgcctggatatatgatctgggatgtagaaactaatgaaaatggttacctgtgggagtgggatgatgggattgatggcaggggcagggtgggattgatggcagggacagggtaggaatgaagcttttcaatatcattttattttattttattttattttatttatttatttatgagacagaacctcactctgtcgcccaggctggagtgcagtggcacgatctcagctcactgcagcctctgcctcccaggttcaagcgattctcgtgcctcagcctcctgagtagctgggattacaggcatgtgccaccacgcctggctaatttttgtatttttaatagagacggggtttcaccatgttggccaggctggtctcgaactcctgacctcaagtgatccatccacctcagcctcccaaagtgctgggattacaggcatgagccaccacacctggcctgcctttcttttctaatgtaagcctttagctgttaatttccttctcagcaccaatatttgatttttgacctatgtgaacgaattaacttttcagaatactgaatttaaaaaacacaccaagaaatcaagagaagaagaaatgtcaacatgtaatcttaggcttcagatactccctttcctgtgtatactgtgaccaaaggtcactgcactgcaggcttaacttgtacaatctccttagttcctgttgccaaccttcccctcggatattcttggatttcatattttgagccttcccttgctccctgggctcacctacacctggaccttagcctgtgattctgtttctccacacctctcaggtgtggctaccttgggtttcatctctgacacctcccatggagtgaactttagagtgactgtgtcccaaaaacaccaaaagggaggtgggtgtggcccaagcactcatgactcaggatggacccagggaccaagggatggccccaaacagagtgatcagtgggagctggagtagagtagaacacagttctgagaagcccatgctcatggaaggagtcttttgtgaagtgcagatgatttgtaggggaggaacctgctccctcacctttccagagaccctggtctgggaaggaggaagccataagattatttagctgggtcacatggattctcagctccccgcctagccaccaaaataaattccaccagatagatgaaaagagttaaagggaaaaaagagaattaaaccatgagaaacaaggaaatgctgaggaattttttatcagccctctggatacagaaatgaagtgaaaagtggtagaaaaaaaatcacaaaggaagaaaaccttgagatctacataaaaatgtaaatctcggtactcaaaaagagggcaaacgaaagagagacaactaacagggatcgctctgggttgctgttgagctagctgtgggccagcagctgctcagcacagagttctttcctcacaagtggagaggctggtttgtccccactgatctccctgaggtccttgacttttttgaggggtgtggcccaaacccacaacttagttcctaataccttttgatactcttttattagatagatgttttacaaatattttctctcagtctgtgccttacaaagtagcagaggtgctgaaatagaggtttttcaaaaaagttttgctttttaagtccagttgatcaacttttttcttttctggtccatgcttatgtcctatctaagaaatctttgcctaactgaaggccacaaagaactcctcctctgtctaaagcaggggtttccagccggggtgcagtggctcacgcccgtaatcccagcactttggaaggccgaggcgggtggatcacctgaggtcaggagtttgagaccagcctggccaacatggcgaaaccccatctgcactaaaattacaaaaattagccgggcgtggtggtacgtgcttgtaatcccagctactggggaggctgaggcatgagaattgcttgaacccaggaggtgaaggtttcagtgagccgagaccaccacaccactgaactccagcctgggtggcagagtaagactctgtctcaagaaaatagtaagaagtaaataaaatatagcaagggtttccaaccttttggcttccctgggccaccttggaagaagaattgtcttgggccatacgtaacgatagctgatgagctaaaaaaaaaaaaaaaattacaaaaaatatcataggctgggtgcagtggctcatgcctgtaatcccagcactttggaggccaaggcgggtggatcacctgaggtcaggagttcgagaccagcctggccaacatggtgaaaccccgtatctactaaaaacacaaaaaattagctgggcgtagtggctcactctagtcccagctactgtggaggctgaggcaggagaatcgcttgaacccgggaggcgggggttgcagcaagccgagatggtaccattgcacttcagcctgggcaacaatagtgaaactccatctcaaaaaaaaaaaaagtctcataatgttttaagaaagtttgctaatttgtgttgagttgcattcaaagccatcttgggcagtgggttgggcaagcatggtctaaagggtgtatagttttaggttttacatttaggtctatgatccattttaagtttgtgtttgtgtgtatggtgcaagatagggattgaggtttgtttgtttttgtttttttttttgcatgtggatatccaattggtccagaatcatttgttgaaaagactactctttctccattgaattgccttggcatatttgtccaaaatcagttgtctctttatgtgtgggtttattcctcatgcctcttgtttgacaggctctgccagaccatgaggatgagatcccggagacagtgcgaaccgtacagctcattaaagatctggccagggagatccgcctggtggaagtaaggagcatggggcagggaagaaaaggcatttggaaaggccttgaggctcaagtggcaggttaggcctctgcagttagcatgagagcccaggggaagggtcgggaagaccctaccaaagacccaattcattcgttcaaataattattactgtgtttcaagtgtgccgcacattgggctaggctcttaaaatacgtaaatagtgcctgcccacaaagaactcagcctaatagaggaccctgagcaaagttaacctctttgagtttcagtttcctcatctctaaaatggggataattgtacctactcgaggattgttaaaaggattaaataaggtaatgtgggttgagcacaaaaatagagtgcttggcacacagtaggtgcacagtaaattctgacggtgggtcgtggtggtgggtggtggtggtagttgtagttgttgttattattaatattttgactcagtctctgcattctgcaaaatgacagttctctcggggtgaagatgattacaaagccatgtttcaacaggtggcatataccacgaggcagtaaggtatagtggtaagagattcagagaaacctgggttctggttcctgctctgtcacttgcaagcctttcagagcctcagtttcctcatctgtaaagtgaggataacatcaacctttcaggattttgttaggatcaaaagctaatatatgtagagcccctcgcacagtgcctggcagagtaagtactcaataaatgtgagccattgttattagtagactttaatagcaaagagagaagttggtgtgggatggtgaagtagcagaggcaccagaggagaattcctttaagctcagaagctgtaaagttttatttagtgcccaggatatatacatccatgctgaagggtggtcaaagtgagctgggaagttgtgcttctagcctcaatgcttgcagcatgtttcactgcctacaccatagcttacagtgtccacctcctacctctcattttcctccagtcccatctgtcaaaatcattcaggatagttaaaggcttaccttttctccagcgcctctcacttaaaccacaaaactttgggctggttggaagaggacttagagatagattatatgtggtccatgggctttcaaatgttttaaagcaatggaatcctttttttaaaatgacatcttaggtggaagcccaatattcaaagcataactgctttgaataagatgaaggtgggaggcccagggctccacttgttcttctcattcgccttctaccttcccccgattctcggggctcctcccaagaagctcaaaggagccacagaacatcttcaaaaatcacctttccagtctagtcctttaattttacagctaagcaaacagtctcaaatggtcagataactttcctgagctagttacagagctagctagcagcagaattaggactagaacctctccttctctcaaatcctgtagtccttagaatttgaaccacacagattagtacttgattattttctgtctcatgtcagctacttaatggagtattttctctccagttttgacagtagtgctttgctcgtcttcttacttgtcaatggctgggtaaagaaatgccacccaataaattcttgatgactcattatgtaaaagctagggtgtgcatatgtggagcatctataagccacttccatggcagtaccaccagtaccaggaacagacctctgctgttagtgttgagagaacccttgagtaagctctaaccccctcatgtactaacactcttgtaggacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaaggtgggtgctggcccatgggttcagcccaacccttttgggtgtcccttggaagagcagggtttcaaaaagcaggctatcctgtctggctgccatgtcccttagaccccctgctgtttggctaccagtcccactcatttaataggcatttattgagaccttttctatgccgggcactgtgataggtgctgtggatgtgactctcaagaggctgacaggcgagtgagaaagacaggcataaaaacaaatgagtgcaatcaagtattgtgaatgccacaatcaggggtgtgtgtgggaccctgagatacagaggagggttgattctgtctgggtagggaagattttcaggagctcttttcagaaaacataacacttagctgaattttgaaatgctgggacgggaatgagatttgaaaacattgcgtgtgtcaggttgtagtcttgagcaggtccttgagaaaagccctccaccagggctccatcttgcctcaagattgtgattctctccatgggcatctgaagatgtgccccctcttttttaagggaacatggttcacaagattgacaggtgtcccctgaaccaaccacacattttcaacctcctgctcctgtgatcagtgggggtatggggggacagtatagcagaaggccttggctcaggtggttttgacagtgaactgaaccagtgaaaccagagggaacttgccatcgtgattcccatgggagtcccagacaggtaacggctgagtctcctacttctacagttcaacatcactggtgcctgcttgaatgactcagatgacgactcaccagacttggaccttgatggaaatgagagcccattggccctattgatgtctaacggcaggtgaggtgggaaggaggagcacagaggtactgggactgtcagtggtaatatgccactgagacagggcatggaattggaatctaggggttgggacatgggtaggagggactgtacttagggcaatacctagatattataatgtattgttgcttagttcagagaaccatggtgtggtgttggaggtgggtagagtgagaggtctgaaatcgaattggcaagcctgagaaagattttatcagttctagaaacttcagcaagtcattgggagagaaccactggcagcaataagtatagcatacttactaaaagcattagttttttctataccttttgactttcgattagatttttaggaatttagtttacagaaatccttgcacacaagtgtgtaacgataaatgttcagtgttcactgcaccattgtttgtaatagtaattggaaacatccaaatgttcatcagtaagggctagataaataaatgatggtacatctatagaatggaatatcatgtagctgttaaaaagaatgagacagttaaatattgacacagaaagatgttcaaggtatatttttaaaatcaggttacataataatacataggaatagttccatttttacttttaaaagggcatgtatgcacatgtgtatatgtatgcacgtatggaaaagctgtatatagacatttgtattttttgaagaggtttaaaaatgcaatatacaagcgttagaaataaaacagtgtgaaagagcacacagtgaaaaatctcacacccatctctctttccctgttaccttcccatggacaaccaatgtcagtggtttccttccagagatatgtatgtacatttaggcaaataaatagtgtgttatatatatgtaaatacctttaaaaaaaaatagagatggggtctctgttattgcccaggctgagctctaactcctagactcaggtgatcctctcacttcagcctccagagtgctgggattacaggtgtgagccaccttgcctggcctagttatatattttatacttctcataccaagttttgttttttttttttttttttttttttgagacagagtctcactctgttaccaggctggaatgcagtggtgcgatctcagctcactgcaacctctgccctgctcggttcaagtgattctcgtgtctcagcctcccaaatagctgggactgcaggcgcatgccactatgcccagctaatttttgtatttttagtagagacagggtttccgcatgttggccaggctggtctcgaactcctggcctcgagtgatccgcccacctcggtctcccaaagtgctgggattacaggcatgagccaacatgcccggccttgttataccaagtttttaacagtggttatccctggaaagtacaatagggaaggtaagagcaaattttcacttcagtagcatttgaattttgtacaatgagcacgtatttacttttctttaaatatttatttacttttctttaaataattttaaaagaacaagttctaaaagaataaaataaaagctgtttacaacaaaattatggacttgggaatcaggcagtccgaggtttaaatcccagctgtgacacatattcagtgttctactttggcaaactaatgaacctatctgagcttcagtgtcctcattatatgtattctatagttaaaacttaccttagggttgttggaggattaaatgagataatatacgtagaacgttaaccacagggcctgccatataattaatacttaatacatggtagttcttataaatatgatgatgaagatagagacaaaagaattctccatgaagatggtgataatgatgtgggtatgaccagaatccaagaagattgtcagaaaccctgaaatacatagaggcaggggaaggcagtaagggctattttctagatactcagaacactagacatcagcagtcaagagccaagtgcagagtatgaacgatgtaggaacacaaacaacaaaggtagcttaattgcctccttgtaggaaaaggttaccttcaggtccatctgggcccatctgggtggaaaataagggaaaaaggagtgagagtagggcagattctgaaagcaacagagctattcttggggtttgagaatccagttactaaagtgtaagattagagagaccgttgaatattgcctttgtccagaactcatgataggtctcctggacaggagaaaattcagagtcctaggagtctagcctataatggctattgaaggtacaataagacatttcctgcccctgccccacccccagcagtccttcttgtgctgctgcctattacccgctgcagctgtcagaagctgttaagtgaacccagatagtcaaagtatagaaatatttacagatgatgtgatgctatgtctgggcttctctccaaacttggtgttttgaagagaatgaggtgtagatgaaacaagactggctgggttgataattgctgaaacttagctgagtgataggtatatgagaattaattctacttttatatttttgtgtatttgaaatttttctttaaaatttttttaaaaattattagagacagggtcttgctgtattgcctgggctcaagcagttctcttgcctcagcctcttgagttagctgatactacagacatgcactaccacaacccagctgaaatttttaattattagaagttaataaaagatcagggcatacatagctgtcatttattgagcatctcctctgtgtcaaagtctatcttagctgtttatatacactattttatttaatcctcacaaccccaaaagtaagtagtagtatccccattttactaaggtgaaaactgagagtcagagaaccttataatattacctacatggagcagttgccatggatcaagctctgtatgagctcatttaatcctcaaccctctgaagtagaaaataggtcagttaaatgacagacaattcactgaaagtcaatttaaccaaattactagttgctaaatgtatcaatttactgatttaccaaaaacatgtttctttttaactgtttatgaggtttttttcagcagtttgtattggttaatatcgtctactatgtgtaacaggattatctaagccactttttgagtcctgaacaaaggcagtgttcatttcaaccagcaatcatgagtgtcttcacttactggccaacgtttgttgttttttttttctttttgactgtagccattgaggtttttccagcagtttatattggttaatatcatctactatgtgtaacaagattatctaagccacttttgagttctggacaaaggcaatgttcatttcaaccagcaatcatgagtttcttcacttactggccaacatttgttattttttttttcttcttgactatagccattccggtggatgtaaagtggtaactcattgtatgtgttttttaaaaaataaaaattgtggcccggtgcagtggctcacagctgtaatcccaacactttgggaggccagggtgggcggatcacttgttaggagtttgagaccagcctggccaacatgacgaaacccttgtctctactaaaatcataaaaattagccagacatggtggtgggtgcctgtaatcccagctacttgggaggctgagacaggagaattgcttgaacctaggaggcgggaggttttagtgagccaagatcatgccactgtactccagcctgggcgacagagcaagactccatctcaaaaagaaaaaaaaaaaaagcaaatataaaaattgtctatatttaaggtatacaatgtgatatttgataaaatctatactgtgaaatgattatgccagtaaagctgattaacatatgcatcacttcacatacttaccatttttgtgtgtgtttgtggtgagaacacataggtctactctcttatgaaatttcaagtatacaatacagtattttttttttttttttgagacggagtcttgctgaggcaagagaattacttgaacctgagaggcggaggttgccgtgagctgagatcatgccattgaactccagcctgggtgacagagcgagactctgtctcagaaaaaaaaaaaaaaaaatttttttttggatacaaatcctttgccagataaacgatttccaaatattttctcccagtctgtggcttatattttattttcttaatggtttcttttgaaatacaaaaatttttaattttacttaatcccaggtcataatgatatttttctgtgttttactctagttttatagttttaggttttacatttagatctatgatgcattttaagttaatttttgtatatgatgtgagataagggtccacatttatttctttgtatccatttttctcagcaacttctactgaaaaaaaccatcctttccctcactgagctgctttagcaccttttgtcaaaaatcatttgatcataactgtacgggtttattcggaactcttttccactgctgtatgtctgtctttatgctggtattgcattgccttgattaccatagctttagagtaaattttggaattgagcagtataagtcatccaatgttctttttcaaaattattttggctgtgttaggtcctttctatgtccatgtacgttttactatcagctttttatttaaaaagctggctggattttgatagggattgtattgaatctgtaggtcaatgtagagagaattgcaatcttgctagcgactaacaatactgctagtgactgtttttatgttctccttcccttcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaagtgtgtgtctgttctttctttttcctcccctgcccgtttttttgtttgtttgttttgagacggagttttgctcttgttgcccaggctggagtgcaatggcacgatcttggctcactgcaacctccgcctcccgggttcaagtgattctcctgcctcagcctcctgagtagctgggattacaggcatgtgccaccatgcctggctaattttgtatttttagtagagatgggatttcactatgttcatcaggctggtctcgaactcctgacctcaggtgatccgcccatctcagcctcccaaagtgctgggattacaggtgcaagccaccacgcccagcccttgcccattttatatttgtttttggccctcttgatagacttaagaccttaggcctgagcttgttgacattttgctatactatgttctgtaggccttcattgtttcctttgttctaaagatttatttatcacctgatccctaacctctaaattagtcatctgtggtcattacttccaagaaaattagtcttatttttttcttctgggtatttggctgaaatgctaatcatagcttcataataagtgcattccattgttttctagaatttccccggaaattgccccgtgcgaagccttgctctgaccccaaccgagttcgtgaaccaggagaagttgagtttgacattgaggtaggattctgccctggatctagtcttctgctcattctggtgatagagacagaagacagattgtcattctagttgggggatatgcagggaggaagacatcctttgcattcatttcctgaataatttatttattattactattattttttgagacagagtctcctcgctctgttgcccaggctggggtacaatggcatgatcatggttcacagcagtcttgacctccggggccagctcagccttctagtagctgggaccacaggctcacaccaccaatgtagctaattctttaaaaaaaatttttttttgtagagatagggtctcgctgtgttgcccaggctggtctcaaactcctgggctcaagcgatcttttgccttggcctcccaaagtgctggaatcacagggtgagccactgcatacagtgaaatatttattaagtgaaagattgtgtgccaagtgctgctgagcatataaatggaagatttcaatttagttgaaataccttaaacatcctttaatacagaatagaatgaaagtcagtgtgggccgggcgtggtggctcacgcctgtaatcccagcactttgggaggctgaggtgggcgtatcatgaggtcaagagatcaagaccatcctggccaatatggtgaaaccctgtctctgctaaaaaattagctgggcgtggtggcacacccctgtagtcccagctacttgggaggctgaggccgaagaatcgcttgaacccaggaggcagaggttgcagcgagccgagatcgtgccactgcactccagcctggcgacagaacgaggctctgtctgaaaacaaaaaataaaaagtcagtgcgatgtagcagaaagagtatgtgatatggagtatctgatgtgaccttacacaaattatttaacttccctgagccttagttttcttatctgtttaaaatgggagtatactacctagctcacaaagatgccttggaaattaagataaaagaatgaatattctgcttagtacttggtctatacttggtgctcagaagatattaatatcaggagtcagatcatcgcccctgtactggggccttaccagaccaatcctgggcagctgaggtgatacactctctctccaacaggaggactatacaacagatgaggacatggtggaaggggttgaaggcaagcttgggaatggtagtggcgctggtggcattcttgatctgctcaaggccagcaggcaggtggggggacctgactatgctgccctcacgtgagtactggcttttatctcccctttccaggctatcagacagcaacccccgctcccgcccaaggtgccaggtcagccaatcagtagatatttatagagctatttaaagggacaaagaattatccagggcatttgggtgaaagaataaagtaggcatgaaaccactcctaaggaacttaagatctgatggcaataagatgtatagacttcaagaggaatcaattttgggcacttaggaagttgggaagaggggctggaagagtcaagcaaggagaattgttacaaaaacaatgaaaggaaagaatgcagcatgcctaaacagggagggaagtgtgccccttttttgccaccttgcctgctgtctgtggagagacaacacaaaaaggactggcttttcgtgaaagcaatctatgatactgtcttgatccttaaacttaattccaaatttttcactttggatgattctcccctttttcctcccactttgatcctcatagctatcatccctcctccctgagtattctgatgaccgatttactctgacagctaaaaacaactctctcagtatttctcctctgttccttgcagcgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatagtaagggcagctaagcacatgggttcaggccagaaggggtctcctcagtcccagtctccatcctagtcccaatagaggacagcttgtagtgaacaaagtcctggtcttaagcctgatacttagtttctctaagccatattttcctaatttgtaaaatgggaatatctcacaggttaatgttaagaatttgagattatgctcacacagatcatctggcacagtttcttgctcatgggaagccttcaaaaaatggtagttataatttgctatcatctatttttactaatgtccaacctttaccgctggtgactctttttttctcttgcctgtttgactgccatcatctgtgtcatttgtgtcctgcgttggccagtttgtcccttgcagagatacataatgacctttcagtgagctttttacatttaagagatgactcctttttttaatccaagattttattgagtaccacagtgtatcaggcactcttgtgtaatacaggtgactgtataatgtaagtgctttttgttttgttttgttttgttttttttgagacagaatctccctcattaacccagggtggagtgcagtggtgccatctcagctcactgccacctccgcctcctgggttcaagcaattctcgtgcctcagcctcccgagtagttgggattacaggcgtgtactatcacgcctggctaatttttgtatttttactagagacaaggttttgtcatgttggctagggtgatctcgaattcctggcctcaagtgatctgcccgcctgccttggcgtcccaaagtgctgggattataggcgtgagccatcgcgcccggccattgttttaatatttcaaaagttatacaaatatggttaatgcttattgaccaaaattagaagaagatggagaaagcaaaaattctttttgactaacactgtttcctctctgaacccaaagataacctttgtcatcattttcatgtataccttttattttgttgtgtttacattcatatgtagacagaagtgtagttttagtgtgtgtggttctgcaacttgcttagttttctttcaatgtcagtgcagagatataccttatcaatacagagatctatctgctgcatagtgttctgtaatatagaaatatatcatatgtttaatcattccctactgattgacatttaagttgttcctaagtttttacttttactaacaatgctgcaatgaaaattcttacagtaaccttttgtacctgtgtgccagttaatatttttctaggggggatagacctgttgagttgaagggtatgtagaagacaaatgttaataaatagtgccaaatttccctccaaaagggccagtacatgatcagtgtatgaaacatacctgtttacccatagtcttaccagcaatggatactatcagcctttttaatttttgccaaccttatggcaaaagatggtgtcttgtttgttttacgtgtttattgactcttctttattccttttctgtgaattttccattcagtctttcacccatttttctgttgggatgttttgtttttcttattgatttgtaagagttccttatatattctagatgtgttggagtattttttgtatattctggatttattgaaaaatatttccttttaggtttgtgtttaattttattatgtctttctagcatgtagatgattttgatttttacattgtcatctttatcaatttttttttttttttttgagacacagtctcactctgtctcccaggctggagtgcagtggcgcaatcatggctcactgcagcctcagacctctgcagtcccacctcaacctccctggtagctgggaccataggtgcataccaccacacccagcttattttttgtacagatggggtttcgccatgttgcccaggctggtctcaaactcctgggctcaagtggtcctcctgccttggtctcccaaagtgctgggattataggcgtgagccactgcatccagccatctttatcagtttttaatagttttttgtattttatgttttgattaagaaggccttcttatattttcccctaaaacttgtataggagttaaaattttagctctttatctggaattaagtttttgtgaattgtgggaggttagaatctaactttatttttttccacatcagtagtcatttcccccagcaccatttattgactaattcatcattatccccctgacttgaagttctacctttgtcataaacgaaattcccatatatatggggatttgttttccactttagtccaagttctgtaccttaatagctatatgaccttggtcaggctagttaacctctctatgcctctctgtgatagtcatacctacctcataggttgttatgagagttaaataaatatacagaaagcacttaaaacattgcccagcacatgataagtaagtactgtgtattagatattattaatattattctgttccataaaatcaacttgtcaaaacaaatttttattttaccaaacagatgctaaaaaagaaaatgaaaatcaacttgtctattcctgtgacaataccatgtaggttagttaccacagactttgtttctggtagagcaaatcccctctgcagaccttgctgtgaacctgaggagaccacagatgctcaccaaggctctcatctttgagctaagctttgatttgttttagggacatgccaggttcccctggccacccactctactgtgagcagtcaaatcacattgacctgcagctaagatgtctggacttgatttaaccgctcctcttagaacagctcactcagcctctcctccctccttcgcctccctactttgcccagcaaccatggaaaggcagcttaccaaggagagacctccctactttttcttatttttccagaatttcgaggctgctgttgagctttttctattccagatggattttagaatcagcttttcaaaggattgcatggtgtttgtggattaatttatggagacctatctttcatcagaggcatttcggctatactgggatttgcgcattcctgaatataacctcatgtcctgaaaatttgtgcactaaaaacaataaggcaggcaaaaagagattagggccacagccctcaaaatctatgtgactttgaagccaaaatacagactcaaataatagcagttctaagttagagcccaatggcatttgtacccggcattatagtcagtggcttctctatggccttaagctctggactcagacttcctctttccaaatctggattcttttgagggcatttggttaaatagataccagcttcatcaaatcaaaatctgatccagggcctagtccctatcaatcttttttggcaaaacaaacaaacaaaaaaaaaacagagggaaatgtctttgcaacttctttatctgctctgtcaggtagcctatcccatcagaactaaattttgtagaaaatagtcaccatttattttttctctggtaggcaaacttgtgtgatttttaatttttgtctgtatgtcttcttatgttgctaaggctttctctgtagttgtgaaaaagtctaccactgattggttgtaaacaactatggaaaattgtttttgaactggtacaacttctgaacagcattgaaatcattgttttgtctttttgttgttgtttgtttgtttgttttgagaccgagtctcactttgtcgcccagggtggaatgaagtggcgtgatctgggctcactgcaatctctgccttcctggttcaaacagttctcctgccttggcctcccaagtagctgggattacaggcacacgccaccacgcctggctaattttttgtgtttttagtagagacagggtttcaccacgttggccaggccggtcttgaactcctgacctcaagtgatccacccgcctcagcctcccagagtgctgggattacaggcgcgagccaccaggcccagccagacatctttctcttatttaccttttgggtatgagcagcagccatcttttgtttctgtcttcaaacatagtctgtctctatttattcaggtcttcttgtatgtatctcttctttggtttatttcttcttcagtttatttctagaaattttattttggttcgtaaaattggcatctttttatgtattacgttttctaattggctattgctaatacggaggacagtagttgattctttcccatatcaatcctgtattggactaccttattatactgttattagttctatttgttttcagtttattgtcttgagttgttgaggtagatgatctgtgtgtcctgtattagtttgatagggctatcataacaaaatatcacagactgggtggcttaaacaacagaaagttatttccttacacttttggcagctgaaagttgaagatcaaggtgctggcagagttggtttttcctgaggtctctctgcttggcttgcagatggccttcgtcttgctgcctcttcatgtggtcatacttctgtgcatatacgcccatgacgtctctctgtatgtcctaatcaccacctcttataagaccaccagtcagattggtttagggcctactctaatggtctcattttaacttaattatttcttaaaaggctctatctctaaatatagttacattctgaatactaggggtaggtcttcaccatatgaattttaggggacaccattcaacccataatatcctcctcctctccagtattcatacctctagcttccagttttattacagtgttgagtcatagtggtgatgggggcatccttgtgctgttttcagactttaaagggaatactgccagtctttctccactcaatatataggtctctgttagactactctcatagagttcaggggagtctctagctatttatttacttatttagacacagtctcgctctatcacccaggctggagtgtagtggcgcaattttggctcaccgtagcctccacctcctgggctcaagtgatccttctacctcagcctcccgagtagctgggactgcaggtgcacgccaccactcctggttaatttttgtgtttttagtggaaacagggttttgccatgttgtccaggctagctttactttaaaagatttttttttgttttaaaatcaagaatcaaattaggttttaccaaataattttggcatatttggacataaatacatagtttttctatgttaatttgttaatacagtgaatgacattaataaaattactaattttgaatcgatattttcttgagattagctgtacttgtacttggttgtggtgtttaacaatagttcatctagtttatttgattgctagtcttttcaaaaactagttttttggctttattgatcatctctagtgtttgatattttattctctttttaatttttctgtattcaacatcttgagttgaaagctctgttgatgtattttcaatctgctttttggtaaagcgttttttaaattttatttttattttatttatttatttttgagacagagtctcgctctgtcacccaggctggggtgcagtggtgcaatctcggctcactgcaacctccgcctccccggttcaagcgattcttctgcctcagcctcctaagtagctgggattacaggtgtacgccaccacgcctggctaattttgtgtatttttagttgagacaggacttcaacatattggccaggctggtctcaaactcctgacctcaggtgatccacccgcctcagcctcccaaagtgctgggattataggcgtgacccactgtgcctggcctgaaattttattttttaaattaacatgaagtaaaattgactctcttggtatacacatgtttatattcttccagccaccataatcaggatacagagccctttgatcactccctaacctcctttgtgttactaccccctttgtagtcatgccttccctctactcccgagcaaccactgatctgctctctgtcactgtggtttttgcctttgccagaatgtcatataaatggaattatgcagtatgtaatattttgagactggtatcttttgcttaccataatgccttttttttttttttttttgagatggagcctcgcactgtcgcctgggctggagggcaatggcgtgatcttggctcactgcaacctctgccttccggattcacgtgaatctcctgcctcagcctcctgagtagctgggattaaaggcgcacaccaccacacctagctaattttttgtatttttagtagagacggggtttcactatgttggccagactggtctcgatctcctgacctcgtgatccgcccgcctcagcctcccaaagtgctgggattacaggcataagccactgcacccggcccaccataatggctttaatattcattcatgttgttgcatatcaaaagcttgttcttttttattgctgagtaatattccattgtatggattatacccattgaaggtcatttcagttgtttccactttggggtgattacaaatagagctgctgtgaacattcaggtataggttcttgtgtgaatatgagttttcatttttctagggtaaatacctaggaatgggattcctgggcggtatgggcagtgggtgttttaactttacaggaaaccactggctgggtgtggtggctcgtgcctgtaatcccagcactttgggaggccaaggcgggcacatcacgaggtcaggagttcgagaccagcctggccaatatggtcaaaccctgtctctactaaaaatacaaaaaatttagccaggtgtggtggcatgtgcctgtagtcccagctactcaggaggctgaggcagaagaattgcttcaacctgggaggtggaggttgcagtgaaccgagattgcatcactgcactccagcctggggggacagagtgagactccatctcaaaaaaaaaaaaaaaaaggccgggcgcagtggctgacgcctgtaatcccagcactttgggaggccgaggtgggtggatcacgaggtcaggagattgagaccatcctggctaacacggtgaaaccccgtctctactaaaaatacaaaaaattagccgggcgtggtgtcgggcgcctgtagtcccagctactcaggaggctgaggcaggagaatggcgtgaacccaggagtcggagcttgcagtgagccgagatcgcaccactgcactccagcccgggcaacagagcgagactctgtctcagaaaaaaaaaaaaaagctactgaactgtttcccagaatggttgttttacatttccactagcaatatgtggaattccagttgctctacatactcatcagcacttggttttgtcaatatagttattttaatcatcctaataagtatgtagtgatatctcatttagtgattcatctaatggctaatgataataaacaactttctgtgtgtttgccattcatatatcctcttttttgaagtgtcattaaacagacattttgaatgcattgttaagatttcttgttaaggatttaactatgaatttttctttttgttttcttttctttgtttttttgagccagtcttgctctgtcacccaggctggagtgcagtggcacgatctcggctcactgcaacctctgcctcctgggttcaagtgattctcatgcctcagcctcctgagtagctgagactataggtgcgtgccaccattccccagctaattttttttttctagtagagatgaggtttcaccatgttggccaggctggtcttgaactcctgaccttaagtaatccacccaccttggcctcccaaagtgctgggattattggcatgagccaccacacccagcctggatttattttctttagtagatatagaattttcaggttatctgtttgattttaggtgagttatttatttattttttatttatttattttttaagactagccaagggcagtagtgaaaagaggggaaagagtttgggtgagtttttatagtttgtatctttcaaggaattggtccatttcatataacttacagaatttatgggcatagagttgtttgtagaattcccctattattctttaaatgtctatggggtctttagtgatatcccccttttcccttctcattcttgatattggtaaattgtttcttctcttttttttttcctttgccattcttgctggcactttgtcttttttttttttttaacttaaaaagtgtttttagggctacaggtgcatgccactggctgtttttttatttttatggagatgggggtctcactgtgttgcatagccttgtgtcaaactcctgacctcaagtgatcatctcttctggacctcccaaagtgctgagattacaagtgtgagccaggccttattgtgtcaatttaatggatcttttcaatatttttggtttcattttctatgttttgtcagttacattccactcttaatgtagttaagattgctgtagttttattttattctttttctaatttcagagatgatcgtttagattatttatttgagacctttttcgtttctttttttgctatttttattctattttattttattttatttttttgagacagagtcttggtctgtcacccaggctggagtgctgtggcgcagtctccgctcgctccaacctccacctcccaggttcaagtggttctcctgcctcagcctcccgagtagctgggattacagtcaggcgccaccatgtccagctaatttttgcatttttaatagaggtgggatttcaccaggctggtctcgagctcctgacctcaagtgatcgccctccttggcctcccgaagtactgggactaaaggtgtgagccaccatgcccagccttttttttttattttggtattttataaagttgatatattaacagcatattgtgtatattttggggttacatgtgatattttgatacatatatgcaatgtgtaatgatgaagttaggcttagtgatatatctatcatcaaacctttatttttgtgtcagaaacattataattctcttctagctgttttgaaatatgcagtaaattattaactgtaatttcttgactgtactattgaatgctagaatttattccttctatctaactgtatttttgtacccattaaccaactatttttcatcccccgcttcctttcccagcctctggtaaccaccattctactctccacctctgtgagatccacttttttagctctcacatatgagtgagaacatgcgatatttgtctgcgtattcctggcttatttcacttaatataatgacctccattttccttcattttactgcaagtgacaggatttcatttgttttaatggctaaataatattccattgtttatatataccacatttcttaattttactcatttgtccattgatggacacttaggttgattccatatcttggctattgtgaatagtattgcagtgaacatgggaatgcagatatctctttgatatactgatgtctttccttttggatatgcccagcagtcaaattgctggatcatatggtagttctatttttactttttcgagacacctccatactgttttctatgatagttgtactaccttatattcccaccaacagtagtatgaatgttcctctttctccaaatgctgaagagtaacaaatcctctccagcttttgttactttttgtcttttggataatagccattctaacttgaggtgagatgatttctcattgcagttttgatttctatttccctgatgatgagtgatattggacattttccccatatacctgttggacattttttttccaacttttaagttctggggtacatgtgcaggatgtgcaggtttgttacataggtaaacgtgtgccatggtggtttactgcacagaccaacctatcacctaggtattaagcccagcatccattagctgttcttccttgtactctccttccccaccactgacaggccctagtatatgttgttccccgcctcccatgtgtccatgtgttctcgtcattcagctcccacttacaagtgagaacatggggtatttagttttctgttcttgtgttagtttgctgagaataacagcttccagctccatccatgtccctgcagtggacgtgatgtcgttcctttttatgactgcatagtattccatgctgtatatgtaccagcttttctttatccagtctatcattgatgggcattttggttgattccatgtccttgctattgggaatactgctgcagtgaacatacgtgtgcacgtatctttataatagaattatttatattcctttgggtatatatccagtaataggattactgggtcaaatggtagttctgcctctagatctttgaggaatcaccatgctgtcttccacaatgcttgaactaatttacactctcaccaacagtgtaaaagcgttcctttttctctgcaacctcaccagcatctgttgttttttgagtttttaattgccatcctgctggtgtgagatagtgtctcattgtggttttgatttgcatttctctaatgaacagtgatgttgagctttttttcatatgatggccgcatgaatgtcttcttctttttttttttgagacggagtctcgctctgtcgcccaggctggagtgcagtggcacaatctcgactcactgcaagctccgcctcccgggttcatgccattcttctgcctcagcctcccgagtagctgggactgggactacaggcgcctgccaccacgcccagctaatttttttgtatttttagtagagactgggtttcaccatgttagccaggatggtctccatctcctgacctcgtgatccgcccgcctcagccccccaaagtgctgagattacaggtgtgagccaccgcgcccggctgaatgtcttctttttagtggggttgttttcttataaatttgtttaagttcctcttagactctggatattatacctttgccagatggatatattgcaaaaattttctcccattctgtaggttgtctgttcactctgattatagtttcttttgatgtgcagaagctctttaatttaattagatcccatttgtcaatttttacttttgttgcaattgcttttggcatttttgtcataaaatctttgcctgtgcctatgtcctgaatggtattgcctagattttcttctagggtttttatagtttggggttttacatttaggtccttcattcatcttgcgttaattcttgtatatggtataaggaagggatccagttttaattttctgcatatggctacctggttctccccagcaccacttattaaatagagaatcctttctctattgcttgtttttgtcaggtttgtcgaagattagatgtgtgtaggtgtgtggtctaacttctgggttctctattctgttcattggtctatgtgtctgtctttgtaccagttgcatgctgttttggttactgtagccttgtggtatgaagtcgggtagcgtgatgcctccagctttaattctttttgcttcggattgtcctggctatttgggctcttttttcattcaatgtgaattttcaagtagtttcttctaattctgtgaagaatgtcaatagtggtttaatgggaatagcattgaatctgtaaattactttgggcagcatggccattttcacgatattgattctttctgtccaggagcatggaatatttttccacttgttggtgtcctctctcatttccttgagcagtggtttgtagttctcctcgaagaggtccttcgtttcccttgttatgtgtattcataggtattacattctttctgtagcaattgtgaatgggagttcattcatgatatggctctctgcttgtctgttgttggtgtaaagaaatgcttgtgatttttgcacattgattttgtatcctgagactttgctgaagttgcttatcagctgaagaagcttttgggctgaggtgatggggttttctatatataggatcatgtcatctgaaaacaaagataatgttacttcctctctccctgtttgaataccctttatttctttctcttgcctggttgccatggccagaacttccaatgctatgttgaataggagtggcgagagagggcattcttgtcttgtgccagttttcaaggggaatgcttccatcttttgcccatttagtatgatactggctgtgggtttttcatatatggctcttattattttgaggtatgttccttcagtacctagataattgagagtttttaacatgaagggatgttgaattttatcaaaggtattttctgcatctattgagataatcatgtttttgactttagttctgtttatgtgatgaattacgtttattgatttgcatatgttgaaccaactttgcatcccagggatgaagccaacctgatggtggcggataagcttttagatgtgctgctggattcagtttgctcatattttattgaggatttttgcatcagtgttcatcagggatgttggcttgaagttttctttttctttttttttttttttttttttttgagacagcgtcttgccctgtcaccaggctgaagtgcagtgacgtgatctctgctcactgcaacctctgcctcctgggttcaagtgattctcctgcctcagcctctcgagtagctggaactacagatgcgtaccactatgcccagctaatttttctatttttagtagagacggggtttcaccatgttggccaggatggtcttgatctcttgacctcgtggtctgcctgcctcggcctcccaaagtgctgggattacaggcgtgagccaccgcagccggccgaagttttctttttttgttgtatctctgccaggttttggtatcaggatgatgctggcctcataaaatgagttagggaggagtcccttcttttcaattttttggaatagtttcagtagaaatggtaccagctcttctttgtacctgtagtggaattcagctataaatctctctggtcctgggctttttttggttggtaggctatttattactgcctcaatttctgaactcattattggtctattcagggattcagttccttcctagttcattcttcggagggtgtatgtgtccaagaattcatccatttcttccagattttctagtttatgtgcatagaggtatttatagtattctctgatggttgtttgtatttctgtggagtcagtggtgatatctcccttatcatttctggttgtgtctgtttgattttctctcttttgttcttcattagtctagctaatggtctatctattttattaattttttcaaaaaagaagctcctgaatttgttgattttttgtttttttgaagggtttttcgtgtctctgtctccttccgttcagctctgatcttggttatttcttgtcttctgctagctttgggatttgtttgctcttggttctctagttcttttagttgtgaattttgagatctttctagcttcttgatgtgggcatttagtgctataaatttccttcttaacactggtttagctgcatcccagagattctcatacattgtctctttgttctcattagtttcaaagaacttcttgatttctgccttaatttcattatttacccaggagtcattcaggagcaggttgttcagtttccatgtagttgtgtggttttgagtgaatttcttagttttgagttctaattttattgtgctgtggtctgagagactgttatgatttcagttcttttgcatttgctgaggagtgttttacctccgattatgtgatcaattttaaagtgccatgtggtgatgagaagaatgtatattttgttttttgggtggagggttctgtagatatctatcaggtccacttgatccagagctgagttcaggttctgaatatctttgttaattttctgtctagatggtctgtctaatatcgtcagtggggtattaaagtctcccactatttttgtgtgggagtctacgtttctttgtaggtctctacgaacttgctttacgaatctgggtgctcctatattgggtacatatatatttaggatagttaggtcttcttgtggaattgaaccctttatcattatgtaatgcccttctttgtcatttttgatctttgttgatttaaagtctgttttgtcagaaactaggattgtgacccctgctgttttctgtttttcatttgcttggtaaatttccctccatcccttcgttttgagcttatgtgtgtctgcacttaagatgggtctcctgaagacagcatactgatgggtcttgactctatccagcttgccattctatgtcttttaattggggcatatttagcccatttacatttaaggttaatattgttacgtgtgaatttaatcctgtcatcatgatggtagctggttattttgtagacttgtttatatggttgcttcatagtgtcactggtctgtatacttcagtgtgtttttactaaagtacttcctttaggagctcctgttggccatttctatgtctttttttgagaaatgtctgttctggtattttgcccatttttaaattggattatttgttttttgctattgagttccttatatattttagttattaatcctaatcccttgtcagatggatagtttgcagatattttctcccattctgtgggttgtctctgcactttgttgattgtttcctttgctgtacagaagctttttggcttaatgtaattatatttgtgtattcttgcatttgttgcctgtgcttttgagttcttactccaaaacaatctttgcccagaccaatgtcctatagcatttccccagtattttcttgtagtagtttcatagtttcaggtcttacatttaagtcttttaatccattttcaattgatttttttgtatatggcaagagataaaggtctagtttcattcttttgcatatgggtattcggttttcctgacaccatttattaaagagactgttctttccccagtgaatgttcttggtgccttcgtggaaagtgagtgggctataagtgggtggatttatttctggattctctatgctgttctgttggcccatgtatctgttttaatgccagtaccatgctgttttggttactgtagctttgtaatataatttgaaatcaggtagtatgaggcttccagctttgttcttactgctcagtattgctttagttatttggcatcttttgcagttttatgtgaattttaggattgctttttctatttctgtgaagaatgtcattggtattttgttagggattgcatggaatctatagatcgtttttgggtagtatagacattttagcaatattagttcttccaatacatgtgcatatgctatctttccattttttgtgtgtccccttcaatttttttcatcagtgttttgtagttttccttgtagagatcttgcaattatttggttaaatttattcccaggtattttaagttttttgtagctattgtaaaggggattgctttttttagttttttttttagatcattcactgttagcacatgtaaatgctactgatttttgtatgttgattttgtatcctgcaactttactgaggtgttttttttgttgttgttgtttttgagacagagtctcgttctgtcacccaggctggagttcagtggcatgatctcagctcactgcaacctttgtcccccggattcaagtggtcctttcacctcagccacccaagtagctgggactacaggtgcccaccaccacacccagctaatttttgcatttttagtagagatgagggtttaccatgttgcccaggttggtctcaaactcctgagctcaagctatctgcccgtctcagcctcccaaagtgctgggattacaggcatgagccactgcacccagccatctttactaaatttgtttatcagttcttttatttttattttttgagatggagtcttgctctgtcacctaggctggagtgcagtggcgcaatcttggctcactgcaacctccgcctcctgggttcaagcgattctcctgcctcagcctccaagtaaccgggattacagatgcccgccatcacgcccagctaattttttgtatttttagtagagatggggtttcaccatattggccagactgatctcgaactcctgacctcaggtgatctgcccaccttggccttccaaagtgctgggattacaggcgtgagccaccgtgcccggcgaggcctgtagttttaattgttgtatttttttctggttttggtatcaggataatgctggcctcatagaatgagttttgtggaagtattccctcctcttcagttttttgagttaaggtagaattgttgttttaatgtttggtagaattcagcagtgaatccatcaggttctgggcatttatttgatgggagacttcttattactgcttcagtctcattacttcttgtctgttcaggttttctgtttcttcatggttcaagcatggtaggttatatgtgtccaagaatttatccatttcttcccagtttccaatttgttggtgtatagttgttcatagtagtctctacctttgtatttctgtgatatcagttgtaatgattcctttctcatgagatatttttaatttctaatgtaaacatttagtactttaaattttcctctaagcagagctttctttgcgtcccccaagttttatgttgcaatttcactttttttttttttttaatttttatttttattgatcattcttgggtgtttctcacagagagggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcactgcccttaatccatttaaccctgagtggacacagcacatgtttcagagagcacagggttggggggtaaggtcacagatcaacaggatcccaaggcagaagaatttttcttagtacagaacaaaatgaaaagtctcccatgtctacttctttccacacagacatggcaaccatccgatttctcaatcttttccccacctttccccgctttctattccacaaaaccaccattgtcatcatggcccgttctcaatgagctgttgggcacacctcccagatggggtggtggccgggcagaggggctcctcacttcccagtaggggcggccgggcagaggcgcccctcacctcccggacggggcggctggctgggcggagggctgacccccccacctccctcccggatgaggtggctggccgggcagaggggctcctcacttcccagtaggggcagccgggcagaggcgcccctcacctcccggacggggcggctggccgggcggggggctgaccccccacctccctcccggacggggcggctggccgggcggggggctgacccccccacctccctcccggacggggcggctggccgggcagggggctgacccccccacctccctcccggacggggcggctggccgggcagaggggctcctcacttcccagtaggggcggccgggcagaggcgcccctcacctcccggacggggcggctggccgggcggggggctgaccccccacctccctcccggatggggcagctgccaggcagagacgctcctcacttcccagacggggtggctgccgggcggaggggctcctcacttctcagacggggcagctgccgggcggagggtctcctcacttctcagatggggcggttgccaggcggagggtctcctcccttcccagatggggcggctgggcagagacgctcctcacctcccagacggggtcgcgaccgggcagaggcgctcctcacatcccagacggggcggcggggcaaaggcactccccacatctcagacgatgggcggccgggcagagacgctcctcacttcctagatgggatggcggccgggaagaggcgctcctcacttcctagatgggatggcagccgggcagagacgctcctcactttccagactgggcagccaggcagaggggctcctcacatcccagacgatgggtggccaggcagagacgctcctcacttcctagacggagtggcggccgggcagtggctgcactctgggcactttgggaggccaaggcaggcggctgggaggtggaggttgtagcgagccgagatcacgccactgcactccagcctgggcaccattgagcactgagtgaaccagacaccgtctgcaatcctggcacctccggaggccgaggctggcggatcactcgcggttaggagctggaggccagcccggccaacacagcgaaacccagtctccaccaaaaaaatacgaaaaccagtcaggcgtggcggcacgcgcctgcagtcgcaggcactcggcaggctgaggcaggagaatcaggcagggaggttgcagtgagccgagatggcagcagtacagtccagcttcagctcggcatcagagggagaccgtggaaagagagggagagggagaccgtggggagagggagaggagggagagggagagggagagggacaatttcacttttattaatggaaatattttctgttttcctgtgggatctcctctttgacccatgtttatttaaaagtatgtttaatttttatgtgttagaggtattccagttatctttctattgctgctttttgttctttttgttaagacatcattcttctggtttccttttgttctttgtcagtggtttccttttgctctttcagcctagttgatttagtctttgtatggtaaatacaatgtcagagcttccttagggacagtttttgtcagtttctctttttttttcccccgtaaatgggccatacttcccttttcgttgcatgcctcatggttttttttgttggaaactggaaattttgaatattataatgtggtttactctggaagtcaaattttccttcctcagtttgcttttgttgcttgttatgaactgcagtcatctattatttagtgacttttcccaactactttttacaaagattgtattccttattgtgcagttactgagtctccattccttagcctcattagtaagctgagactttctgatagagatttcctgacaactttgtttgtttggaaggcaggagtacagtggcacaatcttggctcactgcagcctccacctcccgggttcaagcaagtctcgtgcctcagcctcccgagtagctaggattacaggcatgtgctaccacgcgtggctaatttttgtatttttagtagagacagggttttgccatgttggcgaggctggtcttgaactcctgacctcaagtgatccgcctgcatctggagtttcttaaagacatgatttagcagcctttttctttgttaatcaccccttgttgttgtgagatttttattggactccagagttccataaaagttgttctgacagtttttgccaggttgatggttgtttcagtggagggacagatcattttagctccctattactccattatcagtggtgtcactcctccttccctgcaccctcttcgtgtgtgtgtgcgtgcgtgtgtgtgtgtgcacacgtgcacgtgcatgttctttttttttggtaaaaaacacataccattaaatttatcatcttttttccattatttacctttaagctccgttagacttgacaaatttaccatcttaatcattttaaagtgtatagttcagtactattaagtatattcacattgttgtgcaacagatctctataactttttcatcttgcaacacttaaactgtatacccctaaacactaattcctccctctagccattggtcatcaccttctactttctttcttttcttttttttttttttttttttgaggcagagtttttgctcttgttgcccaggctggagtgcagtggcacgatcttggctcactgcaacctccgcctccaaggttcaagtgattctcctgcgtcagcctcctgagtagctgggattacaggtgcgcgccaccacgcccagctacttttttgtatttttaatagagacagagtttcgttatgttggccaggctggtctcgaactcatgacctcaggtgatccacctgcctcagcctcccagagtgcagggattacaggcatgagccactgcgcccgacctctactttctatttctatgattttgacacctttaggtactttgtaagagtggaattgtatagcatttgttctggcctttttttcttagcataatatcttccatgttcatccatgttgtagtatgtgatagctttcctttttttaaggctgcataataactgctgtgtgtacctaccatactttcttttatttttcctttttttaaattatacgtttctgggatacatgtgcagaacgtgcaggtttgttacataggtatacatgtgccatagtggtttgctgcacccatcaacccgtcatctacattaggtatttctcctaaagctatccctcccctagcccccttccccctcacaggccccagtgtgtgatgtttccctccctgttttcatgtgttctcattgttcaactctcacttatgaatgagaatatgcggtgtttggttttctgtcctgtgttagtttgctgagaatgatggtttccaacttcatccatgtccctgcaaaggacacgaactcatcctttttatggctgcaaagtattccatggtatatgtgtgccacattttctctatccagtctatcagtgatgggcatttgggttggttccaagtctttgctattgtgtacagtgctgcaataaacatacgtgtgcatgtgtctttctagtagaatgatttataatcctctgggtatatacccagtaatgggattgctgggtcaaatggtatttctcgttctagatccctgaggaatcgccacactgtcttccacagtggttgaactaatttacactcccaccaacagtgtaaaagcattcctatttctccacatcctctccagcatctgttgtttcctgactttttaatgatcaccattctaactggcttgagatggtatctcattgtggtttcgatttgcatttctctaatgaccagtgatgatgagtattttttcatatgtttgttggctggataaatgtcttcttttgagaagtgtctgttcatatccttcacccactttttgatgggattgtttgtttttttcagcccaggtgatctttttgttccctttgtgtgcattaagtatgtactgtttatttcttcattcacttagtaaacagttactgagaacttgtgcttcagtgtgctagtaggctcccttaatttgaaataaataatacatattcctgcccttatggtaaattggaggcaacagatttgctaatcagctcttaaataccatataacagcttcagtagagggatgcacaggaagctatggagagccaagtaggaggcatctcaatcatgattaggagagggagggaagagttcttgtggaaagtaaatctaaagctgaattttgaagggtgagtaagtaaagtaactcatgaagttattcactaaatggatgttgggtgaatgaatcagaattaggtgaatctaggagaaggacatttgctgcaaggatgcaaagtagaagggcatgaaatgtatgtggtacattcagagactcttggagttgagtatggattaagtaaaaggtacatttgtaggggaagggcaggagctggagtaggtgtcattctatcttcaccctttggatgaaatctcattttaccctgttttcccttctccctgcagtctatccttcactggagtctgatgatgatgaccctgctttgaaatctcgacccaagaaaaagaagaattcagatgatgctccatggagtcctaaaggtaatctagtattttgtcccttaaactctgtaggggtggtcaggaggaaatagacaaggtaggtgggatatttaatatcagaagacctgattcagtcactcatttgtttattcagcaaacatttgttgagtgtctgctgtgtgtcaggcactgtgttaggttctggagctaaaatgactaataagacacagagtttatgtaattagtccaataaaatcagaggtaatggagcatattgcatttgatattatatggtttgaggtgaaaggaagaccttgaacagattttagcaagcagtctgaggcttctgagaacgttctgataccatcatcccagtactctggtagttttgttgtcaaggagggaaattctgctgactgttgagctctataaggcccaagattatcacctatactgagaggccatctctgaggagggaagaatgaccactgagttgaacatggagtttagaggataatggaagaattttcttcgtctccttggctggatagtattcacactgaggatgcatccttcagttagtttttgctgcttaacagtctgcccaaaacttagtggcttaaaataacagttaataatttttcataattctgtaggttggctgagctgttcttctagtctaggccagattccctggggctgaatggtctcaaaagttctccttcaggtgtctcagacctactatctaagtcctactaagacctactatctaagatggccaaggcttctctctacatggtctttagtctaccaagcttttccacaaggtggcagaaaggtttctagcagcaagagaggacaagccccaatgtgcaagcacttttcaagcctttgcttaagtcatatttactgttgtcccattgactaaaacaagttacgtggccaagccttgatcccatggttgggaaatagattgcaccttttgagaggagaactgcaaagtcacatcgcaaagtatcatgcatacgaggatacatgagcacactgaaggccattactgcaacagtctgccatagaggtcattgggatttcagtacctgtggttccccagcagataaagggcttgctcttctcaccctgccttatttagactttttggtgtttgcttgaggtcgagggggtgacataggggtagcagggcattcctcagaagtgttatgttagtgagttaatcagtaaatgtttctttttaaaaaaaaattggggccgggcctggtggctcacacctgtaatcccagcactttgggaggccaaggcgggcagaacacctgaggtcaggaccagcctgaccgacatggtgaaacgtcgtttctactaaaaatagaaaatcagccgggaatggtggcgggcgcctataatcccagctagttgggaggctgaggtaggaaaattgcttgaacccaggaggccaaggttgcagtgagctgagattgcaccattgcactccagcctgggcaacaagtgggaaactccgtctcggggaaaaaaaaaaaaatttggctaggtgcagtgtggctcatgcctttaatcccaacattttgggaggctgaggcgggtggatcacttgaggtcaggagtttgagaccagcctggccaacatggtaaaaccccatctctactaaaaatacaaaaatcagctgcatgtggtggcatgtgcgtttagtcccagctactcgagaggctgaggcacgagaattgcttgaacctcggaaagcggaggttgcactgagccgagaccatgccactgcactccagcctgggcaacagagcgagactccatctcaaaaaaaaaaagaaaacttaggcctatttttaaattttattttcttctatcatttccaggtttatttttcctgtcaaagtaaatttttctggttagcacagtagaaaatttagaaaatattgaaaataaagggaattatgaagaaggaaccacccacgagtccgccacccagaagcaaccaatgttaacattttgacatgtttctttatagtcttttccctatacattttttaatttttattgtttaaatcacatgtgtgtacaattttttaaatttttttttaaattttttttaaatggagtctagctctgtcccaggctagagtgcagtggcgggatcttggctcactgcaatctccgcctcccgggttcaagctattctcttgcctcagcctcccaagtagctgggattacaggcaggtgccaccatgcctgactaattttttgtatttttagtagagatggggtttcaccatgttggccaggctggtcttgaactcctgacctcatgatctgcccgcttcagcctcccaaagtgctggaattacaggtatgagccaccacgcctggccacatgtatacaattatgcactgtactttaaaattttgtttgagcttttgatcaaagtagtgggtgtagcatatcaaaaagtatagagaaattaggccaggtgcggtggctcacgcctgtaatcccagcactttgggaggccgaggcgggtggatcacaaggtcaggagatcgagaccatcctggctaacacggtgaaaccccgtctctactaaagatacaaaaacttagccgggcgtggtggcaggcgcctgtagtcccagctactcgggaggctgaggcaggagaatggcatgaacctgagaggtggagcttgcagtgagccgagatcgcgccactacactccagcctgggtgacagagcgagactctgtctctcacacacacacaaaaaagtatagaaaaatttaggaggaaaagcaatgttcttctgcccctactttccccacctgcaatcccgttcccaagagacaacctcatagttttcgtttcctggtagatgcctccaaaactcaagagaagtatgccaccctttcttggtttatgaagtctatttctcctttaatcaacttacatcattcccttttttttttttttttttttttttgaggcagaaactcgctctgtggcccaggctggagtgcagtggtgcaatcttggctcactgcaacctccgcctcctggattcaaacgattctcatacctcagcctccaaagtagctgggactataggcgcgcatcactgcacccagctaatttttttgtatttttagtagagatggggttttgccatgttagctaggctggtctcgaactcctgacctcaagtgatccatctgcctcggcctcccagagtgctgtgattacaggccgtcaatctctcttgattacctactttgtaagatacagttgttggtgaccctacatccatagggtccttttgtaaccttctgtgaaccattttttcccttgtgggaagtaaatctaaagctgaattttgaagggtgagttagtaaagtaactcatgaagttattcaccacactaaatggatgttgtgtgaatgaatcagaattaggtgaatctagaaggacatttgccgcaaggatgcaaagtagaagggcatgaaattgtatgtggtacattcagagactcttggagttgagtatggattaagtaaaaggtacatttataggggaggggtacattcccttttgtaaccttctgtgaaccataattttttgtttatgctgtcaagtttattaacatatacattgttgttactactctacattgactagaaattaactgtaaatatcgaaaaccaatagagacatctggtcttttaagttaatattatatcataagcatgttcctatgccattgtttataaataatatttttaatggctacaagatatcagttccatggatatacctaatatatatgtaatttctaacatataggctattttcaagtttttacaattagtacatttggagtcaatatctttatatgtaaatgtttatatctctgattatttactcaggatggatcaccatgaaaccttagaggggccaaagtatgtgaggttatacaatgaaaagtttccttcccagccctgttagtagccttctacttacccacctggagtcaactagtgttatcagcttttttttttttttttttttttttttgagagggagtcttgctctgtcgcccaggctggagtgcagtggcgcgatctctgctcactgcaagctccgcctcctgggttcacgccattctcctgcctcagcctcccgagtagctgggactacaggcacccgccaccatgctaattttttgtacttttagtagagatggggtttcaccgtgttagccaggatggtctcgatctcctgacctcgtgatccgcccgcctcggcctcccaaagtgctgggattacaggcatgagccactacgcccggccatcagttttttcatttatcttctcagagacagtttgcacatatacaagcaaatgcatgtatatgttttcctacctccccctccttttttttttaactcagttggaaacgtattttatacgctgttatgtgctttgcttttctctcttaagaatacatctgggccaggcacggtggctcacgcctgtaatcccaacactttgggaggccagggtgagcggatcacgaggtcaggagatccagaccatcctggccaacatgatgaaaccccgtctctactaaaaatacaaaaattagctgggcatggtggcgcacgcctgtagtcccatctactcaggaggctgaggcaggagaatcgcttgaacccgggaggtggcggttgcagtgagccgagattttgccactgcactccagcctgggcgacagagcaagacttcatctcaaaaaaaaaaaaaaaatagttcttgatacttattgcagaagtgttttccagaaaagttgtaccaatttacacttccatccgcagtgcttgtttatgaaatgtatgcaggcattgaacacaccagttaggagtagtatttgattatgagtaatgtctcaagcatccttagtgagtgcttgttctctcagagtcacaagatggctacttcacctccagcattggggtctgggctgcagtcaggaagaaggagaaaagcaaaaggaaaaagggacaggcatgctgagtgctgagcattccctctccccaaggagttttaagttccacgttttttacacatctatttggctgaaattgtgtcagatggccaagactatcagccagagatgctaggagatacagtttttatctaggcatattgctgtcccacaaaatcagtgtttttgttagtaagcaggaaagagaatgacatttggttgagaatgagtagtctctaccatgagggtttttttgtttgtttgtttgtttgttttttatttattttgaaacagtctcggtctgtcgcccaggctggagtgcaatggcatgatcttggctcactgcaacctctgcctcccgggttcaagcaattctcctgcctcagcctcccaagtagctgggattacaggcacctgccaccacactcagctaattttttttgttgtttgttttttgagacagagtcgttctgtcaccagactggagtgcagtggcgagatcccggcccactgcaacctccgcctcctgggttaaagcaattctgcttcagcctcctgagtagctgggactacaggcacgcaccaccgcacccagctaattttttttttttttttgtatttttagtagagacggcatttcaccatgttggccaagatggtctcgatcccttgtccttgtgatccgcccatgtcagcctcccaaagtgctgggattacaggcatgagccaccgcgcctggccagttttttgtatttttagtagagacagggtttcgccatgttggccaggttggtctcgaactcctgacctcaggtgatccacctcggcctcccaaaatgttgggattacaggtgtgagccaccacatccggcttctaccatgaatttttgatccttggtaattcataagcaaacaacagtatctcattgatttaatttacatttttttgattaagcatagcctctatgttttattagcatcagagtttcttccattgtaaattttgtttacatcctttgcccacttatccatgtggttcttcaaggttttcgagttgcccattttatatagtaagggaatagtcatcctttgtttcatacacacacacacacacacacacacacacacacgcacatattttatacttataatgtgcttgtacttcttcctcattctacaggaaaatttgaatatttcagtatcaagtgttgatcatttgtttgcatattcagagagtagataattaacacccttgtattttttaagcataatttttaaatatctaatgtgttgatctacaaagaattgcttaatatatggtactgagcagaagatataaattggtattccccccaaaaagatgactgttggtgctagaatcacattcccactaagctgaaaatgctttctttgccatgtgtactgactcatacgtatcatgggttgtttgaggcacatccattttgtaccatcaaagttctgtctgctcttgtgctggtatttcacttattcactacctatttatgacttagaaaaaccacagacttttttattttgaggcagagtctcactctgttgcccaggctggagtgtagtagcatgatctctgctcactacaacctccgcctcccaggttcaagcgattctgctgcctcagcctcccaagaagctgggattaaaagcacccgccaccaccatgcctggctaatttttgtatttttagtagagatgggattttaccatgttggctaggctggtctcaaactcctgacctcaagtgattagcccgcctcagcctcccaaagtgctgagaattacaggtgtgagctaccacgcccagccaaaaaactgcaaacttttaaaaagtggcttttagttaactaaaaagatagttctttaaaatgaagaagaacaccaagtttaacccaataggatgaaactgtagagcacagatgcatcaactggtgttcatggacctttgaatctcctattaatattctattgaaattttatgtaaatgcatgcatctatgtatgtatatttctttagtaatttttatcacattttcaaagtgagttcttaactcaaaagatgcattctactaaggcattctactaaggggattcccattaagatcaggaataagactaatgtgcccactaacactgctattatttagtattgttctagaagttcatgccagtgtaattagaagtaaagcagaaattaaaaaaaaaaaaaaaaaaaagaaaagaagagaccaaatcatgatgtgagccagtagggtgagaatcctgttcacttttggccatcattgtatctgtagcactttgcctagtgcctggcctgtaggagatgtttaacaaatatttgatgagtgaaagataagatataattgtataatcgatatagaaaacacaggtatggggctgagcatggtggttaatgcctgtaatcctagcactttggaaaggtaagatgggaggattgtttgagcctaggagttcaagaccagcctgggccacatagtaagaccctgtctctacaaaaaatagaaataaaaatagagatatgatataattatgtaatatcagaaaatgaaagagaatcaactaaaaactgctaatactgataagagaattcagtaaattgggtaaatcattggatatataccagctatccaaaaatcaagaagtactatattagtaataaccataatgtactgagaaaaagaaatgctattgacaatagcaacaaacatataaaatatgcaagaataattgtaagaagatagtgtggaaccgacatgaagaaatagagatttcccatatgcctggttataaagactgagtgttgtaaagagtcatttccttccaaattaatgtatacatttaacactagcctaaatcaaaatcctaatggaattttgtggggaattcattctaaaagtaatttaaaaagtaaacaggtataattagcttaaagaatattgggatagagaaagtaaatgaaatatactatagtgctacagtaatcataagcaccagaacagtcggtaaatacttttccttttaaaaaatttttgttatgaaagttttcaaacataagataaaattcaagaggttattaccatgaacacctatatatatatatatatatatatctgtcacccagatttaatgaacattttgctgtatttgctttattctttttttcaaggcattttaagcaaaatcttacgtgttacgacatctctagttttttgctgattttttcttttctttttttttttttttttttttttttgagacagagtcttgctctgtcacccaggctggagtgcagtggcatgatcttggctcactgcaagctccgcctcctgggttcacgtcattctcctgcctcagcctccccagtagctgggactacaggcacctgccaccacacccagctaattttttgtattttttagtagagatggggtttcaccatgttagccaggattgtctcgatctcctgaccttgtgatccgcctaccttggcctcccaaagtgctgggattacaggcgtgagccaccacacctgtccgttttttgctgattttctaattgctctatccattattgaaaatgtggtattgaagtctccagctattattattgaatttatctattttctcccatcagtttggtcagttttcacttcatctattttgagcctctgttgtaaggtacacatatgtttgtaattgttataccttgttgatggattgacctttttatcattataaaatgctcttctttgtctttagtaatgatttttgtctcaaagtctgatgttagtatagccattgtagttttcatttgagtaccacttttattgttatctcttttttcatccatttattttcgacctgtgtcttcaaatctaaactgtgtgtcttgtatagatagcatatagtagggtcatttttaattcattctgccaacatctgcctatcagttggagggttctaatagctgccaaagttcgactcaatatccattttgctatttgttttctatgtgtcttattttttgttcctcaattcctccattagttactgccttcttttatgtttaatagctattttctaggaccccccccgcttttttttttttttgagacagagtgtcactctgtcacccaggctgaaatgcagcaacgcgatcttggctcactgcaatctctgcctcctgggttcaagcaattcttttcctgcctcagcctcctgagtagctgggattacaggtgcctgccatcacgcctagctaatttttatatttttagtagagttggggtttcaccgtgttggccaggctggtctcgaactcctgtcctcaggtgatccacccatcttggcctcccaaagtgctggaattacaggcatgagccaccgtgcccagccctaggatcccattttaattccttttttttttatctctctatatgtgaggggtttttttttgttgttgttttgtttttttttttttgagatggagtcttactctgttgcctaggctggagtgcagtggcacaatcgcgactcactgcaacctccacctcccgggttcaagcaatactcccgcctcagcctcctaagtagctgggaatacaggcacacaccaccaagcctgggtgatttttgtgtgtttagtggagacggggtttcaccatgttggccaaactggtctcaaactcctgacctcaggtgatcggccgcctcagcctcccaaagtgctgagattacaggcgcgagccaccgcacctggccaagttattttcttagtggttgtcctggggattaacaacttaatttataccattctaattcacattattatcacttaatttctttctttcttttttttttttttttgaggcagagtctcgctgtgtcgcccagattggagtgcagtggcaccatctcggctcggctcactgcaagctctgcctcccgggttcacgccattctcctgtctcagcctcccgagtagttgggactacaggcgcctgccaccacacccggctaattttctgtatttttagtagagacgaggtttcaccgtgttagccaggatggtgtccatctcctgacctcatgatccgcccgcctcagcctcccaaagtgctgggattacaggcgtgagccaccgcgcccagcctattatcacttaatttcagtactacacagaaactttgctgctatatagctccattacccttctcttttatgctattactgtcacaaattacatctttatacattgtgttcatgaacacagggttatagtaattgctttatgtaattgtctgttaatccagttagaaaaagttacaaaaatatgttgataatgtcttttaaatatacctatctagttacctttaccagtgctctttatttcttcatgtagactcaattgtctagtgtcctttcatttcagcctgaaggtttccctttaacatgccttttttttttttttgagacagagtctcgcactgtcgcctgggctggagtgcaatggcatgatttcagctcattataacctctgcctcccgggttcaagcaattctcctgcctcagcctaccaagtagctgggattacaggtgcctgccaccacgcctggctaattttttgtatttttagtagagacgggtttcactatgttggccaggctggtctcgaactcttgacctcgtaatctgcccgcttcggcctcccaaagtgctgggattacaggcatgagccaccacacctggccctttagcatttcttataggtaaggtctactagtgtcaaactatttgtttttatttatctaggaatatcttgatttcttcatttttgaaggatagttttgctggatctggaattcctgattgatagtttttcttttagcacttagaatatgtcttcgcactgtcttctaacctccatgggttctgatgataaagaaatcactttatgttgtgagtcacttctgccttgctgctttcaaaattctgttgtcgttggccgggcacagtggctcaagcctataatcccagcactttgggaggccgaggcgggcggatcacgaggtcaggagatcaagaccatcctggctaacacgatgaaaccctgtctctactaaaaatagaaaaaaaattagccgggcgtggtggcgggcacctgtagtcccagctactcaggaggctgaggcaggagaatggcgttaaccctggcggcagagcttgcaatgagccgagattgcaccactgcactccagcctgggtaatggagcaagactccgtctaaaaaaaaaaaaatttctgttgtctttggtttgagttatgatgtgtagccttttaaatttgttcagcttggagttcgttgagctcttgaatgtataaattgtttttcatcaaatttggaaagtttttagttgttatttcttcgaataggtgtccttcagatccctttggctctgttcacttttcttcattctctttttatgtgtgctcatcagactggataatctcaattgacttatcttcaaagtcagtaattcttccttctacctgctcaaatgtgctattgaaaccctctagggaagtttgcatttcagttaaagtttgcatttcagttattttacttttcaacttcaaaataactgtttggtttctttttataatttctgtctctattggtattctctgtttggtgagacatcatactcatactttcctgtagttccttagacatggtctcctttagcctttgaaagcatttaaaatagctgatttaaagtccttgtctagtaactccaactatgtctaggaagtcagggacagtttccactgattgattttttttcttgtgaatggctatactttatttctttgtatgtcttgtaattttttgttgaaaactgtacattttaaatgccgtggcaactctgaaaatcagattttctccactctgctcctcagagaacactctttgttgtagttgtgttttgtttagtggcttttctgaactaattctgtaaagtctgtaaacttttttgtgtgtgcacactgatgtctctactcatttagcttagtagatgtctcatgattggacacagatttcctgaaatgcctggaaccagtgagtgctcccagtgcttgctgaggggctctctatgtgcatgttggagcatgccttcactcagccaggcagtttacaactctgcggtagccttcacttctatttgtgtagcacctcaaagtcagacagaggtgcatgcttagggccttctcaagtcttacagcgccaacacaggcatgtggtcttataatttgcagaaatgcgtgagaacttgtcaaattctttatggatatctcattctttagcttttttttaaccatttgggttaatctattgtttgtcacaactgttatccatcaccttaaacagctatgacattaagcacatgcctttaaaattcttttttaaacacccatcagggagggagaggcttttagtactaggctttgaaagaaagctctagctcctttctgctcactacattgctgggaacttggactgctgtttttcaaggtgttcactaagctggggtaaggtagatgtgtctagggcaagttaaaatgcacaaagctcattgttcttactgagattcagctgtttttcttgaatcaagtgctttccaggttgctgcaagccttttgttaatttccagagttctgaaaaaatttatcctgacaatttttgctagtttttttgttgtttttattggggagtgaattcttggaggtcctttgccatgtttactgatgtcgcccatcataacatctcatccttaatacttaaatatgcattgaatgatattttcttccataaccacggtgccattatatgacacctaagcaaagtaacatttatttcttttttttttttttttttttttttgagacggagtcttgctctgtcacccaggctggagtgcagtggtgcgatctccgctcactgcaagctccgccttccgggttcacaccattctcctgcctcagcctcctgagtagctgggactacaggcgcctgtcaccacgcccggctaattttttgtatttttagtagagacggggtttcactgtgttagccaggatggtcttgatctcctgacctcctgatccacccaccttggcctcccaaagtgctgggattacaggcatgagccacagcgcccggccaacatttatttcttaatatcatctagtaccatgtacttattcaaatttcccccagttgcaccaaaaatatcttttgtaattggcttacttaaaccagaatccattcaaggattacacaatgcatttggttattataagctcttagtcttgttcattatttaaaatttgttaatatgacaattttattttattttttgagacagagtctcactctgtcgcccaggctgaagtgcagtagcgcgatctcagctcactgcaatctctgccctcggggttcaagtgattctcctgcctaagcttcccaagtagctgggattacaggcacgtgccaccacacctggctaatttttttgtatttttagtagagacagggtttcaccatgttggccagcctggtctcaaactcctgacctcaggtgatccgctcacctcggcctcccaaagtgtattatgacaattttattttttattttattttattttatttttattttatttattttttgagacggagtttcgctcttgttgtccaggcgggagtgcaatggcacgatcttggctcaccacagcctctgcctcctgggttcaagcgattctcctccctcagcctcctgagtagctgggattacaggcatgcacctccatgcccggctaattttttgtaattttagtagagacagggtttctccatgttggtcagactggtctcgaactcctgacctcaggtgatccacccacctcggcctctcaaagtgctgagattacaggcgtgagccaccgtgcccggccgacaatttttaaacatatgtaaaagtagaagggatagcacctgaatacccatagtcttaatactcagattctatagttgtaacattttgctatagttgcttgattcctctatctgtatctatctggctatctatagtttttgctgagccacttcaaagtcatcataacatattttacccgatggttcacgcctgtaatcccagcactttgggacaccgaggcaggtggatcatttgaggtcaggagtttaagaccagcctggccaacatggtgaaaccccatctctactaaaaatacaaaaattagccgggcggggtggtgggtgcctgttatcccagctacttgggaggctgagaaagaagaatcacttgaacccaggaggtggaggttgcagtgagtagaggtcacgccactgcgtgactgtgagactccatctcaaaaaaattaaataaggacatccgccattccccggtgtaaccacactacttttttttatacttaccaaagttagtaataattccctaagatcttcagatacccagttcataaccaaatttccccaactgtttacacaaaatatcttttataggtttttttccctcccaaaacccaggtctaatcaaggagggttcttttttccccagcttaaaacaaccaccattttcttatgttcatgtattctgtgggtcaggaatttggaaatggcacaatggcgacaacttgtctctactgcatgaagtctggggtctcagctggaaaaactttgaaggctgggggtgacttgttggccaagagtttgagtcatctgaagtctttcacttacatgtttgatgcctggcctgggaggacacaaaagactgaaagtgccaacatgtggcctctccatgtgactagcttcctcactgctcagcagcctcaaggcaatcaaactttttacatggcggttcagattgctaaaagcatgagtgttccaacaagcagtgtggaaactgaaattgcctttactgaccttgcctcaaaagtcatatagtgtcatttataccatattctatagcttgcaaataagcctgcttagattcaagagtggggcacagatctcacctatcagtaggaaaggtgtgatgggatttggggtcatgttttaaaaccaccacacatacaaaactatagagaacaatataaaagagatccaagtatccatgactgaaaattatgcgtcaacttttggtaaatttgcttcagatcatgttttaaacaaatgttacctttaaagaaagaatttcagccttccgaattgcttgttctagaatctgcatactgcttatccagaaattctcctttataatagcaatagctaaccaaggagtttaaatctaggtcagcagtaccaccacatcttttttctgtgacattagtttttttctttaaaaatataataaggctgggcatggtggctcatgcctatggttttggaggccgaggtgggtggatcacttgaggttaggagttcaagaccatcctggccaacatggtgaaaccccgtctctactaaaaatacaaaaattagccgggcatggtgttgcatgcctgtgatcccagctactcaggaggctgaggcaggagaatagcttgaacccgggaggtggaggttgcagtgagccgagatgaccccactgcactctagccttgggcgacaaagcaagactccatctcaaaaaataaataaaaatagaatagttcattgagctcctatatatccaccagtgagaatgaacagttattaatatattgccgtattggcttcatttatcactatcttgttttttaaatttttttctttgcttgaaagcaaaccccagttattatgctgtttcccccaagtatttcagtatgtatttctaaaaagtggatattttctcaccaaaccttacaacctgttattatacataacaaaactaacaataatttgataattctttatataattccaagtccataatcaaatttcctaaattgtcaaaccatgaaaaggtgtttttatattagatttgtttaaatcagggtctaaacagggtccatgtggcatttgaatgccttttaaccctctcaatctagagcactctccccttttttgttctgtgctattgatttgttgttgacactggtgtaattgccctgtagcatgtcctaccttctagatttgtctgtttgcttacttgtgacattgtctttttaaagagactaagccagtttatcttgtagaatgtctgcttgttttcttctggtgtcatttgtttttctgtacctgtttcctaaacactgaaagtaatatgaatggcttgctatattttagctcttcaacaaaactacttctcaggtgatgtgaatttcctattgcttctcatcaagaggcgtgtgaagttgtgttgtgctttctcactattagtgacagtaaagttcatacttaaagtggtaatctcttgatctcatcattataagttttttcttcttgaggtgaatgggtaatattttggtgctgtgtgaatatccaattccctagaatcaattgtttcattaggacttgccagcttgtggttttctaattctgtcattccttctacatttagtagctggctttcttctgtaaagaagagctgtctctcatcatttagggctgtttggttatcctgaaatacacttccttttgaaatggtgggatgagtatttttttatttcaggttggtaaggcattataaaagagtcatgcaagagggtggtcttcttcaggaactcatagcctggctggtagacagaataacacatcagcattagagaatgagacaaggtggtatgtgctatgtatcaagtaatttatacagatcataagttcaaaggaaaaagagatcagtggaaccaaagaggttttgtgtaggagattgatttcagcttaccttaaagaatgggtaggttttgaataggcagacaaaaaggaagatagtactctaggtggtgtggattttgaggatgaaagcatagggagagaggatgagctgtacacactctggagatgtaataaggaagccatccgtctggagaagctgagaatatggatgtggaaataaggttggagaggtaagtgggccagaagcagaatatgggacaaacttaaatgccagttcagggagattaactttttatttttattattattttattattattattattttttgagacagagtttcactgtgtcgccgaggctggtgtgcagtgatgcaatctctgctcactgcaacctctgcctcccaggttcaagcaattctcatgcctcagcctcctgagcagctgggactacaggcgtgcaccaccatggccggataattttttttttttttttgagatggagtcttgctgtgtcgcccaggctggagtgcaatggcgcaatctcagcttactgcaagctccgcctcccaggttcatgccattctcctgcctcagccttctgaatagctgggactacaggcacccgccaccatgcctggccaattttttgtatttttaatagagacggggtttcaccatgttagccaggatggtcttgatctcctgacctcgtgatccacccgcctcggcctcccaaagtgctgggattacaggtgtgagccaccgtgccggccaatttttattattattttattactattattattattattttttgagacagagtttcactgtgtcgctgaggctggagtgcagtgatgcaatctctgctcactgcaacctctgcctctcaggctcaagcaattctcatgcctcagcctcctgagcagctgggactgcaggcgtgcaccaccatgccgggataatttttgtatttttagtagagacgaagttttcgccatgttggcgaggctggtctcgaactcctggccacaagtgatccatctgcctcagcctcccaaagtgctggaattacaggtgtgagccactgcacctggcctggcttattgttctatttttagagacagggtctcactctgttgcccaggctggagtgcagtggtacaatcgtagctcactgtaacctcaaactcctgggctcaagcaatcctcccacttcagcctcccaagtagctaggactacaggcacatgccaccacacctggctaactttttaattttttgtagtgacagggtcccacctcaccctcccagagcaatgggattacaggcatgaaccatcatgcccagccaaaggaggttcacattttttttctttttccctctgggaggtttacctttatcctttaatcagtgtgtgctttgagcattggtgaattaggttcttatgtgatggcaagcaaaatctggcttcataaaaagctagaagcaggaagaccaatgagagtacctttggagagcttggaggtagggaatatggctagccttcggataaatgtcttagtgacaccttctcatcctgtttcccttgcagcccgcgtgaccccaactctgccgaagcaggaccgtcctgtgcgtgaggggacccgggtagcctctattgagacaggtttggctgcagcagctgcaaagctggcccagcaggtaggtgctgacaccccaggtcaccctgcaactaatagcagtttgacttagagcctcaacacttagacctgcaggctgataggatcccacctttgtctcaatggggattgagtaacctttgatctttatccttggcagtatcccagccccctcttaaatccctcttatcccaactcaatgataagctacttccacaggttacacagttgacatgattcaggatgaaagaaaatattaggccagagaaaaacccacttaccttttttggtgtgtaaaaacctctcagatgagaaggaccagatccttcctttgctctcatatgaagccctgagggggtgactcagctgagtacgctcaagttctcagccacccaccagtattggaatttggttgattagaaatttttcttgtcctctttatgaaataatattatcttaatcttcacccacaaattttttttttgtcctaaagagtgatcttcactagaatcaaattcatctcctagcattacatctaaaagttctttaatgtgcgtaatgtgcttaggagcctttggaggtgaattctctggttatcttgcaatcaatatcccgttagctcctaatcccatatcctatagcttagagcactgttaagcatctgctttgttagttgcttccatatataatgtgtaatgtaatctatctgcccaatagccctgttcaacaggtgatattttcatcattttataggtgaagaaaatgaagctctcattaactgactcaggataatacagccagtaaatggaggagacaactcaaactcatatcctctaacttcaaatttcatattactttctatttaaataaatgcttatgtagttcagtcattacatcctatttaaatagtgtttaaatctttggcaatcttctttgaccagaacttctgtctcttatgtatatcccaatacagtgtaagctgtaatttgaaaaagggggttctactgttttatataaatataaattaagtaaagctgtgaaaattactcttagtgccttttaaggagctaaattctgtttgggatgatcagagataacctcaaagaagaggttttgaaattggggaggggctttgcaagctaagcttctggtaggggccagggaggcattctaaaagaagggacttccttcgtatagcacacaaagccctcttaaagtcctcttgatttggtctctagtcatctccctgacctccttccagcccctcatgcacaccttttatacagccatagtgcactgcaatactcatagtcccctcagtgagtatatcagattgtctcatgcttttgtgcctttacacaagatgttccttttacccattgagaatcataccctatcagatcccttacctaacagcccttcatactacctaccaccactttatttcagaggcctttttctatatgcttctacaacattcgtggtacttacaatcataaatgtatgttttggtgtttcttattaaactatgaatacttcaagagtgggaatatatttaatttaacttggtatccccactatggtcagaaaatgtgtttagtcagtattggggtgggtgggtgagtgaatgaatgaatgaacgaaagaaagaaacagatctttctgtattggagatttcatgttggggaattagttaaaataagtaatgattataagaatggattctagagtcagcctgcttggatttaaattatgtaatagttctaccatttgggcaagttaatttctctttgcctcatttcctcatagacttcattttaggattaaatgaggtaatgtacgtacaagctcttttagaatggcagttgttatggagtaagtactataggcctgttagcttttttcatcattatcattatgggttggctaagtgtaaacagccagactgtggaagatcatgaatgtcaggccagggagtttgaacttgggcggggatctgctaacagctttttgagcaacgggattggcaaggtgaaagtggttctgtcataagatggtctagttgtctgtgggagtatctggataaattatatgtgaaagagattggcagcaaaggtagcaaaatttaggctagtgatctagatatgaagaggtaattctggatttaagtgagagaaaaagggacagaaatgcagttcctggtatggttagaatagcagtttggctgagggaagagattctgaagccaaatggcttggatgtgaatcccagtttgaccacttactggtcctgtaaccttagggaaatgacttagcctctctgtgccacagtttcttcatccttcaaatgggattataattcttacttcttgggtatttacaagtattaaatgagtaattatagaagagtggttgacatgtattactaatattgttattattgtaccccagaaatgcccgtggtagccacagcctgtgagatcttccgaaggcaggattaggcttgtgttgccaagagaaggcaaaaaaatgtgatcactgagttggtttgtgtggctgtgtagcatttcagaaggtgaagtgatttacatgctctcagcaccacctttccaggttctcagggctccagatgcccactatacaagtgtccaccatgcagtggatagtagatccatagggcagtggatggttgaaatacaaggtattgggagaagtgacacaactccttatttgtcattcccatccccaaagtgaggtttttagacccagtgacctggaggattgtcaagcccactgttaaaagaaaaagaccagcaagaggaagtgaagccattataagagatgaagatagaataataattaaccacttgtcgaatatctactatgtgctgtgtatttttatgtcatcacttaatcttttcaaaaatcctaaaaagcagatattattttacctgttttatagatgaggtagctgagattcagaaaggttagtcagtttgaccatagtcatccaatttagggacacaagcctggatttgaaccagatttatctcattccaaaactaataatctttctaatctttctacgctcagattttccactttgagaagtttgcaaggtgtctcttcagatagacctggttagatagtggtcccaactacttttcagctgtgaggctttgggctcaagttacttaatatccctgcacttccattttctcatatgtaaaattaggattttttcttcttagagctgttatgaggattaaatgagataaagtatataaagtgtctcagctgctgatgtaaatttagttattatcattagacgtgtccaaggtctacctcattagtggcaacactaggaccaaaatcctagtctccaaattcatttacagctttcttggcactgtactaataagtgacagtggtgacttaaggatggatggtaacaaagagatgatctcaggtattggaaggcctgttatgtgctgtgtgtacatccaggctagacttggtgcaggtaagggagagggtggcaggttgcacaaccatattggacattgtctagttagttcctttcctgggaacttgtcttcttcactccttaatctctcctcctacttggcttgtgtttcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggtacaacggccatatggttgtagaaccgaaggatcttagagccacctgccctaaatcctaagtgctctagtagatgacaataccagggagggacactgaaggccaacctaaggtgcttggatttgatcttatgggccatggagagatgttgactgatttgaagtacagacaagatcaggttttagttttgaaagatccttctggtggccagaaggaggtagagggtgggctagagatgggaactctagggaggaggcacatatacaagttcaggcaggcaggaagagtacctggggctctgccagagggaatggagaggaaggagatgaactgatcaaatatggaggcagtcaaataggacatgggaggggatttaatgtggggagacagagacaacaaagagttagaggactgaagccttcctttccctcactttggtcctcaaagcccagtccctagagtacgcagctcaagggcatggaggttggtgtgatgttgaaggctgatgaagatgagagtttctaatgaagcaaggccctagggatggcaacttcagggacactgagctctaatcactaaccaggcacttgtccagtcctggtgggtaggataagagggtatggaagtacatttacctccctgcaggatcttggaaggaaaatgattgggaccagagtaatcagtggagaaaaagaactagacaaactgtaatcagggagtcttgctgctacaggaggtcataggaggaagagtcaaagcatgtggtgttggttggaagtagttaaggagggcttcctgcccaatatggtctaaggatggagaaactttgtgggtagagaaacaggaaggggaggtggcctgagggcagttggtgccagatttgatgttgaagcccttgccaaagcccttgcttacttttcccttcccccacaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggcaattg

SEQ ID NO: 4620 - DNA, 108573 bp, human
tttcctctcatcccccctcctctcccctcccctcaggctatagtcagaaaattgtgggacaggtgcaaacaaatccttgaactgtatttgaactgaagtgaaacagtagggtcaaagaagagttcagagggagttgtggagttggcagcagctttacagaggaactacactgagggcctggggacagaacgcgggtagcacagggcacaaggttcaacgtccctgctccgggactcaagtcacttggcttctcgaagcccctgccttcatttggtgataatcacagagcttccttcacagggggaagaaccaacaacgcagagaccgtgggaaagagcccagcctatcgaaggtgctcaatgaacaggagccgcggtgagtactccgcctctaccccggctgaagcccgcccccgccgccacctattaattttgtagtttggagtcaccgagttcacctcctctcataggaggagaaggctggggaggaggagtgtgcgagtcggggtagctgaactccctgtttgcccggaggagggggaaggctaggaagtttcgggccccactcaaaatggagccaaacgtctgcctcgcctaagatggcggcttctccgcctctgggctcaaggtcttcagcggcgattgggcaccttaaagagacgagcgggtccaaaggtggctgagaaccgccctcctttctcaaggtggcgccccgcccccccgatgacgtcacccgggagccggcggctcgcggttccccgcctccgccgcgctcacctcgcgagtccagccctcataagatggcggtcgccttggttgtctgggtagcgccgccactctcaacatggtagctgtttatcccgtatttctcctcccctctccgcctcaacttcctcattgttttgaataaactttattgactactccgaattgcctaccaccgccactgggcttctcccagcgacttttcgggccgtgtgcctcggacgtggcggccggttcatctctttccccgttggtttgctcgcgagtatctcctgccggcccagcgacgacgccacttgcccgttcgccgggcggccgccagactaggcccaagccgcggtctccagtaggcccgaacggccgggccgaggggaatgttgtggaggaggctgctctgaagcaccgttgagcggctggcgccgcgcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctgtaagttttgggggctgcgaggctattactgtcagttttaggatatactgtgaggtacctgaacatttggggagactagggagctctcatcagtttgagggggggctgcaaggaaacgctgccagtttccgagcgatgcaaaagaatccttgcttagtttcgggagtgtgaggaaattctagtcagtttgaggggttttgaatagatccttttgagtttcagggatgcagccagaaccctgtcatctttaaagtacagaacgagctggtcagtttagagatttatatttatttcagttttgggggtgatgagactcctgactggtcggggaaggaatgatattgagagtgatggaaaggattatttaaactctccgaacacgaccccagaactgtgatttgagttgggcgcctagtcttgtctgtcttgttcgtgaaggctttgagtaacctgaagagactttcagggatcccttatctctctctggttggccctatttcaggtggtgagaggagggtcttgtcttgagatacccccagcctcatttttgacgctgtggtttgcgtcataatagagggagccctgtgaaacaggggtcagctaggggagggttcagtgagagatgaaagaagcttcccgaaaaggcttcaggtattttcttgaaacccggaaagaagttatcactgacaacggggccgaagaaggtggggggtggggagtggagagtgtgggggcggtgggaagcctggaaggttgagctccgttctttacgtgtgaaagaaattctaagggccgggtggactttctctggttgccccctacagccgcaccagctgtgttgcatcccggcggcggtaactctattggagaactgagggttggtgcaagggggtggggggcgggggctgattcactctgtaaaaagtgttatttgtgcctagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcaggtaaggagggcaggccaggctacacagggtgcggtggccaggtgtgttcacttgctctctcttcctttctcagctctgtttttagattccggctcaggaccccctctcccagactcaggttctgccatctctccttgcagaacaggacctagctgacattagcctctggtttctccttttcctgtgttttcccctatgtatttcttctttgcacttttcttttgagtgtttttttagatttataagacccccccccccttttctttcctgttacaaagaatcatttttatattcttctctattttattttttattttgttttatttttttcgagacggagtttcgctcgttgcccaggctggagtgcaatggcgcgatctcggctcacagcaacctctgcctcccaggttcaagcgattttcctgccccagcctccaagtagctgagattacaggcatgcaccaccacacccagctgattttgtatttttagtagagacggtgtttttccatgttgatcaggctggtctggaactcccgacctctggagatctgcctgcctcggcctcccaaagtgctgggattacaggcgtgagccaccgtgcccggtcatcatttttatagtctgacaattatgttctgcctcacacactggcttttgggaaaacagtgttgcttatttgaggtagttgagtccataaacagggatttaagttgtggctttgtacttagtttcagagtgaccatgcacaagttgctttgcttttctgagcctcattgtcttcagctataaaatgttatcaaatacatcctttctgactttgcaaagcagtttggatgtactccataaatggaggcagaaatggaagagtattttatttctacagcatttatctgcagcaccatccaactaaattgaattaagcagaatagatgctgggtaaaacaggagtaaaaccactgatgaatttccttcagttaaccgtgtgtgcacataagcacctgtcacccagaattccggagaggttagtgtgtacgataaaactaatatttcattaatgggatttaaatctcagctatggaaagacaaccttgagggggctttgtacactggagcacaacaaaacagtgtatggcaccctcctcctgttgcttgttagattctagaattttcagttgtctggtctcctccagaggggctatttctttttctttttttcttttttcttttttttttttttttatttgagacaaggtctcactcttgtcacccaggctggagtgcaatggcatgatctcagctcactgcaacctctgcctcccgggttcaagcgattctcgtgcctcagcctcccgagtagctgggattacaggtgcacgccaccacgcccggcaaatttttttgtacttttttgatagagatggagtttcaccatgttggccaggctggtctcaaactcctgacctcaagcgatccgcccgcctcagcctcccacagtgctaggattacaggcatgagccactatgcccagcaagctatttctgtttatcacactcaagaccaaactataggtgctggtgctgctaaaatcctgccctcagcagggactgcccccttgccccgtatccaaattcatgtttaactgatctctattgaatatttattgtgtgcccggcacagagttctgttttactgcctcatgttatttaagaggggacaaccctagagggtgggaccttttcctttgccctgaaaataagtggggattaagatgtctttcaggattcctggtgtctttgctagtgctgatcaagtcactcctcagcttaacattcttctttcagtggttcgtctctgggataaaattcagtatcctttatatgacagacaagaccttttgtgatctacttgtttattctcatttcctgccactcctcctctcttgttctttatgtcctagcaagactgaactacctatagttctgggaaaattttatactcctttatgcctttttgtctttgtacgtgcaaactcccactaatgccctctcccctttgcaactcacagactgtaaaaggtgtaaaagtccttcttcctcttggttcccattgcactttgtgtgcgtctttattaaaaagtaattatttaatcatatcatagttataaatatatctgtgtcattcgttagccagagcttcctgagggcagagatgtcttcttttcatttttggtatccccagaacctagttcagtgctaaacatgtaatagatgctgagtacatttttgaatgagttaatgagtcttcatgaaaaaaagctgttgcctggggcccttactttggattgtatgggaaatgtgtaggttcagacctgtaaaatgggctcctgctaactcctcactctggaaacagggaacaggaatgaatgcttcctgactgcttatgtctgccggaccccatgacagggacttgggacaaattatttagtctatatgcaagcctgaaagttggatatttctcttttaaataatgttcttaattttttcttgctcttatagtgagacctgcttgttgtagaaaacacagaaaaagaataaagaaggaaatataactcacctaagtctactactgtctggcacaatccactgttaaatttgttgttgcattaactcccatcttttgacttagaatataaacatatttttacaagatgggattgcgttataaataccattttacaacctattttttatttctagttaatgttacaatgtaattgccagttcattaaatattcagctaaacttgatttctgatatcccacaatatatatgtgtcaccggttaatttggtaatttcctttatggttggacattgtacttttttgaacattatttgtacttttttatattataaataatgtgaggaaactttgggcgttctggaaaggttttgcatcttgatatgagtgctgattaaaacaaaaacattatggaaagcatctttgcctagtagatacttgacatttatttataaggagcaccattgaggccttaaagaattctaaacttacaaatacagaaatgggcttatgggccaggcccctctttaatcacatttctgtggtgagttgtgtgtttctgtgtacactctaacacaagttaactgccttaatttttttccatgaaatacaccaaattttaaaaatctcttttgcttctctctatgggcccccactgaacaaggaagctagctgagaatcaggtccttgggggtggctgctcttgcttactcagtgcattgctcacagaaacacaccaggcttatagtgcgccatttaagtttgtacttcagcacaattggaaattactacatactgtggactttttatggttgcttgcaagagttaagccaacaaattttaaatccacagatacctagaggtgatagaaatctgttcatatctctagtgacttcttttttttttttttttttttgagacagagtctcactctgttgcccaagctgcagtgcagtggcacgatcttggttcactgcaacctctgcctcctgggttcaagtgattctcctgcctcagccttctgagtagttgggattacaggtgcgcgccaccacacccggctcatttttgtattttagtagagacagggtttcactatgttggtcaggctggtctcgaactgctgacctcgtgatccacccaccttgacctcccaaagtgctggtattacaggtgtgagccaccatgcccggcctctagtgacttttgtaggatagatttcttgaagtccagctagggattatggaatataatgccaagttactttttggaaaggttataacaagcgaggcaactattccattttgcagctgagaatctggaattcgtggaagttaagtgactttctgagtgtggatttgaactttgaattatttgattccagagcccaggttctcagaagtgcaaaaaacatggtattgcttcattcttcctgtaagaagctggattttgcaaaaacactttgatttgtacagcggtggttctcaaacttcagcatgtatcagactcacttggaagacctgatgaaacacaagttagggatgccctagctacagtatttctgattcagtaggtaagaagggcccacccttgagaaccactgatttagaacattatcctgtcttgattccttccccttctgcggagtgtgatagcttctgatactgagggatggatggactaacatatcattactgtacaccagtcattctctttttttggtacagaaaaattggaatgaacattctttttatattattcttttttaattcctaagtgagctaacacaggaggaacgaccttttttaaagtacagttcatcaactgggaatttgttcaaaatgcaatttcttgggctaggacttggactcagcagtctatattttaacaaacaagtgatcctgattcaccctaacatttgagaatcattgctgtacaatagtggagaaaactagttggcaagcatttattgatttctgggatttttagcacaaatttcactctacagttttcctgtttataaaagaaatattggttgatacatgcccaagggaataactttggtgtggatttttaactctagaggaaaggacactgatttcagatctgggttcaaattctgattctgttacatattagcaaataatttcttatctgtgaagccttagtttccctgagaggttgtgatgatttaaataaaatggttatagctatcgtttattgagcacaagctagtgttccactcactatgctaaccacttcgcctaattatctttatcttttgggggagttttaaaaattattccatttagtagttataggactattcaaattacctattttatgttggatgtgtactttccgagaattgacccatttcatctaagttgtcaaatttatgtttgtagaattgttcatagtatttctttattatccttttgatatcttcaggtgctgtagtgataattttgtttcattagtgatactaaaaatgtatcaggctgggcatgtgatgtcattcatgcctataatcccagcactttgggaggccaaggctggtggattgcttaagcccaagagttcaaaaccagcctgggcaacatggtaaaaccccgtctctacaagaaatacaaaaattagcagggtgggtggcacatgcttatagtcccagctgcccgggaggctgaggtgggaggattgcttgagcccaggaagttgaggcctcagtgaactgtgatcatgccactacactccagcctgggtgacagagcgagaccctgtctcaaaaaaaccgaaaacaaacaaacaaaaaaaatttgtcttcgtatttgtcagacttgctagaggtttgtcagttttatggatcttttcaaagaacaagctttttgtttcattgactttttctgttgtctttctgttttcaatttaatagatctctgcctttactatttttttcctcctttggtttattttgctctctatctagtttcttgaggtgggagattagattattgatttgagactttcttttctttttttttttttttttattttttctgaaacagcctgttgcccaggctggagtgcaatggcgcgatctcggctcgctgcaacctccacctcccgggttcaagtgattttcctgcctcagcctccctactagctgggattataggcgctcgccaccacgcccagctaattttttgtatttttaatagagatggggtttcaccatgttggccaggctagtctcgaactcctgacctcaggtgatccacccgcctcggcctcccaaagtgttgggattacaggcgtgacccacagcacccggcctttctttcttttctaatgtaagcctttagctgttaagtttcttctcagcaccaatagattttaatatgttacattttcccttttcatgtagttcaaggcattaaaaaaaaaaaaagtttttttttttttttttttttttttttttgagacagtgtctcagtctgttgcccaggcggtactgcagaggcaggatcatagctctcactgcagcctccagctcctgggctaaagtgatcctcctgctgcctcaaggcatttttaaattccccttgaaacttcctgtttgacccatgaagtatagaagtatgttgtttaattttgaagtttttgtagagtttcctgttatcgttctgttactgacttctagtttgatagtggtcagagaatatactttgtatgatttcaattcctttacatttattgagatttgttttatagcccagagtctatcttggtaaatgtttcatgatcactcgaaaagaatgtgtattctgccatttttgggtagagtgttctataaatgtcaattaactactgttggttaatggtgttgctgaattcttctaatccttgctgattttttcttttttcttttcttttttttttttttttttgagatggagtttcgctcttgttgcccaggctggagcgcgatttggctcaccgcaacctccggctcccaggttcaagcgattcttctgcctcagcctcctgaatagctgggactacaggcatgtgccaccacgcccagctaattttgtatttttagtagagacggggtttctccatgttcgtcaggctggtcttgaacttctgacttcaggtgatccgcctgcctcggcctcccaaagtgctgggattacaggtgtgagccactgcactcggcctactcattcattcattcatttatttttgagacagggtctctatgtcacctgggctggagtgcagtggtttgatcatggtttactgcagcctcaaattccagggcttaagcaatctcctcatgcttcagcctctacaatagctgaaactgcaagcatgtgccactgtgtgccctaatttttaaaattttttgtgtggggagggtgtgggtgtaggttggtggtacctccctttgttgcctgggatggtcttggacttctggcttcagatgatcctcccacctcagcctcccaaagtgctgggattacaggcatgaactactgctcttggcccgagttatctctgtattgcttttttcagtacttgctctaggtattacattatacatataacttaccataagcaactgctcttgacattttaccagtttgattgaagagtagaaactttacttttctttttcctttttttttttgagacagagtctcactctgtcacccaggctggagtgcaatgatgtggtctcggctcactgcaacctctgcctcctgggttcaagcgattctcccaccttagcctcccgagtagctgggactacaggtgtggtccaccatagccggctaatttttgtatttttagtagagacgagttttcactatgttgaccaggttggtctcgaactcctgacctcatgatctgcccgcctcagcctcccaaagtgctgggattacaagcgtgagccaccatgtccggttgaaactttacttttctttatatgccttaatgctcttttgtttataatctaattaatcgttttgttgttgttgagacagagtcttgctgtgttgcccaggctggagtgtagtggaacagtcacggctcacctgcagcctaaacctcctgggctcaagtgatcctcccacctcagccccccaccccccagtagctgggactacaggcatgcaccactatgcctggctgattttttttttttttttttttttttttgagacgaagtctcgctctgtcgcccaggctggagtgcagtggcgtgatctcggctcactgcaacctccgcccctccaggtttaaacaattctctgcctcagcctccagagtagctggaattacaggcgcccgccaccacgcccagctaattttttgtatttttagtagaaacggggtttcaccatcttggccaggctggtcttgaactcctgacctcaaatgatccacacgtctcggcctcccaaagtgctgggattacaggcatgagctactgtgcccagcctactcattcttttaggataagtgttggcaacagatacgtttagttttccttaatctgagaatatcttgatttcccttgaattcttaggggatcttttcacttcatatcgaactctgggtttctagttcttttatctcagcgcttgaaaactgttctgctacttccttttgccctccatggtttctgatgagagagcctctgtcattcaaattggtgttctccttgaggtaatgtgtcatttatctctcattgctttcaggatttttcctttgtcttttgcttttaggaatttgattaagccatgtcttagtgtggatttgttccggtttgtcttttgttgtagtcctgtaggttgctgaggctctgttcattttttttccaatctgttttctttctgttgttcagattggataatttctattgttctatcttcaacttactgattcttttctctgttttctccattctgctgttgaattttcatttaagttactaaagaattttcattgttactgtatttttcagttctaaaaattctgttagattcttttctatatcttctatttgtttgaagagattttctattttttgttgacactttctttttttttttatttgagacaagagtctagctctgtggcctagactggagtgcagtggtgcaatcttgggtcacttcaacctccacctcctgggttcaagtgattctcctgcctcagcctcccaagtagctgggattaaaggcacataccaccatgcctggctaatttttgctgacactttctatgtatttatttattttattatgatgatgatgatttttttctgagatggagtttcactctgttgcccaggctggagtgcaatggtgcgatctcggctcactgcaacctctgcctccctgggttcaagtgattctcctgcctcagcctcccgagtagctgggattacaggcacatgccaccacgcccagctatcttttgtatttttagtagaaatggggtttcaccgtgttggccaggctggtctcgaactcctgacctcgtgatctgcccacctcagcctcccaaagtgctgggattacaggcatgagccactgtgcccggcgacactttcaatttattcatttgtttcaggcatgttcttaattgctcattgaaacatttttatgatggcgcctttaaaattcttaaataattccaacatctgtgtcatctcagtcttaacatctgttgattttcttttcttattcgagttgtgattttccttgttcttggtatgacaaataattattttaattatattctggacatttggggcattatgtcacgagatcctggatcttatttaagacttctgtttttgcaggccttctcagacactgcgctccggtggcagaaagggggtaccacttcatgactgccaggtgggggtggaagtacaggttccccacttggtctttggtgctatccaccacctgctaggtgggtggatcctgctgtctctagtcggtctgctttcttcccttcacctttcagagttttatgtttgttttgtatatattgtccagggtttttagctgtacttggagggatagggaggagtgcatctacttcatattgttccagaaccagcagtgataggttaaataatgtgcccaaagctacacagacagctggaccacagatcaaacctgggtctcctctactttcactgtagaatacagtattatagacaatataagcactgtttaagttgttagaagttatggaagatagggaaaatcagatatgtgctatgtgccaggcattgttctggacaccggggtgggggaggggggatacggcagtgaacatgagacagtaaactaacagcttaatatatagtgtgtcaagtgataatacatggtctagagaaaagtaaagtagggtgagcaggagaaggagtaccaccccagggttgaagtagtggttactttatacaggatgattacagatgggttacctatgagcctgaaggaaagcgaggaagggaaccatgctggtaagtaggggaagagtgtttcaagtagaggacataaaggacccaagtggggagcagacctggcatgctaccagtccagtccaatgctattggaacagagtgagtgaggggagagtaatagaagctgaggttaagggtcaggggtgtgcagatcatatacagcagtgattttccaagtatggttcccagaccagcaggatcagcattatctaggaactgattaggccaattcttggatcccaccccagactgactgaatcagaaactctggagatggagccctagaatctgtggtttaacagcctttcagatgcacgctaaagtttaaaaaccatgggtatagggtgtaaggacttggtttttactctggatgggagccacagaagctttttgagcaagtgagagttgtgatctgatttaggttttggctcttgtgaggatagactaaaggtgaggagcaaggtagaagcagggagaatttcggggctactgtagatcattattccttaaagtgtggtccctggaccagcagcatcagcatcacctgagaggtcattagaaatgcacgtttataggcccaacccagtcctactgaatcaagatgtctggggatggggcctaggaatctgtattttaacaagcttaccaggtgtttctaatattccctaaaatctgagaaactttggtctagttaggcagtggtggcttaaagcagagtcagtgatgatgagaagtggttggattttgaatatatattgatacaggatttgttaatagattggattggggttgtggaagaaggaactcaagaatgactcaattttgaagaatttggtgtaaaggggactagagtaatggggcagagactgaggggatcacaaaagggttttttgtttgggttttttttttttttggagatagaacagtctgtctgtgtgcatgtcagtgcatatgaagttattccgttggtgcatccagaattcagtgaaacctgttatatgacaaactcataaaggagacacttcctaggtacgctggaacttgctgtgtcctttgcattcctttaagtcctgtgtgcctggagttggaggggtggggcggtgggaatggtggatgcttcagcttctggttttatagatggtgctctgtctggacctggatccttgggtaccctcagaaggcagaggttgaggagataagaagccagacaggatcttgagcaaaatcatcatctctcaggcatctccaagtctcagctcccactcagttccacatccctggaagagttgagtgtccattttggagtgctcataacacttgactgtattaatcaccccacattatatcctggttacatattgtagtgatatagtagagtcacaaagtcctgaatttgtatcctgctctgctacttagtagttttgtaattgccaacaatttacttaaccactcagacccagatttctcatctgttagattaggataatattaacgatgatgatgatgatagctaatacttaacatgtgccaggaactttaagtacttaactattttagctcatttaatcctcttaaccaccctgtgaagtgggtactattagtacttccatttcacagatgcagaaactgagatgcagaaaggtgaagtataaattgcttaagttcacatagctagtgagtggcagaggtgagattcaaacccaggcagtttggctcctaagcctgtactttaaacctctgcttctgtgtttaatgtctgtgaatgttgtacggaaggccctgatttgttgtggagattaaatgtgataatatgtgaagttcatagctcagtttttttctcagtgccttttatgctaacttcaaattcattcactcactatcctgttaccttgctttactgactttatagcacttacgaaactgttttgacactgcctctctgtctcccgctctaaaatgtccagtccatgagggcagtgtctgctcaatcaatatttgttgaatttatgcactcatttacttaacaaatactgcttaccgtgtgcttggctttgcagtataccatggggataactcatcttaatcacaagacctggtgctataataattatcctcttgactaaggaagctactcagagcaaatcagcatttaccacccttggtcccaggtggtaactatcgagacagtgcagccagaagcccgatttttcatttgtctgcctccctgatatgaggagttgtctagcacgttgatgtttgttgaataataagtaaggcaagactgagagatgggaaaggtgaggacttttggtaaataagatacactatctggcaaatgtagtggggacagacagcaggtaagtgagcaattccaaggcctcgtggtgaaggctgaaatagggatagtgttgtgggggtgccacagcagcagggaaaaggaagagcaggaatgttccaggtagaaggagatacctgtgatgaaacccagaggctagagctagacagagtatggcaccgagagtccgctggctttttagagcagagctggcttcatgggtgtgcaatcgttatagtcacatggtgccccatgcctgaggtttaatgttctgtggtggttgtcttgaaattcttaataattttgcctttgattttgtgattggtatgtgatggaacaatggagtgtgcgctggggatttaagagtcttggctcatatgtggttctacctcctgctgccattctacctccccgaacaggttcttggctagctgcctggggcactgggcccaggtgcaggtgtggacagagtcggttgggttcatgtaccctgtgtactaagtcaccgggcagggccccagggtacttgtgtgggcctgcactcgccccttgagttatccctatacccaagggagcgtgacagtaaatagcatattaaaactgcatggtaagttgagagagagaccatggaagaaaggaaaaagcttttctattttttgaacagggagctcccacttttcatttccattaggccccacagattgtaagtgggctatgcagtaggaatgtctcccccagcatacgctgtgtgtgaggggaaagacgtgagctcagccagagaggcaaggccttttgggccatggtaagtttatactttaccttaggaaaaatagggaccctgtgaggcattttaagcatgggttgataggatcaaatttgtgtttttaaatgatcactttggctgtagtgtggagggccgattgggtagggacagaataggggccaggagtccagttaggagggcaggacaataactgagttagagataatagtggcctgaactagcgcaggggcagtaaggatgacaaattaacacaattgatagctaataaagagagttgataggacatgctgataacttggataataacaacaaacatacacagcacttactatgggccagacactgttctaaacactttctatatatttagttcatttgcttttgataacaaccttgtgaagtaggtacagtttttatccccatcttacaatgaggaaactgaggcacagagaggttaagtaacttgtccaagatcccacagctagtaagtggcacagccaggatgcaaacccagagaatctggacctaaagtcagtgttcttaacttgatgctagaacgtctacttcagggtatagtggagggagagggctagaggtgaatcagtgatggctgccaggtttctggcttgaatgcctggtgaggttatggagccatttgcagaagtgggaaacctaagagaagggagcatgtttaggtgacagacagaaggagaaactgagtttggacatgttgaatttgaagtacgtaagtggctatccagtagaaatgtctcacccaggagacatttggagggaagggtctaatctggcttggagttatgagtgcatagagggcacatggagccctgggagtgagaacagtgaggaaaagtgaggagaaaagagtgcccaggtaagaggacctaagaaacttcaacatttaaggactgggcaggagaaaaagagttcatcgggaaaaaggaacagccaaagacatgattaaaatcacatcacatccctactcatagtggctgttactccccagttcttgtggctacccaggaaaagccagagtgctttacagtggcctacaacaccctactacatgagtctattgcctttctgacttattactgtcctcctacctctctactctagaacactctcctcctctctgctaccttcggagtctagggatgctcccaccacagggcttttgtacttgctgttcttattgggatgctcttccttcatagccacatgaggggcttgctcccttactccctttgggtctttattcaaaagccattttgtcagtctttccctgtcttccctatctaatatttcaccctcactaccattcttcctggcccccccattgtgtgtgtgtgtgtgtgtgtgtgtgtgtgtgtgtggtgtgtatagttatatattcacacatacatattcctctatatcccccttcctgtttttttttctacctaggtcttctcactatccagcatacaatgtgtttcaccaattgcattgatttatcttgtttcttgtctgcctccccactagaacatcagctctatgagggcagggatttttgtatgctttgttttttgtcttcgtctcaccagcacctagaccagagcctggcggatgctcattaaatgtcagctgaaggaatgggcaccagccagatgggacgttatagaagtcaaggatagagagcttgtcaggtggagagtgtacagggttggcagggcgaaaatggtgctaagaggttaagggagataaagcagagaagtacttattgcatatatcaacaaggaggtcaggaaaccagtgagatctattttaaagaaggtggggactaagatcagactagcaggagatgaatcacaaagtgcatatagcaaccctaaaaaagtatcgatttggctctgatagaacacctctggatactactaggcagctaagggtgggagggagactttttactgtatatacttctgtactctgagttttgcaccatgtacagctgttacttattcaaaagaggagtcattatcaagcttcgtaggtttatttacttcatttttaagctgcataggtttaaagaaagaatgtgtttggctgtgaaggggcggacagaagggagggaggatgggagggcgggtaggtcttggttttttaatttgtaaacatcaatagacttgtttaaatgctattgtgaagagaaagagagagattgaagatactgcagaaagaaggaataattgattgagaaggtaagaaaacatgtgacccaggtggaaaacttggctttagaaggaaggaaagatagtacttttgttgtgataggaaaaaaaggatgggtgtagaaggaggtagattggtgatgagaagttaaggtagttcacctctgattacttaattttctctaagaagtaggaagtgcatcgcttcttggtcttttggctaagatcaagtgtagaagtaggaagtggctggcatgatggctcacacctgtaatcccaacactttgggaggctgaggtaggaggatcacttgaggccagaagtttgagaccattctgggcaacaaagcaagaccccctctctataaaacacacgtacagacacaaattaggtgggcgtggtggtgtgtgcttgtagtcctagctacttgggaggctggggcaggaggatcacttgagcctaggagttaaaggctgcagtgaactatgattggcaccactgctctccagcctgtgcaacccagtgagaccctgactctaaacaaaacaaaacaaaaacattaaggaactcaaagaatgaaagcaaagagtgcttaacaacaacaacaacaacaacaacaaaagccaaaaccaaaaaccagaagtagtaggaagcaaggtaatttttgagagagaagaggcaggtagtggggtgagagatttgacacagccacagtagataatgagagagagttgagtggggaatttcagaaggattgtcaggcagcatgatccagatttttttttttttttttttttgagatggaatcttgctttgtcgcccaggctagagtgcagtggcatgatctcggctcactgcaacctctgcctcctgggttcaagctgttctcctgcctcagcctcctgattagctggaattataggcgcccaccaccattcccagctaatttttgtattttaagtagagatggggtttcaccatgttgaccaggctggtcttgaactcctaacttcaggtgatccacccgcctcagcctcccaaaatgctgggattacaggcgtgagccaccgtgcctggccaatccaaatattttggacagtgaatttatgatggcaccaatccaatgggttatttttctctagccacatctagtggtctagagttaggtagttgtactgagccagggttagggtttgcatatggggatgaaaggcagtggggcaagtgagggtatctgtaagagaatgattgaagtgaggaatgctggaatctcaactagatagggaaggagggtaaagtcaagaatgtgtgaataggtgaaaagtatgaggataaagagttttgagggcaaagaacaggttgtagtgaatgagagctggatagatagacttgtggtcagagagggcgatgtatgagtttcatattccagaggtacagcagttgctggtgttgacagggtctgggggatggtcatgagagttggtagctgaaatgggagtagaggtaacagtctctgaagatgagaagatcaaagaactaagtgcctggaatgttgtgtctccagatggatactgatttcatgtaggatgttgtcaggactcgggatggggaagatctgagcaggttcttcagcgagtgaaggggtgtgttggggagatgggtatgtggcagtgatgaagaggagtaggaagtggtatggctggatggtgtggaactcagaggagtgggagctcttacacaagggtagaggagagatgatctggaagtctcaccagagagtgagagggatggctacccacaacccagtcctgagttatgagggtatgggagaatgtgcagctataagggctctagcacaatgctgcttagattttctgtggcaaagaaccaaggcacttttaaaatttccaatctataatgggccgatccttttatgatataaaaaaagaattactagaaaaaaatggtatgaaccggccgggcgcagtggctcatgcctgtaatcccagcactttgggaggccgaggcgggcggatcacgaggtcaggagatcgagaccatcctggctaacatggtgaaactccatctctactaaaaatacaaaaaattagctgggcgtggtggtgggcgcctgtagtcccagctactcgggaggctgaggcaggagaatggcgtgaacccaggaggcagagcttgcagtgagccaagatcgtgccactgcactccagcctgggtgacagagcgagactctgtctcaaaaaataaataaataaataaaaatttaaaaaaatggtatgaaccaaaagacatataaaagacaagcccaaaattttattcttagattgaacggatataaaattattctgttaaattgctgtaaaaacttctgcataatagtgatgcttactcttactttctgtacttaccacagacctgtagtaaatagttcacagaccggcattagtctgtggaccacactttgagtggcaccggtgtagagaaaatgattttcccgtaggagaagctgcattcagttaagcctggaaggtgaaggagtgtttgttgaagagagtgccaatgttgagcagtttgtttaccaagttgggaaaggggatgagcagcgggtgtttagagtagagaaagcacatagccacatagggtgaaagtttaggggagagagaggtgtccagagggaacaggggtatgagatagaaagcatgcagtccagggaactgagttaatgctacaaggtctggggaatatctttgaagaagttttaggcaggtgaaaggtgaggtccggactggacttctagcacttactgtgaaaccggatacttactgtgtatcagactttatgctcactgtgctacacacattagtattatttttgtagagatggggttaccctatgttgcccaggctggtcttgaactcccggcctcaagcgatcctcccactttggccgcccaaagtactgggattacaggtgtgagctaccgcgactggccatgctgtgcactttatatacattatcttattgaatccttaaaaaccctacaaagttgatggtgatatccctagtttattgataagctgctggtttataggcatgagattattagttgggaatatatttagttgggatattgggaagattattagttgggaagtcctaatcccaggaagtccatttatgagcatgatcttggctgaaacaacttgagctctgccttaatgttctctgctgtgtgtggtaaaccaaacattttaagacttgggtcttctttttttttttttttttttttttggagacagggtcttgttctgtcacccaggctggagtgcggtagcacaatcatggcccactgtagcctcaatctcctgggttcaagggatcctcccagctcagcctccatgctcagctaaatttttttgtttgttttggtagagatgggggtctcaatttgttgcccaggctggtcttgaactcctgggctcaagtgatcctcctgcctcggcctcccaaagttctgggattataggtatgagccactgtgactggcctaggtgtttaattttagcaagaatttatttggagggctgctggtgccttccctagtaagggaaggttgaattttgtgagattaccacctcatatacatgcaaagtcaaattttcaaaattaagtaaatctttttaagtctttaaaatgtgaaataagcaacagatgtttattgtaggaaattagaagcacagataagataaaaaggattatctgtaatttttcatttagaactactgttgactataaatttttttttttagtctttttcgtttaataaagtatctcaagtttaaaaattaggttataaggctgggcgtggtggctcacacctataatcctagcacttcgggaggcagaggcaggtggatcacttgaactcaggagtttgagaccagcctggccaatgtggtgaaacctcgtctctactaaaaatacaaaaaattagccaggcatggtggcacatgcctataatcccagctaattgggaggctgaggcaggagaatcacttgaacccaggaggcagaggttgcagtgagccatgatcacaccactgcctaatacagtaacccctaaccacatgtggctgctgagcgcttgaaattttaaattttatttaattttaatggatttaaacataaatagccacatgtacttaatagctgttctactggacagcactgttctagacctcataaaaaataaaatttccataaaccttggctgtttttctctttttcagttgtgttggtgttgaagaggagaaggctgctgacattgacctctaccactgccccaactgtgaagtcttgcatgggccctccattagtaagtagatcttagggtttcctagagaagacaatccagaggagagacaaaggaaaggaaatttgggggagtgattgcttttgcctgagcacttgtgattcttcttcctcaggaaatagcagaagcctatgcaggctccacaggccagcacctatctcactaagaggacagaagttcataacttcacctccctcccttcctaaggcttatctagagaaagtacccatccatcttcaccaggaactttcctgaatctgtgagggcctcattgactccagatgctccaaggggtggttagattggaagagaaggatctgctgaggcctttgttcttggtatcatagctcatgaccgttctgactcacaatctctcatgtttttctggcttagtgaaaaaacgccgtggatcttcaaaggggcatgatacacacaaggggaaaccagtgaagaccgggagccctacgttcgtcagagagctccggagtaggacttttgacaggtgaggaaccctgcctccagtggctggtgaatgccagggctctgggaagctggaactcacctcttcccagctttcccagtggctgtcccattaggagcttccccagtttgtgagtatcttcagggctctgcaaattccttctggtttggtcaattcctggaaaacttctggtagttgggaggcagtattcacctaagttagatacttacattcatccaaggaatgctgactagaaggagtcttaggatcagaaagtttaattctctcatagagaagaagaaactcttttaatataaaaaaattattggtcatatatctcttttatgatcgaaaagaggttttatctttttaaaattaagctggccttgttaaaagtaaattacatgaaataagcaaaaataatgagttaaaaaaaggaacaaagcattctcctttgcttggttttttaattcagtagaccatgttcaggttttttaaaaataattgcaactggccgggcgcggtggctcacgcctgtaatcccagcactttgggaggccgaggcgggcggatcacgaggtcaggagattgagaccatcccggctaaaacggtgaaaccccgtctctactaaaaatacaaaaaattggccgggcgtagtggcgggcgcctgtagtcccagctactcgggaggctgaggcaggagaatggcgtgaacccgggaggcggagcttgcagtgagccgagatcccaccactgcactccagcctgggcgacagagcgagactccgtctcaaaaaaaaaaaaaaaaaaaaaaaaaaaaaaaataattgcaactttgattttagattcaggaagtacatgtgcaggtttgtttacgtgggtatattgcatgtgtgaggtttggggtgcaaatggtcccatcacccaagtagtgaacatagtacccagtagctagtttttcagccccttccctactacctccctcccaacttgagtggtccccagtatctattgttcccatctttgtctatgtgtacccaatgtttagctcctacttaaaagtgagaacaaaagcagtatttgattttctgttcctgcattaattggcttacgataatggtctccagctgcatccatgttactgaaaaggacatgatttccttctgttttatggctatgtagtattccatgatatatatgtaccacacttttctttatccattccactgttgatgggcacctagtttgattccatgttttactattgtgaatagtgctgcagacatatcagtgcattcgtctttttagtagatggtttattttcctttgggtgtaaatccagtaatgggattgctgggtcgaatggtagttctcttttaagttctttgagaaatctccaaactgctttccatggtggctgaactaatttacattcccactaacatggtataagtattccctttgctctgcaggcttatcaggatctgttatttttttttttacttcttttcaggttttctgtaaccaaagtgttaattggaataagtgttccttcaacttaatgtttcttgttttatttgtttatttaaaggcagaaacttctcctctctactctggactcctcaggttctttctccaaagtcaacccgttatttgtagatcctttcagaaatggtttttgcatatacaaacatagatttttttaattcctttttttgacacaaatggaaacaactatatattgttctgtatcttgcttttttttaaaaaaatatatatttgagatcaatccataatagcacatacagatgttctttttcatggctgtttaatattacattgcatggtgtaacatttatttaaccagtcctctactgagggacgtttaagttgattccagtattttgctattagaaagaaatactgtaatgaatatctttgcacttaagtttttgcatacgttgccagttacatccatagtggctataccatttcacactcccacagataatgtgcggagggtgccgattttcctatatcctagccaatatttgtttgtttgtttgttttattttatttatttatttattttgagacgatgtctcgctcttgtcccccaggctggagtgcaatggcgtgatctcggctcactgcaacctccgcctcctgggttcaagcgattctcctgcctcggcaccccgagtagctgggattactggcgcctgccaccacgcccggctaatttttgtatttttagtagagacggggtttttaccatgttggccaggctggtcttgaactcctgacttcaggtgatccacccgccttggcctcccaaagtcctgggattacaggtgtgagccaccgtgcccagccaccaatattatttattatcaattttttttttgcctttctgataaaataaatcgtgaaatcctgctgttcccacttgtacttcttttctttctttcttttttttttttttttttttgaggcggtgtcttgctctgttggctaggctggagtgcagtggtgcaatctcagctcactgcaccctccgcctcctgggttcaagcaattctgcctcagcctcccaagtagctgggattacaggcacgtaccaccatgcccagctaatttttgtatttttagtagagatggggtttcaccatgctggccaggctggtctcaaactcctgacctcaagggatctgcccaccttggcctcccaaagtgctgggattacaggtgtgagccactgtactcagctcacacttgtatttctttaattatgaaggaaataagtagattttttttttgagacagggtctcatttgagacaggctggagtcgggtggtgcaatcaccactcactgcagccctgacctccctagcttaatccatcttcccacctgcgcttcctgggtagctgggactacaggtgtgtgccaccacgcccagctaattttttttttgtattttttgtagagacggggttttgccatgttgcccaggctggtctccaactcctgggctcaaacaatctgccttccttggcctcccaaagtgctgggattacagttgtgagctattgcactcagccttagatttcatacatttataaaccagcttgattgttttctctgtgaactacttgcttgttttataggcattctgttgtgttactattactgatttataacagctttcttggagaaaattttaatttctatatggttaagtttattactatttttaatgactgctgggtttttcccaggtttttctactcttaaagctttattttttggaatttaatctttggaccatctaggattatgtaaagaatgagataggcaggccaggcacagtggctcatgcctgtaatcccagcactttgggaggctgaggcgggcagatcacctgaggtcgggagttcaagaccagcctgaccaacatgtagaaatcccctatctactaaaaatacaaaattagctgggcgtggtggcgcatgcctgtaatcccagctagtcgggaggctgaggtaggagaatcgcttgaaccctggaggcggaggttgtggtgagccgagattgtgccattgcactccagcctgggcaacaagagcaaaactctgtctcaaaaaaaaaaaaagaatgagataggcattgagcttgagcttaatatatttgtcccaacacaagttgtcagagttgtcaaatacaaatctttcctccaccatgatttaaaagaaaactattttctgcaccatgatttaaagaaaactattttctttcttttctttaaaaaaaaaaaaaaaaaaaagacagggactctctctgtcacccaggctggagtgcagtggcatgttcaaagcccactgtaacctcaactcctgggttcaagtgatcttcctgcctcagcctcccaagtacgtaggactgtaggcctgcaccaccatgccctgctaattttgaatttttttgtggagacgggtttagaaatgatgcccaggctgaaactcattaagtatgcacgttgagaaagttgttgtatatgcatgttgagaaagttgttgtaaaaatgttgttgttttgtttaaatcagtcttttctctttgacagtgttttaaattgggtaatgctgctcttggtttgaacaaatctgtcaaacttgtcagatgtgtcttttctttctggccaggctgttgactgatttcttcttgtcacccagagaagagcaccatgttggcagaatactccccacctctgccagtgacctggtctcttgccttggacagatcatttcttccctggcagatgaggtttttggcattagttgccagctcacattaagtcccctcataaaaaccccacctcttgggtgagtggcagcctccaataaggcctttagtgggcagggcctcaggctcaagctttctctcctgcggcccacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggtaagacactacagacccttttaactgtaacattgttcattcctgtcaagatctgtgtcccttcccctccaatctgtttttgcatttcctctgtaaccatcttgggaatctcaggtgaaatgccttgtccaaagtcattctttggcagagatagagtcaaaatcctagtctcctctttgttctcctttcatgcattcactcattcgtttatcagagacagggtctcgccctgttgcccaggctggagtacagtggcgcaattaactcactgcagcctccacctcctcctgggctccagggatcctcaaacctcaacctcctgagtagctgagactacagggatgcaccaccatgcctagctagttttgtttattttttgtagagatgatgtcacactatgttgcccaggctgatctccaactactgggctcaagcgatctttctgcctcggcctcccaactgggattacaggcgtgagccaccacgcccagccccttctccttttaatagtccataaaaccccaggttgagctccgttttttacctgggaagttctagggatcattgtctgtcttctgttgaaatgagaaagcttttgactgttgttctcacatgccacttgttgtctgggcatgagtttctggggagaggaagagaagaaatggagaagcaaggcccaggcagatggactactatgtgtgaggctgtgtgtctggtagttccattgccctagcagggcacatagatctaaggaaagtgcgatgggttccttcccctgccccccaaacaaacacacacatatatgtacagtgtcagtggagagaagctttgagtgtaaggccattctagggactgatgaggggacaagagagtcttccacagtccctgagactacttggtgcagaacctatctctttactccaggttctgacaaagagattgatgtgattgatgtgacccgccaggctgactgcaagatgaagcttggtgattttgtgaaatactattacagcgggaagagggagaaagtcctcaatgtcattagtttggaattctctgataccaggtaagaggtgcaggaataacaaaaaaacctgacaaagtgcctgaaacttgtgtgatatatctagtgtatattcgtgtttctctctctttttttttttttttgagacagagtcttgctctgtcgcccaggctggagtacagtggcacgatcttggctcactgcaacctccgcctcttgggttcaagcaattctcctgcctcagcctcctgagtagctaggattacaggcgcccgccaccatgcctggctaatttttgtatgtttagtagagatggggtttcaccatgttggccaggctggtctcgaactccctacctcaggtgatctgcccgccttggcctcccaaagtactaggattacaggcatgagccaccgcaccttgcctcgtgttcctttctcttcttcctggtggtttcttcctttgggatggcgagctgggttatattttctagggtagctgctcacgttgtaacagttgagtcatatttctcctccacagtttctagcattggatagattacatagtagctattttaattaatttttgtctcctttttcaagaccttaggacacccttctttgaccttttcctcctatatacaacagtgccacagtcactgtgtaactggtgggataggtcctcagttcctggaaatagatttactaaaattacccccatgtaggtttcttacatttaaaaagaaaaagagaaacctatttacctttaaatgattctatctggactcacacacacagtagatacgtatatagtcttctctttgggtcagaaatgtgggaaataccaagaaatcataatgtatctttttgcccttaggaaacttactgtctgattatttacatttttaacttttaatttgtagattgataggaagttgcaaaaaagtgtacagggaggtcctgtgtactctttagccactttccctcaatggtaacgtattatgtaattacggtacaatattaagacccttgctgttgtgttttttttttttttttttttttgagacggagtttcgctctgtcacccaggctggagtgcagtggcatgatctcggctcactgcaagctccgcctccctggttcacgccattctcctgcctcagcctcccgagtagctgggaccacaggcacctgcgaccacacccggctaattttttatgtttttagtagagacggggtttcactgtgttagccaggatggtctcgatctcctgacctcgtgatccacccacctcggcctcccaaagcgctgggattacaggtgtgagccaccgcgcccggcgctgttgtttttaagatgcaaggttaaacaacctgagagtgtttaaaaactgtatttgtttgtttatacttcacttcatcctgaaagactattcaaggtagcttacagagatgtggagaagccaaaaaaaaaagagagaaaactagaacaaaagtgaaataagattgggaaatagaatgcatgtggtgggtgctcagcacatttcccggttggtggaaatggactatagagttttcagtgaatttcctgaaggtcagaacaaagagaggagtgcagtattgtaagatttgtggctttacgtaggataaaagcaacagatgtttcagagaaacatttctttacctggaactgagccctgtgaggttgctctagtggtttctcataaagaagacactatgagatggggatagtgcaataacttctataatccacatgccaagtgagtagtctggagtggggctggggagtatgagcatttagtggaggaaatgaacacctttgactggagaagcctgtggagcttggacttgggacttctggagatgagtagaatgaggatactgaccagacttacagaacagaaataagtgtcctatgtgcctttggggattctgtggagggaacttgttctctgacttatctgaccctcactgaactgtggggtattttattcaggcctcaatcttctcttcctaatcagctgacatctgctctccaccccttccttggtagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaaggtaggaatgcgcatggcttctggaggcagccaggccttgggcctccctgtacgtgtcacatggcagcacagaaacattttgaatcagtttgatttacattttgaataaaaaaaatttgatttggccgggcgcggtggctcacgcctgtaatcccagcactttgggaggccgaggcgggcggatcacgaggtcaggagattgagaccatcctggctaacacggtgaaaccccatctctactaaaaataaaaaaaattagccgggcttggtggcaggcgcctgtagtcccagctacttgggaggctgaggcaggagaatggcatgaacctgggaggtggagctttcagtgagccgagattgtgccactgcactccagcctgggcgacagaacgagattccatcttaaaaaaaaaaattgattcaaaaatgtttgacgaatcaaacgtttttgaataatagcagatgcctgaggttttcctggttgttaccttcttttttgttgttgttgaggcagagtaaaaacaaagattttatttatttatttgagatggagttttgctctgtcacctaagatgacagttgccagtgctggactgcagtggcgtgatctcagctcactgcaacctctgcctcccgggttcaggcgattcttctgcctcagcctcccaagtagctaggattataagcgcccaccaccacgcctagctaatttttgtatttttagtagagacggggtttcaccatgttggccaggctggtctcgaacgcctgacctgaagtgatctgcttgcctccacctcccaaagtgttgggattacagtcgtgagccactgcacccagccgttcttaccttcttaattgaaccagtttatactcatatcagcatgtatggaaatgtccacatttactttggaaattcctggtaacatgagaaacttccctttctccaacattattgaggtataatttatatactataaaattcatccattttaattgtacaatttgatgaattttgtcagttgtatatagtcatttaactgccaccacagtcaagataaaacctgtatgagaagtctttttaaagtcaggatttccatagtttcatttttagtaattgttacaattttgtaattagtgtattgtcagtgactatgaaggatttttgaggtctggaaaacaaatttcttaaatgattttggttttcaccattgttcagattatttagttttcttttttattattattatttttttcttagaaacagaatctgtctctgtcacccaagctggagtgtggtggtgcagtcataactcactgcagcctctcactcctgggctcaagggatcctcccacctcagcctcctgagtagctgggactataggtgcatgccatcactcccagctaattttttttaccttttttttttttttttttgagacagtctctcactttgtcacccaggctggagtgcagtggcatgatcatggctcactgcagcctcgacctgctgtgcttaagctgtcctcccacttcagcctcccaagtagctgggactacaggtgtgcaccaccacttctggctaattaaaaaaaattatttttgtagagactagctctcactatgttgcccaggctggtctcaaactcctgagctccagcagtcttcccaccttggccctcaaagtgctaggattacagacgtgagccactgtgtccagacaatttttttactttattttttgtagagacagagtcccactgtgttgcccaggctggactcgaactcctgggttcaagtgatcttcctgcctcaacctcccaaagtgctgagatttcaggcttgagccaacatgcctggcctagttttcttatcagaaaagtcaaaggaaagaatggaaaacttggattgtggctcttgtccaagtgatcacaagtccttacctagttgtttccattggtttatcatttaggaagtagaatgtgtaaatgaaagtgctattatgcaaatgttaggtttaactcttttattttaaaataatttcattttatagaaaagttaaaaaataatgggaagaatgtctgtctgcccttccctgagattcctcaaatgttaccattttattatattctctctctaaagcaaacacaataaaatggttatatatatatttttttcctgagacatttgtgcgtaaagacataatatttctttatatcttaataattcagttgtagttcttaactacaagtttgtcttaaaactttgtcttaaaaacaaagacaaagtcttaaataatttgtatagttatcaaaatcaggaagttaacattgatatactagtacctaatctacagacctgattcaaaattctccggttgtacacctgatatttctagtgttacttttctacattgaaatttattatcatgaaatactggttaaaccaatcatgctgtgagaatatatttgtgctactgggtttttgtttctttctttttttttttttttttttgccaaattatctttctggtgtttatccaggcaaaacacaattaggaaataaatgttcttccaaaagataatcacataacatataatcttccagaagtccttgggcgattactgaacttttaaacttttattagctttgattgcaggtgtgggaaggaacactctgtaaatggcatttgaaggcaaattcaattttcttctcatcagtaatgtggccttaaattctcctaaggctactagtattgatctactcatctgtagaggccattctttatttggcattgtgtctaaaataggaacacttggtgtacatatgtcttaacttgaacaattttgtttgaaatgccctttccaatttgtttttgtcaagtttatagaaacttaaaagtacaaaaagcaaagtgaccttttgaagttttccaaatccacaaagaaatgataattggatgggtttgggcaagaactctggcatattgccatcgttttggagcatgggagaaatacccctttggagtacccgttaaggacttttctggaaacccttggtatttttgtcacttcaacctctttttgtttcagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacaggtcttcccttgggtgcttctgggagggtttggggagggtggaaagaagaagggagcttttggccccacagcatattaatctgattacgtgggatgtctttctcatatcagcgaaaggcgcagaactgggcttcaagaaatttcatgtggtagtcagtgggcagcatggtcacctggggaggctgaaagtggggaatgtccaggaggaggctgatggacttctttgtcctgggttgatgtcatctgggtgaacagagaacatgactctaagccccgtaactctagggatagtgcctgggaggctggcattctaggctctaagtcagaatgacctgtggtggggatagtgctttttttccctaaacagtttgtacctgggcttcactcttagaattatgaattcttaggtcttgggtgggatctgagtatatttattgtgaaaaaatcccccagttgtctcaatttggggagagttgacatctttacttgattaggtcttatatgaatacagggtatctctccatttatttagattttctttgatttctttaatcagaattagtgttaaattttcttaaaatgtatagtagaattctctagtgcaatcacatatgcctggagatttgttttcttgggaagttttaaattaacattcaatttaaaaaatctttaaggttattcagattttctatttcatattaaataagttgcgatcatctgctcttcaaggaattggtctatttaatctaaattgtcaaatatatgtgtggagttgttcatagtgttttcttttttttgagatggagtttcactcttgtcacccaggctggagtgcagtgatgcgatctcgtctcactgtgaccactgcctgcatcccaggctcaagagattctcttgcctcagcctcctgggtagctgggattacaggcttgcactaccacgcccggctaatttttgtatttttagtagagatggggttttaccatgttggccatggctggtctcgaacttctgaccttgacctcaggtgatccacccgcctcagtctcccaaagcgctgggattataggcgtgagccaccgcacccagccatagtattttcttattacccttttgatgtcttccaagtctctagtggtattctttgtatcattcctgacgttagttatttgtgctttctcttttgtttgtgtcaattttctataggttggtcaattttattgatctttccaaagagccactttttttttttttttttttttttttttttttttttttctgagacagagtctcactctgtcacccaggctggagtgtagtggtgcgatcccggctcactgcaacctccgcctcccaggttcaggtgattctcttgcctcagcctcctgagtagctgggattacaggtgcctgctgccacgcctggctaatttttgtatttttggtagagttggggtttcaccgtgttggccaggatggtcttgatctcctgacctcatgatctgcctgccttggcctcccaaagtgctgggattacaggggtgagccaccgcacccggcccacttttggttttattgatttttctctgttgtctttttgttttcagttgtgttgatttctgcttttatctttatttttccttccctctgcttgctttgggtttattttgttctttttctagtcttgagatgagagcttagtttattgatttcaggctttccctaaatttccctctcagcattgatttaggtgtgtcacacaaatattgacatgttgtattttcattaagttaaatgaggttttgaaaaattgagatacatcttaaatattgtaaaatttaccattttaaagggtacaattcagttctttgtatatttacaaggttgtgcaacatcactgctatttaataccagagaatgttcattatgttatttatctcctttttgagatggagtctcactctgttacccaggctggagtgcagtggcacaatctcggcttactgcaacttccgcctcccgggttcaagtgattctcctgcctcagcctcccgagtagctgggactacaggcttgtgctaccacacccggctaatttttgtgtttttaatagagatggggtttcacccatgttggccaagctggtcttgaactcctgacctcaggtgatccacccgtctcagcctcccaaagtgctgggattacaggcgtgagccactgtgcccggcccgaatgttcattgttttttaaaaaaaccctatactcattagcagtcactctttattcatttgtctgccagcccttgacaacccctttttcacttcatttgtgtatggatttgcccttctgaatatttcatatagatggaatgttgtaatatgttgtcttttgtgtctagcttctttcacttgtaatgttttcaagaatcatccatgttacagcatttatcagtatgtccaggctggagtgcagtggcgcgatcttggctcactgcaacctctacctcccaagctgaagcgattctcctgcctcagcctcctgaatagctgggattacaggcacctgccaccactggcctgggtaatttttgtatttttagtagagatggggtttcaccatattggccaggctggtctcgaactcccaacctcaggtgatccacccacctaggcctcccagagtgctgggattacaggcgtgagctactcctgctccctggcgagtgcatctttttttttttttttttttttttgacggagtattgctctgttgccaggctggagtgcagtggtgcagtggcgcgatctccactcactgcaacctccgcctcccaggttcaagcgattctctggcctcagcctcccgcatagccgggactacaggcatgcgccaccatgcccagctaatttttgtgtttttagtagagacggggttttaccatgttggccaggatggtctcaatctgttgaccacgtgatctgtctgcctcagcctcccaaagtgctgggattacaggtgtgagccactgcgccgaccacttcgttctttttaacagctgaataatattctgtggtgtggatatgccacattttgtttatccattagtcagttgatagacatttgagttgtttgcactttttggctgttatgaatagtgttgctatgaacattcgtgtacgagttattgtgtgaacgtaagttttcatttctcttgggtatatatctaggaggggaattgctgagtcatatgtaactctgtgtttaactttttgaggaactgacaaactgttttcaaagcagctacatgtaccattttatattctcaacagtaatgtatgagaatttcagtgtcttcacatcttcccccaatgcttattgctgtctctttatgattatagccatcctaatgggcgtaaagtggtatctcattgaggttttgatttctgttttctggatgacctttgatgtttaacatctttccaaatgttcattggacacttgtatagttttttttggagaaatatctatttaaatcttttgcccattctttaattagattgtctcttcattgttgagttacaagaatttatatactttggatactagacttttaccagatatgtgatttgcaaatattttctctcattcttggggttgtcttgtcacttttttgatagtgtcctatgaaggacaaaagttacaaattttgatgcccaatttatctatttttttttctttatttgcttatgcttttggtgtctaagaggcttgcttaattcaaggtcatgaagatttatgcctatgttttcttctaagcattttatagttttagttcttacatttagatctttcatccattttgatttatattgattttgtgtatggtatgaggtaagggtccaatttctttcttttgtatgtagttctagttgtcccagaaccttttgaaaagactgttctttccccattgaattgtcttgacacctgtgtcaaaaatctgttgaccaaagataagggtttatttctggaccttgaattctattctgttgatccttctaacagtgtcacaccatctcaattattgtacatttgtagtaagttttgaaattgggaagtgccagtgctccaactttttctttttcaggattatttggccccttgaatttttttttttttttttttttgagatgaagttttgttcttgttgctgaggctggagtgcaatggttgcggtctcagctcactgcaacctcagcctcctgggttcaagcgattctcctgccttagcctcccgagtagctgggattacaggcacccgtcaccatgcccggctaattttttcgtatttgcagtagagacggggtttcaccatgttggctcagctggtctcgaactctagacctcaggtgatccacctgccttggcctcccaaagtgctgggattacaggcgtcagccacagggcccagccggtcccctgaattttcataagaattttttggttcagctttcatataggttttctagttattttgtagtgtttgctctaattattactttatacatacatagcatatcacagtctactagtatttacatattacctgtttgagggaagggttgaaaccatacctcttttttttgagacagaatctcattctgtcacccagcctggaatgcagtggtaagatgacagctcaccacagccttgacctcccaggctcaagcaatcctcccacctcagcctcccaagtagctgggaccacagatgtacactaccacgtctggctgatttttttagttttagtggagatggggttttgccatgttgcccaggctggtcttgaactcctgagctcaagtgatccacccacctcggcttcctaaagtgctgggattataggcgtgagtcaccgcaccgggcccaaaaccttacctctttttacatccctttatccttcgcatttttctacaattagtcatgttttacatttttccatgtatttgtcttaaatatttctcttcatacattgattatgagattgacgtgctacccactacaccaagagggctactatcctctgcgtatgttgagaactgtatcacaaagttttataatttttgctttccctatgaaacataatttagaaaactcaagagaaggaaattctatggtattcacccatgtttttactcatctgtttattctgttttcctttctggtctttagagtttcagggtaggtctactgtcgacaagttcttagtttttttccatcagtaaatgtcttgattttttttttctttcattcctgaaggatatttttctggatatagaactctgggttaatagttcttttctttcaacacctaaagaatgttttgctgtttcgttctggcctctgtggtttctgatgagattttggctatcatctgaattgtttttcccctatagataatgtatcatttcttgatgctttcattcttttttttttttttttttaagttttctgcagtttggccatgctgtgttttttttggtgtggatttctttgggtttataatgctgaatgtgttcactgagcttcttgaatgtgtaggtttatgtcttttgctgtatatgtgaaatttttagccattatttcttttcctttttttttcttttctttctttctttcttttttttttttgagagggagtgtcactctgttgctcaggctggagtgtagtggagcgatctcggctcactgcagtgtccgcctcccgagcagctgggattacaggcatgtgccaccatgccctgctaatttttgtatttttagtacagacagggtttcaccatattggccatgctggtcttgaactcctgacctcaggtgatctgcctgccttggcctcccaaagtgctgggattacaggcatgagccaccgcgccaggctgccattatttcttgaaatacttttttagactcatgctctaacttctgctggatctctgattacatgaatgttttgtatcttgtcttagtcccgcaagtccttgagtttatttttctgtgtcttttttctctttgttcaagttcagattgggtaatttcggtttctctgtctttgcattttctgtttctttcttctgttgtctccattcttctgttgagtttgtcaattgcattaattttagatacagtatttttttttttttgacacagagtttctctctagcacccaggctggagtgcagtggcgtgatctcaactcactgcaacctctgcctcctgggttccagtgattctcctgcctcagcctcccaagtagattacaggcacgcaccaccatgcccggctaatttttatatttttagtagagacagggtttcaccatgctgatcaggctggtctgaagctcctgacctcgtgatatacccacctcggcctcccaaagtgctgggattacaggcgtgagccaccacagctggcccagatacagtacttttcatttctaaaattttcttttgtttcttgtgtatttctttgctgagaatttctatttcctatttttgtgtcaagcatgtttggaattgctcactaaggtattcttatgatgatttcttatgatgatttctttcaaattcttgttacataattctatatttgtctaaccatatattgtcttatatatattggattgtctattgttttacaagtctgtttttctcttcaattatcaatattattgatacgatttcattggttttttagaatgtttaatacatggtgaggcaggtcattcactcccacccaactcccacccccatctgcttttctcttttatagttttctgttcccaggcatttattcatccatctttgaatcctttgcctggtctagtccataatgacttttctatactgggcatttagtaactgatggattgaatttgcccattagcggtttgagttaattaattgacatcttggtagaaatgcccacacaccgggtgcaatctacttagggccacaagcattgagtgtctactgtgtgccctggtattgggctaagtgctaaggacaaaagattgataggctgtttcagtataatattctactagccacaatagcaccaataggggtattcaccactagttttggaagcacagagaagagtgcttagtctagccataggtttgtgaaagtcttaggagagcaacactagaagggtgagtagggattaactatgaaaagaaagacaggaatggcatttcagacatagggaaaggtggaagaaaaccaaaactgtgtgaagcagcttatggatactagagcttaaagagcaagggctggggtggatgaaagtgaaaaggtaggccgactgaacttaccacagaggcgattgagggccattgaaggtttatttagtttctaatgaaatatttcagatgtaccaaaagatataaagaacaatataggccgggtgcagtggctcatgcctgtcgctgaggctggagtgcaatggtgcgatctcggctcactgcaacctctgcctcccgggttcaagtgattctcctgcctcagcctcccgagtagctgggattacaggtgcctgccaccatgcccagctagtttttgtatttttagtagagacggggtttcgccatgttggtcaggctggtctcaaactcctgacctcaggtgacccacccgcctcggcctcccaaaatgctgggattacaggcatgagccactgtgcctgaccctaatttatattttagatatatcgcttaggaatggatgtgaaggatagatttgagattattgtagagcagtggtttgcaaacagtcggtattcctttatactcttaaaaactattaaggacccagaagagctttttattatgtggtttatatttatcaatttttaccatataaattaaaatagaaaatttaaaagtacttgttaacttattaaaaaataattataagcccattacatgttagcataaataaaattttttttatgaaaactgttttcaaaaatgtttagtgggaagaatgacattgttttacatctttgcaaatctctataatatctaggttaatcaaaaattgttagaaccccagatctgcttttgctttcattctgttggatgtcacatcatgtacttcctggaaaactccactgtatacccatgagaataagggtgaaaaaggcaaagaacatcataatattctcatgaatatagttctgagtggcatctcagcttctctcaaagagtctcagggagcctaaggattccttggaccacaccttgagaacatctggtgttgggaagccagtttggaggctaactgctcttaaggagttgggtttgagatgagtaggtagtggagataatcagaggaagaaaggccctcttccagctttgattttgccttgttacactgcagggtggatccatgctgtgctgacgcctgtggactgccttgcctttggagggaacttcttacacagccttaacatcgagatgcagctcaagtgagtactgaaactgtggtgattctatgttggccattcctgtctgctagagtgaggagtataatgtagaaggaggggacatggccagaaaggaatggttcctcgttcctgatcatgttcagctgaagattaacaccttttctgcacttagtagttatttgactttgggcaagttatataacctttgaacccaagtttcctaatgtgtaaagtcagatcttgcagagtcattttgaggattagagatacaaagcatccagaacaaaacctgattcatagtaggtgctcagtaaatgaatccttgtttttgttgttggtgtttcctccttctagagcctatgagattgagaagcggctgagcacagcagacctcttcagattccccaactttgagaccatctgttggtatgtgggaaagcacatcctggacatctttcgcggtatggagccctttgccaactgtcctttttgcccctctcccctgagtgaatgagtatgtgtgtatgtgtaagtaacgcagtcaagacatgatactatttcattaccagaaagatctcagtatataaattaaaatcatgttgtgtaccgtaaatatgttcaatttttaaaaagtgataattagtgctttaaaaaaaatctccctagtgctacccgcccagccccgagccccttcttttttgagataggatttcactcagtcacccaggctggagtgcagtggtgtgatcatggctcactgcagcttcaaactcctgggctcaggcaatcctcctgcctcagtttgccgagtagctaagactacaggcatgggcccccacacctggataattttgtaaattttttgtatgaacagggtcttgttatgttgaccagattggtctcaaactcctggcctcgagtgattctcccacctcagactccttttgctggggttacaggcatgagccacagtacccagcaatgctacccctttatagtccctttatagtttcacccactctcctcccttgtaccatccgtaacttctggaaaccactaatctgttttccatttctataattttgtcatttcttttttctttttttccgagacacagtctcactcttgtcacccaggctggagtgcagtggcgtgatcttggctcactgcaacctccatctcctgggttcaagctttgcctacctcagccttctgagtagctgggattacagacacccgccaccacactcggctagtttttatactttttttttttctttttcttttttttgagatggagtctcgctctgtcaccaggctggagtgcagtggtgcagtctctgctcactgcaaactctgcctcctgggttcaagtgattcttctgcctcagcctccagagtagctgggactataggcacgcgccactgtgcccagctaatttttgtatttttagtagagacggggtttcaccatgttggccaggatggtctcaatctcttgacctcgtgatccgcccgcctcagtctcccaatgtgctgggattacaggcgtgagccaccacgcctggccaaatttgtcatttcaaaaatattgtataaatggaatcattatagtacgtgaccttcttagattcacttttttactcagcataatacatggcaaggcatggattttaacctttttgtttagcaagtgtgactgaaaatattggatcacagtgaaatgatctctatttcctgctggttaagataaaaagttcaatttggatagtctgagagtttcctggatctgcttcccctggggataaggcccagtcctgaccgtcctggcatcattgttttggttcctgggcgttagcccagttggaagccactttacttactgggtttcctctttccttgtctgatccagaatagaatgggtcccttacttaggcctgagattcttcaagttgacttggccaggagaaatcagtattgatgagttataaagaatctcaggggccatgagtacagcctcgtagccaatacctcaagctcttattctgccacctagactgtcacttaagtgttcaatcagatgctggatgactaactgctcattacttattctaaacagcttggttcagtagaaaattatttatagagcctaaatctggctgtttgtagtagcctcctgacataaggcagaacacagctaatccatcttctacattaatggcccttaaagtctgtgtaggtagagctcatagtcctcctgagtgttctcattttgaaacccaggaggcacagtaatgtcatggaaggggcccaagcctcagattcaaatacacatggttttagtcatggctctagcacttgctaggtgtgtgccctgggtcttgactttgcctctctgaacctcaattttctgggctgtataatgaagataataccttgcttacaggataggtataagtgttaaatgagataatagatatcacattcctagcacttagtaggtactcagtgaatgaacactatcagaagaactgagatctgcagttgtgctcagaaccttgagcattttctctggttgtcttaacaaaagtcccaagtccttcactttcctgcatggctttgttgacactctgctttcctctttcctcctttaggtttgcgagagaacaggagacaccctgcctcctacctggtccatggtggcaaagccttgaacttggcctttagagcctggacaaggaaagaagtaaatatgcatatttctctacctcctctggagttttgccctttgtagggactggatttgggtagatgttttggagagacagaagagaccagagaagcttgtgggctcctgggtgtagagtggaggtgtgggctaggattcctttgattacattttaaaatctttctttctgatgataaaaagtaatacaacatcacactagagaattagaaaaatgaggaaaagcataaagaaggaaaattatcacctatgatttttacactcagcgggaactgctattaacacttgtgtacatttccttctggtcttttttatgtgcattttaaaaacataattactgtcacactgtgtggttgacccttgaacaatgtggaggttggggtgcagaccctgccccccaatgcagtcaaaaatccacatataacttttgcctccctaaaaccttaactgctaacagcctactgttgaccagaagccttaccagtaatatagtcaacacatattttgtatatgttatttgtgttgtatactgtattattacaataaagtaagctgaaaacatgtgtttactgttcataaagtggaaatgaatcctcataaagggcttcatccttgtcttcacatggagtaggctgaggaggaagaaaaaggagaggggttggtcttgctgtcccgggtggcccaggcagaagaaaatctgcatataaacggacccatacatttcaaacccatgttgttcaagggtcaactgtatatccagttttgtgtttgaatctattggtttgtcttaattttcctgtgtcaccaaagttctccagaaacatttaatagttatgtgatattcttttgcaggaatgtaccatccttgcctaactacttgcttattgctgcttcctttttatttctttgaggggatagttttaaagaatcagacagtaaatatcagtctttgtccctcatttcttgattgtttcttcaggatggattcctggaagaacaattactgaatcaaagtatatgaaaaaatgtaaggctcttgatgcatactgccaaagtgggttttagaaatgtacaaatgtccatttatccaactgaacattaatcaactataaaaaaaaataagaaagctctgtatgtactgatttggaaagatctccaaaatttgtcaaggtgcacaaccgtgtgtatagtgtgccactttatatgtaaaaaggggagaaataagaattatgttagtatatacttgcctggatatatgatctgggatgtagaaactaatgaaaatggttacctgtgggagtgggatgatgggattgatggcaggggcagggtgggattgatggcagggacagggtaggaatgaagcttttcaatatcattttattttattttattttattttatttatttatttatgagacagaacctcactctgtcgcccaggctggagtgcagtggcacgatctcagctcactgcagcctctgcctcccaggttcaagcgattctcgtgcctcagcctcctgagtagctgggattacaggcatgtgccaccacgcctggctaatttttgtatttttaatagagacggggtttcaccatgttggccaggctggtctcgaactcctgacctcaagtgatccatccacctcagcctcccaaagtgctgggattacaggcatgagccaccacacctggcctgcctttcttttctaatgtaagcctttagctgttaatttccttctcagcaccaatatttgatttttgacctatgtgaacgaattaacttttcagaatactgaatttaaaaaacacaccaagaaatcaagagaagaagaaatgtcaacatgtaatcttaggcttcagatactccctttcctgtgtatactgtgaccaaaggtcactgcactgcaggcttaacttgtacaatctccttagttcctgttgccaaccttcccctcggatattcttggatttcatattttgagccttcccttgctccctgggctcacctacacctggaccttagcctgtgattctgtttctccacacctctcaggtgtggctaccttgggtttcatctctgacacctcccatggagtgaactttagagtgactgtgtcccaaaaacaccaaaagggaggtgggtgtggcccaagcactcatgactcaggatggacccagggaccaagggatggccccaaacagagtgatcagtgggagctggagtagagtagaacacagttctgagaagcccatgctcatggaaggagtcttttgtgaagtgcagatgatttgtaggggaggaacctgctccctcacctttccagagaccctggtctgggaaggaggaagccataagattatttagctgggtcacatggattctcagctccccgcctagccaccaaaataaattccaccagatagatgaaaagagttaaagggaaaaaagagaattaaaccatgagaaacaaggaaatgctgaggaattttttatcagccctctggatacagaaatgaagtgaaaagtggtagaaaaaaaatcacaaaggaagaaaaccttgagatctacataaaaatgtaaatctcggtactcaaaaagagggcaaacgaaagagagacaactaacagggatcgctctgggttgctgttgagctagctgtgggccagcagctgctcagcacagagttctttcctcacaagtggagaggctggtttgtccccactgatctccctgaggtccttgacttttttgaggggtgtggcccaaacccacaacttagttcctaataccttttgatactcttttattagatagatgttttacaaatattttctctcagtctgtgccttacaaagtagcagaggtgctgaaatagaggtttttcaaaaaagttttgctttttaagtccagttgatcaacttttttcttttctggtccatgcttatgtcctatctaagaaatctttgcctaactgaaggccacaaagaactcctcctctgtctaaagcaggggtttccagccggggtgcagtggctcacgcccgtaatcccagcactttggaaggccgaggcgggtggatcacctgaggtcaggagtttgagaccagcctggccaacatggcgaaaccccatctgcactaaaattacaaaaattagccgggcgtggtggtacgtgcttgtaatcccagctactggggaggctgaggcatgagaattgcttgaacccaggaggtgaaggtttcagtgagccgagaccaccacaccactgaactccagcctgggtggcagagtaagactctgtctcaagaaaatagtaagaagtaaataaaatatagcaagggtttccaaccttttggcttccctgggccaccttggaagaagaattgtcttgggccatacgtaacgatagctgatgagctaaaaaaaaaaaaaaaattacaaaaaatatcataggctgggtgcagtggctcatgcctgtaatcccagcactttggaggccaaggcgggtggatcacctgaggtcaggagttcgagaccagcctggccaacatggtgaaaccccgtatctactaaaaacacaaaaaattagctgggcgtagtggctcactctagtcccagctactgtggaggctgaggcaggagaatcgcttgaacccgggaggcgggggttgcagcaagccgagatggtaccattgcacttcagcctgggcaacaatagtgaaactccatctcaaaaaaaaaaaaagtctcataatgttttaagaaagtttgctaatttgtgttgagttgcattcaaagccatcttgggcagtgggttgggcaagcatggtctaaagggtgtatagttttaggttttacatttaggtctatgatccattttaagtttgtgtttgtgtgtatggtgcaagatagggattgaggtttgtttgtttttgtttttttttttgcatgtggatatccaattggtccagaatcatttgttgaaaagactactctttctccattgaattgccttggcatatttgtccaaaatcagttgtctctttatgtgtgggtttattcctcatgcctcttgtttgacaggctctgccagaccatgaggatgagatcccggagacagtgcgaaccgtacagctcattaaagatctggccagggagatccgcctggtggaagtaaggagcatggggcagggaagaaaaggcatttggaaaggccttgaggctcaagtggcaggttaggcctctgcagttagcatgagagcccaggggaagggtcgggaagaccctaccaaagacccaattcattcgttcaaataattattactgtgtttcaagtgtgccgcacattgggctaggctcttaaaatacgtaaatagtgcctgcccacaaagaactcagcctaatagaggaccctgagcaaagttaacctctttgagtttcagtttcctcatctctaaaatggggataattgtacctactcgaggattgttaaaaggattaaataaggtaatgtgggttgagcacaaaaatagagtgcttggcacacagtaggtgcacagtaaattctgacggtgggtcgtggtggtgggtggtggtggtagttgtagttgttgttattattaatattttgactcagtctctgcattctgcaaaatgacagttctctcggggtgaagatgattacaaagccatgtttcaacaggtggcatataccacgaggcagtaaggtatagtggtaagagattcagagaaacctgggttctggttcctgctctgtcacttgcaagcctttcagagcctcagtttcctcatctgtaaagtgaggataacatcaacctttcaggattttgttaggatcaaaagctaatatatgtagagcccctcgcacagtgcctggcagagtaagtactcaataaatgtgagccattgttattagtagactttaatagcaaagagagaagttggtgtgggatggtgaagtagcagaggcaccagaggagaattcctttaagctcagaagctgtaaagttttatttagtgcccaggatatatacatccatgctgaagggtggtcaaagtgagctgggaagttgtgcttctagcctcaatgcttgcagcatgtttcactgcctacaccatagcttacagtgtccacctcctacctctcattttcctccagtcccatctgtcaaaatcattcaggatagttaaaggcttaccttttctccagcgcctctcacttaaaccacaaaactttgggctggttggaagaggacttagagatagattatatgtggtccatgggctttcaaatgttttaaagcaatggaatcctttttttaaaatgacatcttaggtggaagcccaatattcaaagcataactgctttgaataagatgaaggtgggaggcccagggctccacttgttcttctcattcgccttctaccttcccccgattctcggggctcctcccaagaagctcaaaggagccacagaacatcttcaaaaatcacctttccagtctagtcctttaattttacagctaagcaaacagtctcaaatggtcagataactttcctgagctagttacagagctagctagcagcagaattaggactagaacctctccttctctcaaatcctgtagtccttagaatttgaaccacacagattagtacttgattattttctgtctcatgtcagctacttaatggagtattttctctccagttttgacagtagtgctttgctcgtcttcttacttgtcaatggctgggtaaagaaatgccacccaataaattcttgatgactcattatgtaaaagctagggtgtgcatatgtggagcatctataagccacttccatggcagtaccaccagtaccaggaacagacctctgctgttagtgttgagagaacccttgagtaagctctaaccccctcatgtactaacactcttgtaggacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaaggtgggtgctggcccatgggttcagcccaacccttttgggtgtcccttggaagagcagggtttcaaaaagcaggctatcctgtctggctgccatgtcccttagaccccctgctgtttggctaccagtcccactcatttaataggcatttattgagaccttttctatgccgggcactgtgataggtgctgtggatgtgactctcaagaggctgacaggcgagtgagaaagacaggcataaaaacaaatgagtgcaatcaagtattgtgaatgccacaatcaggggtgtgtgtgggaccctgagatacagaggagggttgattctgtctgggtagggaagattttcaggagctcttttcagaaaacataacacttagctgaattttgaaatgctgggacgggaatgagatttgaaaacattgcgtgtgtcaggttgtagtcttgagcaggtccttgagaaaagccctccaccagggctccatcttgcctcaagattgtgattctctccatgggcatctgaagatgtgccccctcttttttaagggaacatggttcacaagattgacaggtgtcccctgaaccaaccacacattttcaacctcctgctcctgtgatcagtgggggtatggggggacagtatagcagaaggccttggctcaggtggttttgacagtgaactgaaccagtgaaaccagagggaacttgccatcgtgattcccatgggagtcccagacaggtaacggctgagtctcctacttctacagttcaacatcactggtgcctgcttgaatgactcagatgacgactcaccagacttggaccttgatggaaatgagagcccattggccctattgatgtctaacggcaggtgaggtgggaaggaggagcacagaggtactgggactgtcagtggtaatatgccactgagacagggcatggaattggaatctaggggttgggacatgggtaggagggactgtacttagggcaatacctagatattataatgtattgttgcttagttcagagaaccatggtgtggtgttggaggtgggtagagtgagaggtctgaaatcgaattggcaagcctgagaaagattttatcagttctagaaacttcagcaagtcattgggagagaaccactggcagcaataagtatagcatacttactaaaagcattagttttttctataccttttgactttcgattagatttttaggaatttagtttacagaaatccttgcacacaagtgtgtaacgataaatgttcagtgttcactgcaccattgtttgtaatagtaattggaaacatccaaatgttcatcagtaagggctagataaataaatgatggtacatctatagaatggaatatcatgtagctgttaaaaagaatgagacagttaaatattgacacagaaagatgttcaaggtatatttttaaaatcaggttacataataatacataggaatagttccatttttacttttaaaagggcatgtatgcacatgtgtatatgtatgcacgtatggaaaagctgtatatagacatttgtattttttgaagaggtttaaaaatgcaatatacaagcgttagaaataaaacagtgtgaaagagcacacagtgaaaaatctcacacccatctctctttccctgttaccttcccatggacaaccaatgtcagtggtttccttccagagatatgtatgtacatttaggcaaataaatagtgtgttatatatatgtaaatacctttaaaaaaaaatagagatggggtctctgttattgcccaggctgagctctaactcctagactcaggtgatcctctcacttcagcctccagagtgctgggattacaggtgtgagccaccttgcctggcctagttatatattttatacttctcataccaagttttgttttttttttttttttttttttttgagacagagtctcactctgttaccaggctggaatgcagtggtgcgatctcagctcactgcaacctctgccctgctcggttcaagtgattctcgtgtctcagcctcccaaatagctgggactgcaggcgcatgccactatgcccagctaatttttgtatttttagtagagacagggtttccgcatgttggccaggctggtctcgaactcctggcctcgagtgatccgcccacctcggtctcccaaagtgctgggattacaggcatgagccaacatgcccggccttgttataccaagtttttaacagtggttatccctggaaagtacaatagggaaggtaagagcaaattttcacttcagtagcatttgaattttgtacaatgagcacgtatttacttttctttaaatatttatttacttttctttaaataattttaaaagaacaagttctaaaagaataaaataaaagctgtttacaacaaaattatggacttgggaatcaggcagtccgaggtttaaatcccagctgtgacacatattcagtgttctactttggcaaactaatgaacctatctgagcttcagtgtcctcattatatgtattctatagttaaaacttaccttagggttgttggaggattaaatgagataatatacgtagaacgttaaccacagggcctgccatataattaatacttaatacatggtagttcttataaatatgatgatgaagatagagacaaaagaattctccatgaagatggtgataatgatgtgggtatgaccagaatccaagaagattgtcagaaaccctgaaatacatagaggcaggggaaggcagtaagggctattttctagatactcagaacactagacatcagcagtcaagagccaagtgcagagtatgaacgatgtaggaacacaaacaacaaaggtagcttaattgcctccttgtaggaaaaggttaccttcaggtccatctgggcccatctgggtggaaaataagggaaaaaggagtgagagtagggcagattctgaaagcaacagagctattcttggggtttgagaatccagttactaaagtgtaagattagagagaccgttgaatattgcctttgtccagaactcatgataggtctcctggacaggagaaaattcagagtcctaggagtctagcctataatggctattgaaggtacaataagacatttcctgcccctgccccacccccagcagtccttcttgtgctgctgcctattacccgctgcagctgtcagaagctgttaagtgaacccagatagtcaaagtatagaaatatttacagatgatgtgatgctatgtctgggcttctctccaaacttggtgttttgaagagaatgaggtgtagatgaaacaagactggctgggttgataattgctgaaacttagctgagtgataggtatatgagaattaattctacttttatatttttgtgtatttgaaatttttctttaaaatttttttaaaaattattagagacagggtcttgctgtattgcctgggctcaagcagttctcttgcctcagcctcttgagttagctgatactacagacatgcactaccacaacccagctgaaatttttaattattagaagttaataaaagatcagggcatacatagctgtcatttattgagcatctcctctgtgtcaaagtctatcttagctgtttatatacactattttatttaatcctcacaaccccaaaagtaagtagtagtatccccattttactaaggtgaaaactgagagtcagagaaccttataatattacctacatggagcagttgccatggatcaagctctgtatgagctcatttaatcctcaaccctctgaagtagaaaataggtcagttaaatgacagacaattcactgaaagtcaatttaaccaaattactagttgctaaatgtatcaatttactgatttaccaaaaacatgtttctttttaactgtttatgaggtttttttcagcagtttgtattggttaatatcgtctactatgtgtaacaggattatctaagccactttttgagtcctgaacaaaggcagtgttcatttcaaccagcaatcatgagtgtcttcacttactggccaacgtttgttgttttttttttctttttgactgtagccattgaggtttttccagcagtttatattggttaatatcatctactatgtgtaacaagattatctaagccacttttgagttctggacaaaggcaatgttcatttcaaccagcaatcatgagtttcttcacttactggccaacatttgttattttttttttcttcttgactatagccattccggtggatgtaaagtggtaactcattgtatgtgttttttaaaaaataaaaattgtggcccggtgcagtggctcacagctgtaatcccaacactttgggaggccagggtgggcggatcacttgttaggagtttgagaccagcctggccaacatgacgaaacccttgtctctactaaaatcataaaaattagccagacatggtggtgggtgcctgtaatcccagctacttgggaggctgagacaggagaattgcttgaacctaggaggcgggaggttttagtgagccaagatcatgccactgtactccagcctgggcgacagagcaagactccatctcaaaaagaaaaaaaaaaaaagcaaatataaaaattgtctatatttaaggtatacaatgtgatatttgataaaatctatactgtgaaatgattatgccagtaaagctgattaacatatgcatcacttcacatacttaccatttttgtgtgtgtttgtggtgagaacacataggtctactctcttatgaaatttcaagtatacaatacagtattttttttttttttttgagacggagtcttgctgaggcaagagaattacttgaacctgagaggcggaggttgccgtgagctgagatcatgccattgaactccagcctgggtgacagagcgagactctgtctcagaaaaaaaaaaaaaaaaatttttttttggatacaaatcctttgccagataaacgatttccaaatattttctcccagtctgtggcttatattttattttcttaatggtttcttttgaaatacaaaaatttttaattttacttaatcccaggtcataatgatatttttctgtgttttactctagttttatagttttaggttttacatttagatctatgatgcattttaagttaatttttgtatatgatgtgagataagggtccacatttatttctttgtatccatttttctcagcaacttctactgaaaaaaaccatcctttccctcactgagctgctttagcaccttttgtcaaaaatcatttgatcataactgtacgggtttattcggaactcttttccactgctgtatgtctgtctttatgctggtattgcattgccttgattaccatagctttagagtaaattttggaattgagcagtataagtcatccaatgttctttttcaaaattattttggctgtgttaggtcctttctatgtccatgtacgttttactatcagctttttatttaaaaagctggctggattttgatagggattgtattgaatctgtaggtcaatgtagagagaattgcaatcttgctagcgactaacaatactgctagtgactgtttttatgttctccttcccttcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaagtgtgtgtctgttctttctttttcctcccctgcccgtttttttgtttgtttgttttgagacggagttttgctcttgttgcccaggctggagtgcaatggcacgatcttggctcactgcaacctccgcctcccgggttcaagtgattctcctgcctcagcctcctgagtagctgggattacaggcatgtgccaccatgcctggctaattttgtatttttagtagagatgggatttcactatgttcatcaggctggtctcgaactcctgacctcaggtgatccgcccatctcagcctcccaaagtgctgggattacaggtgcaagccaccacgcccagcccttgcccattttatatttgtttttggccctcttgatagacttaagaccttaggcctgagcttgttgacattttgctatactatgttctgtaggccttcattgtttcctttgttctaaagatttatttatcacctgatccctaacctctaaattagtcatctgtggtcattacttccaagaaaattagtcttatttttttcttctgggtatttggctgaaatgctaatcatagcttcataataagtgcattccattgttttctagaatttccccggaaattgccccgtgcgaagccttgctctgaccccaaccgagttcgtgaaccaggagaagttgagtttgacattgaggtaggattctgccctggatctagtcttctgctcattctggtgatagagacagaagacagattgtcattctagttgggggatatgcagggaggaagacatcctttgcattcatttcctgaataatttatttattattactattattttttgagacagagtctcctcgctctgttgcccaggctggggtacaatggcatgatcatggttcacagcagtcttgacctccggggccagctcagccttctagtagctgggaccacaggctcacaccaccaatgtagctaattctttaaaaaaaatttttttttgtagagatagggtctcgctgtgttgcccaggctggtctcaaactcctgggctcaagcgatcttttgccttggcctcccaaagtgctggaatcacagggtgagccactgcatacagtgaaatatttattaagtgaaagattgtgtgccaagtgctgctgagcatataaatggaagatttcaatttagttgaaataccttaaacatcctttaatacagaatagaatgaaagtcagtgtgggccgggcgtggtggctcacgcctgtaatcccagcactttgggaggctgaggtgggcgtatcatgaggtcaagagatcaagaccatcctggccaatatggtgaaaccctgtctctgctaaaaaattagctgggcgtggtggcacacccctgtagtcccagctacttgggaggctgaggccgaagaatcgcttgaacccaggaggcagaggttgcagcgagccgagatcgtgccactgcactccagcctggcgacagaacgaggctctgtctgaaaacaaaaaataaaaagtcagtgcgatgtagcagaaagagtatgtgatatggagtatctgatgtgaccttacacaaattatttaacttccctgagccttagttttcttatctgtttaaaatgggagtatactacctagctcacaaagatgccttggaaattaagataaaagaatgaatattctgcttagtacttggtctatacttggtgctcagaagatattaatatcaggagtcagatcatcgcccctgtactggggccttaccagaccaatcctgggcagctgaggtgatacactctctctccaacaggaggactatacaacagatgaggacatggtggaaggggttgaaggcaagcttgggaatggtagtggcgctggtggcattcttgatctgctcaaggccagcaggcaggtggggggacctgactatgctgccctcacgtgagtactggcttttatctcccctttccaggctatcagacagcaacccccgctcccgcccaaggtgccaggtcagccaatcagtagatatttatagagctatttaaagggacaaagaattatccagggcatttgggtgaaagaataaagtaggcatgaaaccactcctaaggaacttaagatctgatggcaataagatgtatagacttcaagaggaatcaattttgggcacttaggaagttgggaagaggggctggaagagtcaagcaaggagaattgttacaaaaacaatgaaaggaaagaatgcagcatgcctaaacagggagggaagtgtgccccttttttgccaccttgcctgctgtctgtggagagacaacacaaaaaggactggcttttcgtgaaagcaatctatgatactgtcttgatccttaaacttaattccaaatttttcactttggatgattctcccctttttcctcccactttgatcctcatagctatcatccctcctccctgagtattctgatgaccgatttactctgacagctaaaaacaactctctcagtatttctcctctgttccttgcagcgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatagtaagggcagctaagcacatgggttcaggccagaaggggtctcctcagtcccagtctccatcctagtcccaatagaggacagcttgtagtgaacaaagtcctggtcttaagcctgatacttagtttctctaagccatattttcctaatttgtaaaatgggaatatctcacaggttaatgttaagaatttgagattatgctcacacagatcatctggcacagtttcttgctcatgggaagccttcaaaaaatggtagttataatttgctatcatctatttttactaatgtccaacctttaccgctggtgactctttttttctcttgcctgtttgactgccatcatctgtgtcatttgtgtcctgcgttggccagtttgtcccttgcagagatacataatgacctttcagtgagctttttacatttaagagatgactcctttttttaatccaagattttattgagtaccacagtgtatcaggcactcttgtgtaatacaggtgactgtataatgtaagtgctttttgttttgttttgttttgttttttttgagacagaatctccctcattaacccagggtggagtgcagtggtgccatctcagctcactgccacctccgcctcctgggttcaagcaattctcgtgcctcagcctcccgagtagttgggattacaggcgtgtactatcacgcctggctaatttttgtatttttactagagacaaggttttgtcatgttggctagggtgatctcgaattcctggcctcaagtgatctgcccgcctgccttggcgtcccaaagtgctgggattataggcgtgagccatcgcgcccggccattgttttaatatttcaaaagttatacaaatatggttaatgcttattgaccaaaattagaagaagatggagaaagcaaaaattctttttgactaacactgtttcctctctgaacccaaagataacctttgtcatcattttcatgtataccttttattttgttgtgtttacattcatatgtagacagaagtgtagttttagtgtgtgtggttctgcaacttgcttagttttctttcaatgtcagtgcagagatataccttatcaatacagagatctatctgctgcatagtgttctgtaatatagaaatatatcatatgtttaatcattccctactgattgacatttaagttgttcctaagtttttacttttactaacaatgctgcaatgaaaattcttacagtaaccttttgtacctgtgtgccagttaatatttttctaggggggatagacctgttgagttgaagggtatgtagaagacaaatgttaataaatagtgccaaatttccctccaaaagggccagtacatgatcagtgtatgaaacatacctgtttacccatagtcttaccagcaatggatactatcagcctttttaatttttgccaaccttatggcaaaagatggtgtcttgtttgttttacgtgtttattgactcttctttattccttttctgtgaattttccattcagtctttcacccatttttctgttgggatgttttgtttttcttattgatttgtaagagttccttatatattctagatgtgttggagtattttttgtatattctggatttattgaaaaatatttccttttaggtttgtgtttaattttattatgtctttctagcatgtagatgattttgatttttacattgtcatctttatcaatttttttttttttttttgagacacagtctcactctgtctcccaggctggagtgcagtggcgcaatcatggctcactgcagcctcagacctctgcagtcccacctcaacctccctggtagctgggaccataggtgcataccaccacacccagcttattttttgtacagatggggtttcgccatgttgcccaggctggtctcaaactcctgggctcaagtggtcctcctgccttggtctcccaaagtgctgggattataggcgtgagccactgcatccagccatctttatcagtttttaatagttttttgtattttatgttttgattaagaaggccttcttatattttcccctaaaacttgtataggagttaaaattttagctctttatctggaattaagtttttgtgaattgtgggaggttagaatctaactttatttttttccacatcagtagtcatttcccccagcaccatttattgactaattcatcattatccccctgacttgaagttctacctttgtcataaacgaaattcccatatatatggggatttgttttccactttagtccaagttctgtaccttaatagctatatgaccttggtcaggctagttaacctctctatgcctctctgtgatagtcatacctacctcataggttgttatgagagttaaataaatatacagaaagcacttaaaacattgcccagcacatgataagtaagtactgtgtattagatattattaatattattctgttccataaaatcaacttgtcaaaacaaatttttattttaccaaacagatgctaaaaaagaaaatgaaaatcaacttgtctattcctgtgacaataccatgtaggttagttaccacagactttgtttctggtagagcaaatcccctctgcagaccttgctgtgaacctgaggagaccacagatgctcaccaaggctctcatctttgagctaagctttgatttgttttagggacatgccaggttcccctggccacccactctactgtgagcagtcaaatcacattgacctgcagctaagatgtctggacttgatttaaccgctcctcttagaacagctcactcagcctctcctccctccttcgcctccctactttgcccagcaaccatggaaaggcagcttaccaaggagagacctccctactttttcttatttttccagaatttcgaggctgctgttgagctttttctattccagatggattttagaatcagcttttcaaaggattgcatggtgtttgtggattaatttatggagacctatctttcatcagaggcatttcggctatactgggatttgcgcattcctgaatataacctcatgtcctgaaaatttgtgcactaaaaacaataaggcaggcaaaaagagattagggccacagccctcaaaatctatgtgactttgaagccaaaatacagactcaaataatagcagttctaagttagagcccaatggcatttgtacccggcattatagtcagtggcttctctatggccttaagctctggactcagacttcctctttccaaatctggattcttttgagggcatttggttaaatagataccagcttcatcaaatcaaaatctgatccagggcctagtccctatcaatcttttttggcaaaacaaacaaacaaaaaaaaaacagagggaaatgtctttgcaacttctttatctgctctgtcaggtagcctatcccatcagaactaaattttgtagaaaatagtcaccatttattttttctctggtaggcaaacttgtgtgatttttaatttttgtctgtatgtcttcttatgttgctaaggctttctctgtagttgtgaaaaagtctaccactgattggttgtaaacaactatggaaaattgtttttgaactggtacaacttctgaacagcattgaaatcattgttttgtctttttgttgttgtttgtttgtttgttttgagaccgagtctcactttgtcgcccagggtggaatgaagtggcgtgatctgggctcactgcaatctctgccttcctggttcaaacagttctcctgccttggcctcccaagtagctgggattacaggcacacgccaccacgcctggctaattttttgtgtttttagtagagacagggtttcaccacgttggccaggccggtcttgaactcctgacctcaagtgatccacccgcctcagcctcccagagtgctgggattacaggcgcgagccaccaggcccagccagacatctttctcttatttaccttttgggtatgagcagcagccatcttttgtttctgtcttcaaacatagtctgtctctatttattcaggtcttcttgtatgtatctcttctttggtttatttcttcttcagtttatttctagaaattttattttggttcgtaaaattggcatctttttatgtattacgttttctaattggctattgctaatacggaggacagtagttgattctttcccatatcaatcctgtattggactaccttattatactgttattagttctatttgttttcagtttattgtcttgagttgttgaggtagatgatctgtgtgtcctgtattagtttgatagggctatcataacaaaatatcacagactgggtggcttaaacaacagaaagttatttccttacacttttggcagctgaaagttgaagatcaaggtgctggcagagttggtttttcctgaggtctctctgcttggcttgcagatggccttcgtcttgctgcctcttcatgtggtcatacttctgtgcatatacgcccatgacgtctctctgtatgtcctaatcaccacctcttataagaccaccagtcagattggtttagggcctactctaatggtctcattttaacttaattatttcttaaaaggctctatctctaaatatagttacattctgaatactaggggtaggtcttcaccatatgaattttaggggacaccattcaacccataatatcctcctcctctccagtattcatacctctagcttccagttttattacagtgttgagtcatagtggtgatgggggcatccttgtgctgttttcagactttaaagggaatactgccagtctttctccactcaatatataggtctctgttagactactctcatagagttcaggggagtctctagctatttatttacttatttagacacagtctcgctctatcacccaggctggagtgtagtggcgcaattttggctcaccgtagcctccacctcctgggctcaagtgatccttctacctcagcctcccgagtagctgggactgcaggtgcacgccaccactcctggttaatttttgtgtttttagtggaaacagggttttgccatgttgtccaggctagctttactttaaaagatttttttttgttttaaaatcaagaatcaaattaggttttaccaaataattttggcatatttggacataaatacatagtttttctatgttaatttgttaatacagtgaatgacattaataaaattactaattttgaatcgatattttcttgagattagctgtacttgtacttggttgtggtgtttaacaatagttcatctagtttatttgattgctagtcttttcaaaaactagttttttggctttattgatcatctctagtgtttgatattttattctctttttaatttttctgtattcaacatcttgagttgaaagctctgttgatgtattttcaatctgctttttggtaaagcgttttttaaattttatttttattttatttatttatttttgagacagagtctcgctctgtcacccaggctggggtgcagtggtgcaatctcggctcactgcaacctccgcctccccggttcaagcgattcttctgcctcagcctcctaagtagctgggattacaggtgtacgccaccacgcctggctaattttgtgtatttttagttgagacaggacttcaacatattggccaggctggtctcaaactcctgacctcaggtgatccacccgcctcagcctcccaaagtgctgggattataggcgtgacccactgtgcctggcctgaaattttattttttaaattaacatgaagtaaaattgactctcttggtatacacatgtttatattcttccagccaccataatcaggatacagagccctttgatcactccctaacctcctttgtgttactaccccctttgtagtcatgccttccctctactcccgagcaaccactgatctgctctctgtcactgtggtttttgcctttgccagaatgtcatataaatggaattatgcagtatgtaatattttgagactggtatcttttgcttaccataatgccttttttttttttttttttgagatggagcctcgcactgtcgcctgggctggagggcaatggcgtgatcttggctcactgcaacctctgccttccggattcacgtgaatctcctgcctcagcctcctgagtagctgggattaaaggcgcacaccaccacacctagctaattttttgtatttttagtagagacggggtttcactatgttggccagactggtctcgatctcctgacctcgtgatccgcccgcctcagcctcccaaagtgctgggattacaggcataagccactgcacccggcccaccataatggctttaatattcattcatgttgttgcatatcaaaagcttgttcttttttattgctgagtaatattccattgtatggattatacccattgaaggtcatttcagttgtttccactttggggtgattacaaatagagctgctgtgaacattcaggtataggttcttgtgtgaatatgagttttcatttttctagggtaaatacctaggaatgggattcctgggcggtatgggcagtgggtgttttaactttacaggaaaccactggctgggtgtggtggctcgtgcctgtaatcccagcactttgggaggccaaggcgggcacatcacgaggtcaggagttcgagaccagcctggccaatatggtcaaaccctgtctctactaaaaatacaaaaaatttagccaggtgtggtggcatgtgcctgtagtcccagctactcaggaggctgaggcagaagaattgcttcaacctgggaggtggaggttgcagtgaaccgagattgcatcactgcactccagcctggggggacagagtgagactccatctcaaaaaaaaaaaaaaaaaggccgggcgcagtggctgacgcctgtaatcccagcactttgggaggccgaggtgggtggatcacgaggtcaggagattgagaccatcctggctaacacggtgaaaccccgtctctactaaaaatacaaaaaattagccgggcgtggtgtcgggcgcctgtagtcccagctactcaggaggctgaggcaggagaatggcgtgaacccaggagtcggagcttgcagtgagccgagatcgcaccactgcactccagcccgggcaacagagcgagactctgtctcagaaaaaaaaaaaaaagctactgaactgtttcccagaatggttgttttacatttccactagcaatatgtggaattccagttgctctacatactcatcagcacttggttttgtcaatatagttattttaatcatcctaataagtatgtagtgatatctcatttagtgattcatctaatggctaatgataataaacaactttctgtgtgtttgccattcatatatcctcttttttgaagtgtcattaaacagacattttgaatgcattgttaagatttcttgttaaggatttaactatgaatttttctttttgttttcttttctttgtttttttgagccagtcttgctctgtcacccaggctggagtgcagtggcacgatctcggctcactgcaacctctgcctcctgggttcaagtgattctcatgcctcagcctcctgagtagctgagactataggtgcgtgccaccattccccagctaattttttttttctagtagagatgaggtttcaccatgttggccaggctggtcttgaactcctgaccttaagtaatccacccaccttggcctcccaaagtgctgggattattggcatgagccaccacacccagcctggatttattttctttagtagatatagaattttcaggttatctgtttgattttaggtgagttatttatttattttttatttatttattttttaagactagccaagggcagtagtgaaaagaggggaaagagtttgggtgagtttttatagtttgtatctttcaaggaattggtccatttcatataacttacagaatttatgggcatagagttgtttgtagaattcccctattattctttaaatgtctatggggtctttagtgatatcccccttttcccttctcattcttgatattggtaaattgtttcttctcttttttttttcctttgccattcttgctggcactttgtcttttttttttttttaacttaaaaagtgtttttagggctacaggtgcatgccactggctgtttttttatttttatggagatgggggtctcactgtgttgcatagccttgtgtcaaactcctgacctcaagtgatcatctcttctggacctcccaaagtgctgagattacaagtgtgagccaggccttattgtgtcaatttaatggatcttttcaatatttttggtttcattttctatgttttgtcagttacattccactcttaatgtagttaagattgctgtagttttattttattctttttctaatttcagagatgatcgtttagattatttatttgagacctttttcgtttctttttttgctatttttattctattttattttattttatttttttgagacagagtcttggtctgtcacccaggctggagtgctgtggcgcagtctccgctcgctccaacctccacctcccaggttcaagtggttctcctgcctcagcctcccgagtagctgggattacagtcaggcgccaccatgtccagctaatttttgcatttttaatagaggtgggatttcaccaggctggtctcgagctcctgacctcaagtgatcgccctccttggcctcccgaagtactgggactaaaggtgtgagccaccatgcccagccttttttttttattttggtattttataaagttgatatattaacagcatattgtgtatattttggggttacatgtgatattttgatacatatatgcaatgtgtaatgatgaagttaggcttagtgatatatctatcatcaaacctttatttttgtgtcagaaacattataattctcttctagctgttttgaaatatgcagtaaattattaactgtaatttcttgactgtactattgaatgctagaatttattccttctatctaactgtatttttgtacccattaaccaactatttttcatcccccgcttcctttcccagcctctggtaaccaccattctactctccacctctgtgagatccacttttttagctctcacatatgagtgagaacatgcgatatttgtctgcgtattcctggcttatttcacttaatataatgacctccattttccttcattttactgcaagtgacaggatttcatttgttttaatggctaaataatattccattgtttatatataccacatttcttaattttactcatttgtccattgatggacacttaggttgattccatatcttggctattgtgaatagtattgcagtgaacatgggaatgcagatatctctttgatatactgatgtctttccttttggatatgcccagcagtcaaattgctggatcatatggtagttctatttttactttttcgagacacctccatactgttttctatgatagttgtactaccttatattcccaccaacagtagtatgaatgttcctctttctccaaatgctgaagagtaacaaatcctctccagcttttgttactttttgtcttttggataatagccattctaacttgaggtgagatgatttctcattgcagttttgatttctatttccctgatgatgagtgatattggacattttccccatatacctgttggacattttttttccaacttttaagttctggggtacatgtgcaggatgtgcaggtttgttacataggtaaacgtgtgccatggtggtttactgcacagaccaacctatcacctaggtattaagcccagcatccattagctgttcttccttgtactctccttccccaccactgacaggccctagtatatgttgttccccgcctcccatgtgtccatgtgttctcgtcattcagctcccacttacaagtgagaacatggggtatttagttttctgttcttgtgttagtttgctgagaataacagcttccagctccatccatgtccctgcagtggacgtgatgtcgttcctttttatgactgcatagtattccatgctgtatatgtaccagcttttctttatccagtctatcattgatgggcattttggttgattccatgtccttgctattgggaatactgctgcagtgaacatacgtgtgcacgtatctttataatagaattatttatattcctttgggtatatatccagtaataggattactgggtcaaatggtagttctgcctctagatctttgaggaatcaccatgctgtcttccacaatgcttgaactaatttacactctcaccaacagtgtaaaagcgttcctttttctctgcaacctcaccagcatctgttgttttttgagtttttaattgccatcctgctggtgtgagatagtgtctcattgtggttttgatttgcatttctctaatgaacagtgatgttgagctttttttcatatgatggccgcatgaatgtcttcttctttttttttttgagacggagtctcgctctgtcgcccaggctggagtgcagtggcacaatctcgactcactgcaagctccgcctcccgggttcatgccattcttctgcctcagcctcccgagtagctgggactgggactacaggcgcctgccaccacgcccagctaatttttttgtatttttagtagagactgggtttcaccatgttagccaggatggtctccatctcctgacctcgtgatccgcccgcctcagccccccaaagtgctgagattacaggtgtgagccaccgcgcccggctgaatgtcttctttttagtggggttgttttcttataaatttgtttaagttcctcttagactctggatattatacctttgccagatggatatattgcaaaaattttctcccattctgtaggttgtctgttcactctgattatagtttcttttgatgtgcagaagctctttaatttaattagatcccatttgtcaatttttacttttgttgcaattgcttttggcatttttgtcataaaatctttgcctgtgcctatgtcctgaatggtattgcctagattttcttctagggtttttatagtttggggttttacatttaggtccttcattcatcttgcgttaattcttgtatatggtataaggaagggatccagttttaattttctgcatatggctacctggttctccccagcaccacttattaaatagagaatcctttctctattgcttgtttttgtcaggtttgtcgaagattagatgtgtgtaggtgtgtggtctaacttctgggttctctattctgttcattggtctatgtgtctgtctttgtaccagttgcatgctgttttggttactgtagccttgtggtatgaagtcgggtagcgtgatgcctccagctttaattctttttgcttcggattgtcctggctatttgggctcttttttcattcaatgtgaattttcaagtagtttcttctaattctgtgaagaatgtcaatagtggtttaatgggaatagcattgaatctgtaaattactttgggcagcatggccattttcacgatattgattctttctgtccaggagcatggaatatttttccacttgttggtgtcctctctcatttccttgagcagtggtttgtagttctcctcgaagaggtccttcgtttcccttgttatgtgtattcataggtattacattctttctgtagcaattgtgaatgggagttcattcatgatatggctctctgcttgtctgttgttggtgtaaagaaatgcttgtgatttttgcacattgattttgtatcctgagactttgctgaagttgcttatcagctgaagaagcttttgggctgaggtgatggggttttctatatataggatcatgtcatctgaaaacaaagataatgttacttcctctctccctgtttgaataccctttatttctttctcttgcctggttgccatggccagaacttccaatgctatgttgaataggagtggcgagagagggcattcttgtcttgtgccagttttcaaggggaatgcttccatcttttgcccatttagtatgatactggctgtgggtttttcatatatggctcttattattttgaggtatgttccttcagtacctagataattgagagtttttaacatgaagggatgttgaattttatcaaaggtattttctgcatctattgagataatcatgtttttgactttagttctgtttatgtgatgaattacgtttattgatttgcatatgttgaaccaactttgcatcccagggatgaagccaacctgatggtggcggataagcttttagatgtgctgctggattcagtttgctcatattttattgaggatttttgcatcagtgttcatcagggatgttggcttgaagttttctttttctttttttttttttttttttttttgagacagcgtcttgccctgtcaccaggctgaagtgcagtgacgtgatctctgctcactgcaacctctgcctcctgggttcaagtgattctcctgcctcagcctctcgagtagctggaactacagatgcgtaccactatgcccagctaatttttctatttttagtagagacggggtttcaccatgttggccaggatggtcttgatctcttgacctcgtggtctgcctgcctcggcctcccaaagtgctgggattacaggcgtgagccaccgcagccggccgaagttttctttttttgttgtatctctgccaggttttggtatcaggatgatgctggcctcataaaatgagttagggaggagtcccttcttttcaattttttggaatagtttcagtagaaatggtaccagctcttctttgtacctgtagtggaattcagctataaatctctctggtcctgggctttttttggttggtaggctatttattactgcctcaatttctgaactcattattggtctattcagggattcagttccttcctagttcattcttcggagggtgtatgtgtccaagaattcatccatttcttccagattttctagtttatgtgcatagaggtatttatagtattctctgatggttgtttgtatttctgtggagtcagtggtgatatctcccttatcatttctggttgtgtctgtttgattttctctcttttgttcttcattagtctagctaatggtctatctattttattaattttttcaaaaaagaagctcctgaatttgttgattttttgtttttttgaagggtttttcgtgtctctgtctccttccgttcagctctgatcttggttatttcttgtcttctgctagctttgggatttgtttgctcttggttctctagttcttttagttgtgaattttgagatctttctagcttcttgatgtgggcatttagtgctataaatttccttcttaacactggtttagctgcatcccagagattctcatacattgtctctttgttctcattagtttcaaagaacttcttgatttctgccttaatttcattatttacccaggagtcattcaggagcaggttgttcagtttccatgtagttgtgtggttttgagtgaatttcttagttttgagttctaattttattgtgctgtggtctgagagactgttatgatttcagttcttttgcatttgctgaggagtgttttacctccgattatgtgatcaattttaaagtgccatgtggtgatgagaagaatgtatattttgttttttgggtggagggttctgtagatatctatcaggtccacttgatccagagctgagttcaggttctgaatatctttgttaattttctgtctagatggtctgtctaatatcgtcagtggggtattaaagtctcccactatttttgtgtgggagtctacgtttctttgtaggtctctacgaacttgctttacgaatctgggtgctcctatattgggtacatatatatttaggatagttaggtcttcttgtggaattgaaccctttatcattatgtaatgcccttctttgtcatttttgatctttgttgatttaaagtctgttttgtcagaaactaggattgtgacccctgctgttttctgtttttcatttgcttggtaaatttccctccatcccttcgttttgagcttatgtgtgtctgcacttaagatgggtctcctgaagacagcatactgatgggtcttgactctatccagcttgccattctatgtcttttaattggggcatatttagcccatttacatttaaggttaatattgttacgtgtgaatttaatcctgtcatcatgatggtagctggttattttgtagacttgtttatatggttgcttcatagtgtcactggtctgtatacttcagtgtgtttttactaaagtacttcctttaggagctcctgttggccatttctatgtctttttttgagaaatgtctgttctggtattttgcccatttttaaattggattatttgttttttgctattgagttccttatatattttagttattaatcctaatcccttgtcagatggatagtttgcagatattttctcccattctgtgggttgtctctgcactttgttgattgtttcctttgctgtacagaagctttttggcttaatgtaattatatttgtgtattcttgcatttgttgcctgtgcttttgagttcttactccaaaacaatctttgcccagaccaatgtcctatagcatttccccagtattttcttgtagtagtttcatagtttcaggtcttacatttaagtcttttaatccattttcaattgatttttttgtatatggcaagagataaaggtctagtttcattcttttgcatatgggtattcggttttcctgacaccatttattaaagagactgttctttccccagtgaatgttcttggtgccttcgtggaaagtgagtgggctataagtgggtggatttatttctggattctctatgctgttctgttggcccatgtatctgttttaatgccagtaccatgctgttttggttactgtagctttgtaatataatttgaaatcaggtagtatgaggcttccagctttgttcttactgctcagtattgctttagttatttggcatcttttgcagttttatgtgaattttaggattgctttttctatttctgtgaagaatgtcattggtattttgttagggattgcatggaatctatagatcgtttttgggtagtatagacattttagcaatattagttcttccaatacatgtgcatatgctatctttccattttttgtgtgtccccttcaatttttttcatcagtgttttgtagttttccttgtagagatcttgcaattatttggttaaatttattcccaggtattttaagttttttgtagctattgtaaaggggattgctttttttagttttttttttagatcattcactgttagcacatgtaaatgctactgatttttgtatgttgattttgtatcctgcaactttactgaggtgttttttttgttgttgttgtttttgagacagagtctcgttctgtcacccaggctggagttcagtggcatgatctcagctcactgcaacctttgtcccccggattcaagtggtcctttcacctcagccacccaagtagctgggactacaggtgcccaccaccacacccagctaatttttgcatttttagtagagatgagggtttaccatgttgcccaggttggtctcaaactcctgagctcaagctatctgcccgtctcagcctcccaaagtgctgggattacaggcatgagccactgcacccagccatctttactaaatttgtttatcagttcttttatttttattttttgagatggagtcttgctctgtcacctaggctggagtgcagtggcgcaatcttggctcactgcaacctccgcctcctgggttcaagcgattctcctgcctcagcctccaagtaaccgggattacagatgcccgccatcacgcccagctaattttttgtatttttagtagagatggggtttcaccatattggccagactgatctcgaactcctgacctcaggtgatctgcccaccttggccttccaaagtgctgggattacaggcgtgagccaccgtgcccggcgaggcctgtagttttaattgttgtatttttttctggttttggtatcaggataatgctggcctcatagaatgagttttgtggaagtattccctcctcttcagttttttgagttaaggtagaattgttgttttaatgtttggtagaattcagcagtgaatccatcaggttctgggcatttatttgatgggagacttcttattactgcttcagtctcattacttcttgtctgttcaggttttctgtttcttcatggttcaagcatggtaggttatatgtgtccaagaatttatccatttcttcccagtttccaatttgttggtgtatagttgttcatagtagtctctacctttgtatttctgtgatatcagttgtaatgattcctttctcatgagatatttttaatttctaatgtaaacatttagtactttaaattttcctctaagcagagctttctttgcgtcccccaagttttatgttgcaatttcactttttttttttttttaatttttatttttattgatcattcttgggtgtttctcacagagagggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcactgcccttaatccatttaaccctgagtggacacagcacatgtttcagagagcacagggttggggggtaaggtcacagatcaacaggatcccaaggcagaagaatttttcttagtacagaacaaaatgaaaagtctcccatgtctacttctttccacacagacatggcaaccatccgatttctcaatcttttccccacctttccccgctttctattccacaaaaccaccattgtcatcatggcccgttctcaatgagctgttgggcacacctcccagatggggtggtggccgggcagaggggctcctcacttcccagtaggggcggccgggcagaggcgcccctcacctcccggacggggcggctggctgggcggagggctgacccccccacctccctcccggatgaggtggctggccgggcagaggggctcctcacttcccagtaggggcagccgggcagaggcgcccctcacctcccggacggggcggctggccgggcggggggctgaccccccacctccctcccggacggggcggctggccgggcggggggctgacccccccacctccctcccggacggggcggctggccgggcagggggctgacccccccacctccctcccggacggggcggctggccgggcagaggggctcctcacttcccagtaggggcggccgggcagaggcgcccctcacctcccggacggggcggctggccgggcggggggctgaccccccacctccctcccggatggggcagctgccaggcagagacgctcctcacttcccagacggggtggctgccgggcggaggggctcctcacttctcagacggggcagctgccgggcggagggtctcctcacttctcagatggggcggttgccaggcggagggtctcctcccttcccagatggggcggctgggcagagacgctcctcacctcccagacggggtcgcgaccgggcagaggcgctcctcacatcccagacggggcggcggggcaaaggcactccccacatctcagacgatgggcggccgggcagagacgctcctcacttcctagatgggatggcggccgggaagaggcgctcctcacttcctagatgggatggcagccgggcagagacgctcctcactttccagactgggcagccaggcagaggggctcctcacatcccagacgatgggtggccaggcagagacgctcctcacttcctagacggagtggcggccgggcagtggctgcactctgggcactttgggaggccaaggcaggcggctgggaggtggaggttgtagcgagccgagatcacgccactgcactccagcctgggcaccattgagcactgagtgaaccagacaccgtctgcaatcctggcacctccggaggccgaggctggcggatcactcgcggttaggagctggaggccagcccggccaacacagcgaaacccagtctccaccaaaaaaatacgaaaaccagtcaggcgtggcggcacgcgcctgcagtcgcaggcactcggcaggctgaggcaggagaatcaggcagggaggttgcagtgagccgagatggcagcagtacagtccagcttcagctcggcatcagagggagaccgtggaaagagagggagagggagaccgtggggagagggagaggagggagagggagagggagagggacaatttcacttttattaatggaaatattttctgttttcctgtgggatctcctctttgacccatgtttatttaaaagtatgtttaatttttatgtgttagaggtattccagttatctttctattgctgctttttgttctttttgttaagacatcattcttctggtttccttttgttctttgtcagtggtttccttttgctctttcagcctagttgatttagtctttgtatggtaaatacaatgtcagagcttccttagggacagtttttgtcagtttctctttttttttcccccgtaaatgggccatacttcccttttcgttgcatgcctcatggttttttttgttggaaactggaaattttgaatattataatgtggtttactctggaagtcaaattttccttcctcagtttgcttttgttgcttgttatgaactgcagtcatctattatttagtgacttttcccaactactttttacaaagattgtattccttattgtgcagttactgagtctccattccttagcctcattagtaagctgagactttctgatagagatttcctgacaactttgtttgtttggaaggcaggagtacagtggcacaatcttggctcactgcagcctccacctcccgggttcaagcaagtctcgtgcctcagcctcccgagtagctaggattacaggcatgtgctaccacgcgtggctaatttttgtatttttagtagagacagggttttgccatgttggcgaggctggtcttgaactcctgacctcaagtgatccgcctgcatctggagtttcttaaagacatgatttagcagcctttttctttgttaatcaccccttgttgttgtgagatttttattggactccagagttccataaaagttgttctgacagtttttgccaggttgatggttgtttcagtggagggacagatcattttagctccctattactccattatcagtggtgtcactcctccttccctgcaccctcttcgtgtgtgtgtgcgtgcgtgtgtgtgtgtgcacacgtgcacgtgcatgttctttttttttggtaaaaaacacataccattaaatttatcatcttttttccattatttacctttaagctccgttagacttgacaaatttaccatcttaatcattttaaagtgtatagttcagtactattaagtatattcacattgttgtgcaacagatctctataactttttcatcttgcaacacttaaactgtatacccctaaacactaattcctccctctagccattggtcatcaccttctactttctttcttttcttttttttttttttttttttgaggcagagtttttgctcttgttgcccaggctggagtgcagtggcacgatcttggctcactgcaacctccgcctccaaggttcaagtgattctcctgcgtcagcctcctgagtagctgggattacaggtgcgcgccaccacgcccagctacttttttgtatttttaatagagacagagtttcgttatgttggccaggctggtctcgaactcatgacctcaggtgatccacctgcctcagcctcccagagtgcagggattacaggcatgagccactgcgcccgacctctactttctatttctatgattttgacacctttaggtactttgtaagagtggaattgtatagcatttgttctggcctttttttcttagcataatatcttccatgttcatccatgttgtagtatgtgatagctttcctttttttaaggctgcataataactgctgtgtgtacctaccatactttcttttatttttcctttttttaaattatacgtttctgggatacatgtgcagaacgtgcaggtttgttacataggtatacatgtgccatagtggtttgctgcacccatcaacccgtcatctacattaggtatttctcctaaagctatccctcccctagcccccttccccctcacaggccccagtgtgtgatgtttccctccctgttttcatgtgttctcattgttcaactctcacttatgaatgagaatatgcggtgtttggttttctgtcctgtgttagtttgctgagaatgatggtttccaacttcatccatgtccctgcaaaggacacgaactcatcctttttatggctgcaaagtattccatggtatatgtgtgccacattttctctatccagtctatcagtgatgggcatttgggttggttccaagtctttgctattgtgtacagtgctgcaataaacatacgtgtgcatgtgtctttctagtagaatgatttataatcctctgggtatatacccagtaatgggattgctgggtcaaatggtatttctcgttctagatccctgaggaatcgccacactgtcttccacagtggttgaactaatttacactcccaccaacagtgtaaaagcattcctatttctccacatcctctccagcatctgttgtttcctgactttttaatgatcaccattctaactggcttgagatggtatctcattgtggtttcgatttgcatttctctaatgaccagtgatgatgagtattttttcatatgtttgttggctggataaatgtcttcttttgagaagtgtctgttcatatccttcacccactttttgatgggattgtttgtttttttcagcccaggtgatctttttgttccctttgtgtgcattaagtatgtactgtttatttcttcattcacttagtaaacagttactgagaacttgtgcttcagtgtgctagtaggctcccttaatttgaaataaataatacatattcctgcccttatggtaaattggaggcaacagatttgctaatcagctcttaaataccatataacagcttcagtagagggatgcacaggaagctatggagagccaagtaggaggcatctcaatcatgattaggagagggagggaagagttcttgtggaaagtaaatctaaagctgaattttgaagggtgagtaagtaaagtaactcatgaagttattcactaaatggatgttgggtgaatgaatcagaattaggtgaatctaggagaaggacatttgctgcaaggatgcaaagtagaagggcatgaaatgtatgtggtacattcagagactcttggagttgagtatggattaagtaaaaggtacatttgtaggggaagggcaggagctggagtaggtgtcattctatcttcaccctttggatgaaatctcattttaccctgttttcccttctccctgcagtctatccttcactggagtctgatgatgatgaccctgctttgaaatctcgacccaagaaaaagaagaattcagatgatgctccatggagtcctaaaggtaatctagtattttgtcccttaaactctgtaggggtggtcaggaggaaatagacaaggtaggtgggatatttaatatcagaagacctgattcagtcactcatttgtttattcagcaaacatttgttgagtgtctgctgtgtgtcaggcactgtgttaggttctggagctaaaatgactaataagacacagagtttatgtaattagtccaataaaatcagaggtaatggagcatattgcatttgatattatatggtttgaggtgaaaggaagaccttgaacagattttagcaagcagtctgaggcttctgagaacgttctgataccatcatcccagtactctggtagttttgttgtcaaggagggaaattctgctgactgttgagctctataaggcccaagattatcacctatactgagaggccatctctgaggagggaagaatgaccactgagttgaacatggagtttagaggataatggaagaattttcttcgtctccttggctggatagtattcacactgaggatgcatccttcagttagtttttgctgcttaacagtctgcccaaaacttagtggcttaaaataacagttaataatttttcataattctgtaggttggctgagctgttcttctagtctaggccagattccctggggctgaatggtctcaaaagttctccttcaggtgtctcagacctactatctaagtcctactaagacctactatctaagatggccaaggcttctctctacatggtctttagtctaccaagcttttccacaaggtggcagaaaggtttctagcagcaagagaggacaagccccaatgtgcaagcacttttcaagcctttgcttaagtcatatttactgttgtcccattgactaaaacaagttacgtggccaagccttgatcccatggttgggaaatagattgcaccttttgagaggagaactgcaaagtcacatcgcaaagtatcatgcatacgaggatacatgagcacactgaaggccattactgcaacagtctgccatagaggtcattgggatttcagtacctgtggttccccagcagataaagggcttgctcttctcaccctgccttatttagactttttggtgtttgcttgaggtcgagggggtgacataggggtagcagggcattcctcagaagtgttatgttagtgagttaatcagtaaatgtttctttttaaaaaaaaattggggccgggcctggtggctcacacctgtaatcccagcactttgggaggccaaggcgggcagaacacctgaggtcaggaccagcctgaccgacatggtgaaacgtcgtttctactaaaaatagaaaatcagccgggaatggtggcgggcgcctataatcccagctagttgggaggctgaggtaggaaaattgcttgaacccaggaggccaaggttgcagtgagctgagattgcaccattgcactccagcctgggcaacaagtgggaaactccgtctcggggaaaaaaaaaaaaatttggctaggtgcagtgtggctcatgcctttaatcccaacattttgggaggctgaggcgggtggatcacttgaggtcaggagtttgagaccagcctggccaacatggtaaaaccccatctctactaaaaatacaaaaatcagctgcatgtggtggcatgtgcgtttagtcccagctactcgagaggctgaggcacgagaattgcttgaacctcggaaagcggaggttgcactgagccgagaccatgccactgcactccagcctgggcaacagagcgagactccatctcaaaaaaaaaaagaaaacttaggcctatttttaaattttattttcttctatcatttccaggtttatttttcctgtcaaagtaaatttttctggttagcacagtagaaaatttagaaaatattgaaaataaagggaattatgaagaaggaaccacccacgagtccgccacccagaagcaaccaatgttaacattttgacatgtttctttatagtcttttccctatacattttttaatttttattgtttaaatcacatgtgtgtacaattttttaaatttttttttaaattttttttaaatggagtctagctctgtcccaggctagagtgcagtggcgggatcttggctcactgcaatctccgcctcccgggttcaagctattctcttgcctcagcctcccaagtagctgggattacaggcaggtgccaccatgcctgactaattttttgtatttttagtagagatggggtttcaccatgttggccaggctggtcttgaactcctgacctcatgatctgcccgcttcagcctcccaaagtgctggaattacaggtatgagccaccacgcctggccacatgtatacaattatgcactgtactttaaaattttgtttgagcttttgatcaaagtagtgggtgtagcatatcaaaaagtatagagaaattaggccaggtgcggtggctcacgcctgtaatcccagcactttgggaggccgaggcgggtggatcacaaggtcaggagatcgagaccatcctggctaacacggtgaaaccccgtctctactaaagatacaaaaacttagccgggcgtggtggcaggcgcctgtagtcccagctactcgggaggctgaggcaggagaatggcatgaacctgagaggtggagcttgcagtgagccgagatcgcgccactacactccagcctgggtgacagagcgagactctgtctctcacacacacacaaaaaagtatagaaaaatttaggaggaaaagcaatgttcttctgcccctactttccccacctgcaatcccgttcccaagagacaacctcatagttttcgtttcctggtagatgcctccaaaactcaagagaagtatgccaccctttcttggtttatgaagtctatttctcctttaatcaacttacatcattcccttttttttttttttttttttttttgaggcagaaactcgctctgtggcccaggctggagtgcagtggtgcaatcttggctcactgcaacctccgcctcctggattcaaacgattctcatacctcagcctccaaagtagctgggactataggcgcgcatcactgcacccagctaatttttttgtatttttagtagagatggggttttgccatgttagctaggctggtctcgaactcctgacctcaagtgatccatctgcctcggcctcccagagtgctgtgattacaggccgtcaatctctcttgattacctactttgtaagatacagttgttggtgaccctacatccatagggtccttttgtaaccttctgtgaaccattttttcccttgtgggaagtaaatctaaagctgaattttgaagggtgagttagtaaagtaactcatgaagttattcaccacactaaatggatgttgtgtgaatgaatcagaattaggtgaatctagaaggacatttgccgcaaggatgcaaagtagaagggcatgaaattgtatgtggtacattcagagactcttggagttgagtatggattaagtaaaaggtacatttataggggaggggtacattcccttttgtaaccttctgtgaaccataattttttgtttatgctgtcaagtttattaacatatacattgttgttactactctacattgactagaaattaactgtaaatatcgaaaaccaatagagacatctggtcttttaagttaatattatatcataagcatgttcctatgccattgtttataaataatatttttaatggctacaagatatcagttccatggatatacctaatatatatgtaatttctaacatataggctattttcaagtttttacaattagtacatttggagtcaatatctttatatgtaaatgtttatatctctgattatttactcaggatggatcaccatgaaaccttagaggggccaaagtatgtgaggttatacaatgaaaagtttccttcccagccctgttagtagccttctacttacccacctggagtcaactagtgttatcagcttttttttttttttttttttttttttgagagggagtcttgctctgtcgcccaggctggagtgcagtggcgcgatctctgctcactgcaagctccgcctcctgggttcacgccattctcctgcctcagcctcccgagtagctgggactacaggcacccgccaccatgctaattttttgtacttttagtagagatggggtttcaccgtgttagccaggatggtctcgatctcctgacctcgtgatccgcccgcctcggcctcccaaagtgctgggattacaggcatgagccactacgcccggccatcagttttttcatttatcttctcagagacagtttgcacatatacaagcaaatgcatgtatatgttttcctacctccccctccttttttttttaactcagttggaaacgtattttatacgctgttatgtgctttgcttttctctcttaagaatacatctgggccaggcacggtggctcacgcctgtaatcccaacactttgggaggccagggtgagcggatcacgaggtcaggagatccagaccatcctggccaacatgatgaaaccccgtctctactaaaaatacaaaaattagctgggcatggtggcgcacgcctgtagtcccatctactcaggaggctgaggcaggagaatcgcttgaacccgggaggtggcggttgcagtgagccgagattttgccactgcactccagcctgggcgacagagcaagacttcatctcaaaaaaaaaaaaaaaatagttcttgatacttattgcagaagtgttttccagaaaagttgtaccaatttacacttccatccgcagtgcttgtttatgaaatgtatgcaggcattgaacacaccagttaggagtagtatttgattatgagtaatgtctcaagcatccttagtgagtgcttgttctctcagagtcacaagatggctacttcacctccagcattggggtctgggctgcagtcaggaagaaggagaaaagcaaaaggaaaaagggacaggcatgctgagtgctgagcattccctctccccaaggagttttaagttccacgttttttacacatctatttggctgaaattgtgtcagatggccaagactatcagccagagatgctaggagatacagtttttatctaggcatattgctgtcccacaaaatcagtgtttttgttagtaagcaggaaagagaatgacatttggttgagaatgagtagtctctaccatgagggtttttttgtttgtttgtttgtttgttttttatttattttgaaacagtctcggtctgtcgcccaggctggagtgcaatggcatgatcttggctcactgcaacctctgcctcccgggttcaagcaattctcctgcctcagcctcccaagtagctgggattacaggcacctgccaccacactcagctaattttttttgttgtttgttttttgagacagagtcgttctgtcaccagactggagtgcagtggcgagatcccggcccactgcaacctccgcctcctgggttaaagcaattctgcttcagcctcctgagtagctgggactacaggcacgcaccaccgcacccagctaattttttttttttttttgtatttttagtagagacggcatttcaccatgttggccaagatggtctcgatcccttgtccttgtgatccgcccatgtcagcctcccaaagtgctgggattacaggcatgagccaccgcgcctggccagttttttgtatttttagtagagacagggtttcgccatgttggccaggttggtctcgaactcctgacctcaggtgatccacctcggcctcccaaaatgttgggattacaggtgtgagccaccacatccggcttctaccatgaatttttgatccttggtaattcataagcaaacaacagtatctcattgatttaatttacatttttttgattaagcatagcctctatgttttattagcatcagagtttcttccattgtaaattttgtttacatcctttgcccacttatccatgtggttcttcaaggttttcgagttgcccattttatatagtaagggaatagtcatcctttgtttcatacacacacacacacacacacacacacacacacgcacatattttatacttataatgtgcttgtacttcttcctcattctacaggaaaatttgaatatttcagtatcaagtgttgatcatttgtttgcatattcagagagtagataattaacacccttgtattttttaagcataatttttaaatatctaatgtgttgatctacaaagaattgcttaatatatggtactgagcagaagatataaattggtattccccccaaaaagatgactgttggtgctagaatcacattcccactaagctgaaaatgctttctttgccatgtgtactgactcatacgtatcatgggttgtttgaggcacatccattttgtaccatcaaagttctgtctgctcttgtgctggtatttcacttattcactacctatttatgacttagaaaaaccacagacttttttattttgaggcagagtctcactctgttgcccaggctggagtgtagtagcatgatctctgctcactacaacctccgcctcccaggttcaagcgattctgctgcctcagcctcccaagaagctgggattaaaagcacccgccaccaccatgcctggctaatttttgtatttttagtagagatgggattttaccatgttggctaggctggtctcaaactcctgacctcaagtgattagcccgcctcagcctcccaaagtgctgagaattacaggtgtgagctaccacgcccagccaaaaaactgcaaacttttaaaaagtggcttttagttaactaaaaagatagttctttaaaatgaagaagaacaccaagtttaacccaataggatgaaactgtagagcacagatgcatcaactggtgttcatggacctttgaatctcctattaatattctattgaaattttatgtaaatgcatgcatctatgtatgtatatttctttagtaatttttatcacattttcaaagtgagttcttaactcaaaagatgcattctactaaggcattctactaaggggattcccattaagatcaggaataagactaatgtgcccactaacactgctattatttagtattgttctagaagttcatgccagtgtaattagaagtaaagcagaaattaaaaaaaaaaaaaaaaaaaagaaaagaagagaccaaatcatgatgtgagccagtagggtgagaatcctgttcacttttggccatcattgtatctgtagcactttgcctagtgcctggcctgtaggagatgtttaacaaatatttgatgagtgaaagataagatataattgtataatcgatatagaaaacacaggtatggggctgagcatggtggttaatgcctgtaatcctagcactttggaaaggtaagatgggaggattgtttgagcctaggagttcaagaccagcctgggccacatagtaagaccctgtctctacaaaaaatagaaataaaaatagagatatgatataattatgtaatatcagaaaatgaaagagaatcaactaaaaactgctaatactgataagagaattcagtaaattgggtaaatcattggatatataccagctatccaaaaatcaagaagtactatattagtaataaccataatgtactgagaaaaagaaatgctattgacaatagcaacaaacatataaaatatgcaagaataattgtaagaagatagtgtggaaccgacatgaagaaatagagatttcccatatgcctggttataaagactgagtgttgtaaagagtcatttccttccaaattaatgtatacatttaacactagcctaaatcaaaatcctaatggaattttgtggggaattcattctaaaagtaatttaaaaagtaaacaggtataattagcttaaagaatattgggatagagaaagtaaatgaaatatactatagtgctacagtaatcataagcaccagaacagtcggtaaatacttttccttttaaaaaatttttgttatgaaagttttcaaacataagataaaattcaagaggttattaccatgaacacctatatatatatatatatatatatctgtcacccagatttaatgaacattttgctgtatttgctttattctttttttcaaggcattttaagcaaaatcttacgtgttacgacatctctagttttttgctgattttttcttttctttttttttttttttttttttttttgagacagagtcttgctctgtcacccaggctggagtgcagtggcatgatcttggctcactgcaagctccgcctcctgggttcacgtcattctcctgcctcagcctccccagtagctgggactacaggcacctgccaccacacccagctaattttttgtattttttagtagagatggggtttcaccatgttagccaggattgtctcgatctcctgaccttgtgatccgcctaccttggcctcccaaagtgctgggattacaggcgtgagccaccacacctgtccgttttttgctgattttctaattgctctatccattattgaaaatgtggtattgaagtctccagctattattattgaatttatctattttctcccatcagtttggtcagttttcacttcatctattttgagcctctgttgtaaggtacacatatgtttgtaattgttataccttgttgatggattgacctttttatcattataaaatgctcttctttgtctttagtaatgatttttgtctcaaagtctgatgttagtatagccattgtagttttcatttgagtaccacttttattgttatctcttttttcatccatttattttcgacctgtgtcttcaaatctaaactgtgtgtcttgtatagatagcatatagtagggtcatttttaattcattctgccaacatctgcctatcagttggagggttctaatagctgccaaagttcgactcaatatccattttgctatttgttttctatgtgtcttattttttgttcctcaattcctccattagttactgccttcttttatgtttaatagctattttctaggaccccccccgcttttttttttttttgagacagagtgtcactctgtcacccaggctgaaatgcagcaacgcgatcttggctcactgcaatctctgcctcctgggttcaagcaattcttttcctgcctcagcctcctgagtagctgggattacaggtgcctgccatcacgcctagctaatttttatatttttagtagagttggggtttcaccgtgttggccaggctggtctcgaactcctgtcctcaggtgatccacccatcttggcctcccaaagtgctggaattacaggcatgagccaccgtgcccagccctaggatcccattttaattccttttttttttatctctctatatgtgaggggtttttttttgttgttgttttgtttttttttttttgagatggagtcttactctgttgcctaggctggagtgcagtggcacaatcgcgactcactgcaacctccacctcccgggttcaagcaatactcccgcctcagcctcctaagtagctgggaatacaggcacacaccaccaagcctgggtgatttttgtgtgtttagtggagacggggtttcaccatgttggccaaactggtctcaaactcctgacctcaggtgatcggccgcctcagcctcccaaagtgctgagattacaggcgcgagccaccgcacctggccaagttattttcttagtggttgtcctggggattaacaacttaatttataccattctaattcacattattatcacttaatttctttctttcttttttttttttttttgaggcagagtctcgctgtgtcgcccagattggagtgcagtggcaccatctcggctcggctcactgcaagctctgcctcccgggttcacgccattctcctgtctcagcctcccgagtagttgggactacaggcgcctgccaccacacccggctaattttctgtatttttagtagagacgaggtttcaccgtgttagccaggatggtgtccatctcctgacctcatgatccgcccgcctcagcctcccaaagtgctgggattacaggcgtgagccaccgcgcccagcctattatcacttaatttcagtactacacagaaactttgctgctatatagctccattacccttctcttttatgctattactgtcacaaattacatctttatacattgtgttcatgaacacagggttatagtaattgctttatgtaattgtctgttaatccagttagaaaaagttacaaaaatatgttgataatgtcttttaaatatacctatctagttacctttaccagtgctctttatttcttcatgtagactcaattgtctagtgtcctttcatttcagcctgaaggtttccctttaacatgccttttttttttttttgagacagagtctcgcactgtcgcctgggctggagtgcaatggcatgatttcagctcattataacctctgcctcccgggttcaagcaattctcctgcctcagcctaccaagtagctgggattacaggtgcctgccaccacgcctggctaattttttgtatttttagtagagacgggtttcactatgttggccaggctggtctcgaactcttgacctcgtaatctgcccgcttcggcctcccaaagtgctgggattacaggcatgagccaccacacctggccctttagcatttcttataggtaaggtctactagtgtcaaactatttgtttttatttatctaggaatatcttgatttcttcatttttgaaggatagttttgctggatctggaattcctgattgatagtttttcttttagcacttagaatatgtcttcgcactgtcttctaacctccatgggttctgatgataaagaaatcactttatgttgtgagtcacttctgccttgctgctttcaaaattctgttgtcgttggccgggcacagtggctcaagcctataatcccagcactttgggaggccgaggcgggcggatcacgaggtcaggagatcaagaccatcctggctaacacgatgaaaccctgtctctactaaaaatagaaaaaaaattagccgggcgtggtggcgggcacctgtagtcccagctactcaggaggctgaggcaggagaatggcgttaaccctggcggcagagcttgcaatgagccgagattgcaccactgcactccagcctgggtaatggagcaagactccgtctaaaaaaaaaaaaatttctgttgtctttggtttgagttatgatgtgtagccttttaaatttgttcagcttggagttcgttgagctcttgaatgtataaattgtttttcatcaaatttggaaagtttttagttgttatttcttcgaataggtgtccttcagatccctttggctctgttcacttttcttcattctctttttatgtgtgctcatcagactggataatctcaattgacttatcttcaaagtcagtaattcttccttctacctgctcaaatgtgctattgaaaccctctagggaagtttgcatttcagttaaagtttgcatttcagttattttacttttcaacttcaaaataactgtttggtttctttttataatttctgtctctattggtattctctgtttggtgagacatcatactcatactttcctgtagttccttagacatggtctcctttagcctttgaaagcatttaaaatagctgatttaaagtccttgtctagtaactccaactatgtctaggaagtcagggacagtttccactgattgattttttttcttgtgaatggctatactttatttctttgtatgtcttgtaattttttgttgaaaactgtacattttaaatgccgtggcaactctgaaaatcagattttctccactctgctcctcagagaacactctttgttgtagttgtgttttgtttagtggcttttctgaactaattctgtaaagtctgtaaacttttttgtgtgtgcacactgatgtctctactcatttagcttagtagatgtctcatgattggacacagatttcctgaaatgcctggaaccagtgagtgctcccagtgcttgctgaggggctctctatgtgcatgttggagcatgccttcactcagccaggcagtttacaactctgcggtagccttcacttctatttgtgtagcacctcaaagtcagacagaggtgcatgcttagggccttctcaagtcttacagcgccaacacaggcatgtggtcttataatttgcagaaatgcgtgagaacttgtcaaattctttatggatatctcattctttagcttttttttaaccatttgggttaatctattgtttgtcacaactgttatccatcaccttaaacagctatgacattaagcacatgcctttaaaattcttttttaaacacccatcagggagggagaggcttttagtactaggctttgaaagaaagctctagctcctttctgctcactacattgctgggaacttggactgctgtttttcaaggtgttcactaagctggggtaaggtagatgtgtctagggcaagttaaaatgcacaaagctcattgttcttactgagattcagctgtttttcttgaatcaagtgctttccaggttgctgcaagccttttgttaatttccagagttctgaaaaaatttatcctgacaatttttgctagtttttttgttgtttttattggggagtgaattcttggaggtcctttgccatgtttactgatgtcgcccatcataacatctcatccttaatacttaaatatgcattgaatgatattttcttccataaccacggtgccattatatgacacctaagcaaagtaacatttatttcttttttttttttttttttttttttgagacggagtcttgctctgtcacccaggctggagtgcagtggtgcgatctccgctcactgcaagctccgccttccgggttcacaccattctcctgcctcagcctcctgagtagctgggactacaggcgcctgtcaccacgcccggctaattttttgtatttttagtagagacggggtttcactgtgttagccaggatggtcttgatctcctgacctcctgatccacccaccttggcctcccaaagtgctgggattacaggcatgagccacagcgcccggccaacatttatttcttaatatcatctagtaccatgtacttattcaaatttcccccagttgcaccaaaaatatcttttgtaattggcttacttaaaccagaatccattcaaggattacacaatgcatttggttattataagctcttagtcttgttcattatttaaaatttgttaatatgacaattttattttattttttgagacagagtctcactctgtcgcccaggctgaagtgcagtagcgcgatctcagctcactgcaatctctgccctcggggttcaagtgattctcctgcctaagcttcccaagtagctgggattacaggcacgtgccaccacacctggctaatttttttgtatttttagtagagacagggtttcaccatgttggccagcctggtctcaaactcctgacctcaggtgatccgctcacctcggcctcccaaagtgtattatgacaattttattttttattttattttattttatttttattttatttattttttgagacggagtttcgctcttgttgtccaggcgggagtgcaatggcacgatcttggctcaccacagcctctgcctcctgggttcaagcgattctcctccctcagcctcctgagtagctgggattacaggcatgcacctccatgcccggctaattttttgtaattttagtagagacagggtttctccatgttggtcagactggtctcgaactcctgacctcaggtgatccacccacctcggcctctcaaagtgctgagattacaggcgtgagccaccgtgcccggccgacaatttttaaacatatgtaaaagtagaagggatagcacctgaatacccatagtcttaatactcagattctatagttgtaacattttgctatagttgcttgattcctctatctgtatctatctggctatctatagtttttgctgagccacttcaaagtcatcataacatattttacccgatggttcacgcctgtaatcccagcactttgggacaccgaggcaggtggatcatttgaggtcaggagtttaagaccagcctggccaacatggtgaaaccccatctctactaaaaatacaaaaattagccgggcggggtggtgggtgcctgttatcccagctacttgggaggctgagaaagaagaatcacttgaacccaggaggtggaggttgcagtgagtagaggtcacgccactgcgtgactgtgagactccatctcaaaaaaattaaataaggacatccgccattccccggtgtaaccacactacttttttttatacttaccaaagttagtaataattccctaagatcttcagatacccagttcataaccaaatttccccaactgtttacacaaaatatcttttataggtttttttccctcccaaaacccaggtctaatcaaggagggttcttttttccccagcttaaaacaaccaccattttcttatgttcatgtattctgtgggtcaggaatttggaaatggcacaatggcgacaacttgtctctactgcatgaagtctggggtctcagctggaaaaactttgaaggctgggggtgacttgttggccaagagtttgagtcatctgaagtctttcacttacatgtttgatgcctggcctgggaggacacaaaagactgaaagtgccaacatgtggcctctccatgtgactagcttcctcactgctcagcagcctcaaggcaatcaaactttttacatggcggttcagattgctaaaagcatgagtgttccaacaagcagtgtggaaactgaaattgcctttactgaccttgcctcaaaagtcatatagtgtcatttataccatattctatagcttgcaaataagcctgcttagattcaagagtggggcacagatctcacctatcagtaggaaaggtgtgatgggatttggggtcatgttttaaaaccaccacacatacaaaactatagagaacaatataaaagagatccaagtatccatgactgaaaattatgcgtcaacttttggtaaatttgcttcagatcatgttttaaacaaatgttacctttaaagaaagaatttcagccttccgaattgcttgttctagaatctgcatactgcttatccagaaattctcctttataatagcaatagctaaccaaggagtttaaatctaggtcagcagtaccaccacatcttttttctgtgacattagtttttttctttaaaaatataataaggctgggcatggtggctcatgcctatggttttggaggccgaggtgggtggatcacttgaggttaggagttcaagaccatcctggccaacatggtgaaaccccgtctctactaaaaatacaaaaattagccgggcatggtgttgcatgcctgtgatcccagctactcaggaggctgaggcaggagaatagcttgaacccgggaggtggaggttgcagtgagccgagatgaccccactgcactctagccttgggcgacaaagcaagactccatctcaaaaaataaataaaaatagaatagttcattgagctcctatatatccaccagtgagaatgaacagttattaatatattgccgtattggcttcatttatcactatcttgttttttaaatttttttctttgcttgaaagcaaaccccagttattatgctgtttcccccaagtatttcagtatgtatttctaaaaagtggatattttctcaccaaaccttacaacctgttattatacataacaaaactaacaataatttgataattctttatataattccaagtccataatcaaatttcctaaattgtcaaaccatgaaaaggtgtttttatattagatttgtttaaatcagggtctaaacagggtccatgtggcatttgaatgccttttaaccctctcaatctagagcactctccccttttttgttctgtgctattgatttgttgttgacactggtgtaattgccctgtagcatgtcctaccttctagatttgtctgtttgcttacttgtgacattgtctttttaaagagactaagccagtttatcttgtagaatgtctgcttgttttcttctggtgtcatttgtttttctgtacctgtttcctaaacactgaaagtaatatgaatggcttgctatattttagctcttcaacaaaactacttctcaggtgatgtgaatttcctattgcttctcatcaagaggcgtgtgaagttgtgttgtgctttctcactattagtgacagtaaagttcatacttaaagtggtaatctcttgatctcatcattataagttttttcttcttgaggtgaatgggtaatattttggtgctgtgtgaatatccaattccctagaatcaattgtttcattaggacttgccagcttgtggttttctaattctgtcattccttctacatttagtagctggctttcttctgtaaagaagagctgtctctcatcatttagggctgtttggttatcctgaaatacacttccttttgaaatggtgggatgagtatttttttatttcaggttggtaaggcattataaaagagtcatgcaagagggtggtcttcttcaggaactcatagcctggctggtagacagaataacacatcagcattagagaatgagacaaggtggtatgtgctatgtatcaagtaatttatacagatcataagttcaaaggaaaaagagatcagtggaaccaaagaggttttgtgtaggagattgatttcagcttaccttaaagaatgggtaggttttgaataggcagacaaaaaggaagatagtactctaggtggtgtggattttgaggatgaaagcatagggagagaggatgagctgtacacactctggagatgtaataaggaagccatccgtctggagaagctgagaatatggatgtggaaataaggttggagaggtaagtgggccagaagcagaatatgggacaaacttaaatgccagttcagggagattaactttttatttttattattattttattattattattattttttgagacagagtttcactgtgtcgccgaggctggtgtgcagtgatgcaatctctgctcactgcaacctctgcctcccaggttcaagcaattctcatgcctcagcctcctgagcagctgggactacaggcgtgcaccaccatggccggataattttttttttttttttgagatggagtcttgctgtgtcgcccaggctggagtgcaatggcgcaatctcagcttactgcaagctccgcctcccaggttcatgccattctcctgcctcagccttctgaatagctgggactacaggcacccgccaccatgcctggccaattttttgtatttttaatagagacggggtttcaccatgttagccaggatggtcttgatctcctgacctcgtgatccacccgcctcggcctcccaaagtgctgggattacaggtgtgagccaccgtgccggccaatttttattattattttattactattattattattattttttgagacagagtttcactgtgtcgctgaggctggagtgcagtgatgcaatctctgctcactgcaacctctgcctctcaggctcaagcaattctcatgcctcagcctcctgagcagctgggactgcaggcgtgcaccaccatgccgggataatttttgtatttttagtagagacgaagttttcgccatgttggcgaggctggtctcgaactcctggccacaagtgatccatctgcctcagcctcccaaagtgctggaattacaggtgtgagccactgcacctggcctggcttattgttctatttttagagacagggtctcactctgttgcccaggctggagtgcagtggtacaatcgtagctcactgtaacctcaaactcctgggctcaagcaatcctcccacttcagcctcccaagtagctaggactacaggcacatgccaccacacctggctaactttttaattttttgtagtgacagggtcccacctcaccctcccagagcaatgggattacaggcatgaaccatcatgcccagccaaaggaggttcacattttttttctttttccctctgggaggtttacctttatcctttaatcagtgtgtgctttgagcattggtgaattaggttcttatgtgatggcaagcaaaatctggcttcataaaaagctagaagcaggaagaccaatgagagtacctttggagagcttggaggtagggaatatggctagccttcggataaatgtcttagtgacaccttctcatcctgtttcccttgcagcccgcgtgaccccaactctgccgaagcaggaccgtcctgtgcgtgaggggacccgggtagcctctattgagacaggtttggctgcagcagctgcaaagctggcccagcaggtaggtgctgacaccccaggtcaccctgcaactaatagcagtttgacttagagcctcaacacttagacctgcaggctgataggatcccacctttgtctcaatggggattgagtaacctttgatctttatccttggcagtatcccagccccctcttaaatccctcttatcccaactcaatgataagctacttccacaggttacacagttgacatgattcaggatgaaagaaaatattaggccagagaaaaacccacttaccttttttggtgtgtaaaaacctctcagatgagaaggaccagatccttcctttgctctcatatgaagccctgagggggtgactcagctgagtacgctcaagttctcagccacccaccagtattggaatttggttgattagaaatttttcttgtcctctttatgaaataatattatcttaatcttcacccacaaattttttttttgtcctaaagagtgatcttcactagaatcaaattcatctcctagcattacatctaaaagttctttaatgtgcgtaatgtgcttaggagcctttggaggtgaattctctggttatcttgcaatcaatatcccgttagctcctaatcccatatcctatagcttagagcactgttaagcatctgctttgttagttgcttccatatataatgtgtaatgtaatctatctgcccaatagccctgttcaacaggtgatattttcatcattttataggtgaagaaaatgaagctctcattaactgactcaggataatacagccagtaaatggaggagacaactcaaactcatatcctctaacttcaaatttcatattactttctatttaaataaatgcttatgtagttcagtcattacatcctatttaaatagtgtttaaatctttggcaatcttctttgaccagaacttctgtctcttatgtatatcccaatacagtgtaagctgtaatttgaaaaagggggttctactgttttatataaatataaattaagtaaagctgtgaaaattactcttagtgccttttaaggagctaaattctgtttgggatgatcagagataacctcaaagaagaggttttgaaattggggaggggctttgcaagctaagcttctggtaggggccagggaggcattctaaaagaagggacttccttcgtatagcacacaaagccctcttaaagtcctcttgatttggtctctagtcatctccctgacctccttccagcccctcatgcacaccttttatacagccatagtgcactgcaatactcatagtcccctcagtgagtatatcagattgtctcatgcttttgtgcctttacacaagatgttccttttacccattgagaatcataccctatcagatcccttacctaacagcccttcatactacctaccaccactttatttcagaggcctttttctatatgcttctacaacattcgtggtacttacaatcataaatgtatgttttggtgtttcttattaaactatgaatacttcaagagtgggaatatatttaatttaacttggtatccccactatggtcagaaaatgtgtttagtcagtattggggtgggtgggtgagtgaatgaatgaatgaacgaaagaaagaaacagatctttctgtattggagatttcatgttggggaattagttaaaataagtaatgattataagaatggattctagagtcagcctgcttggatttaaattatgtaatagttctaccatttgggcaagttaatttctctttgcctcatttcctcatagacttcattttaggattaaatgaggtaatgtacgtacaagctcttttagaatggcagttgttatggagtaagtactataggcctgttagcttttttcatcattatcattatgggttggctaagtgtaaacagccagactgtggaagatcatgaatgtcaggccagggagtttgaacttgggcggggatctgctaacagctttttgagcaacgggattggcaaggtgaaagtggttctgtcataagatggtctagttgtctgtgggagtatctggataaattatatgtgaaagagattggcagcaaaggtagcaaaatttaggctagtgatctagatatgaagaggtaattctggatttaagtgagagaaaaagggacagaaatgcagttcctggtatggttagaatagcagtttggctgagggaagagattctgaagccaaatggcttggatgtgaatcccagtttgaccacttactggtcctgtaaccttagggaaatgacttagcctctctgtgccacagtttcttcatccttcaaatgggattataattcttacttcttgggtatttacaagtattaaatgagtaattatagaagagtggttgacatgtattactaatattgttattattgtaccccagaaatgcccgtggtagccacagcctgtgagatcttccgaaggcaggattaggcttgtgttgccaagagaaggcaaaaaaatgtgatcactgagttggtttgtgtggctgtgtagcatttcagaaggtgaagtgatttacatgctctcagcaccacctttccaggttctcagggctccagatgcccactatacaagtgtccaccatgcagtggatagtagatccatagggcagtggatggttgaaatacaaggtattgggagaagtgacacaactccttatttgtcattcccatccccaaagtgaggtttttagacccagtgacctggaggattgtcaagcccactgttaaaagaaaaagaccagcaagaggaagtgaagccattataagagatgaagatagaataataattaaccacttgtcgaatatctactatgtgctgtgtatttttatgtcatcacttaatcttttcaaaaatcctaaaaagcagatattattttacctgttttatagatgaggtagctgagattcagaaaggttagtcagtttgaccatagtcatccaatttagggacacaagcctggatttgaaccagatttatctcattccaaaactaataatctttctaatctttctacgctcagattttccactttgagaagtttgcaaggtgtctcttcagatagacctggttagatagtggtcccaactacttttcagctgtgaggctttgggctcaagttacttaatatccctgcacttccattttctcatatgtaaaattaggattttttcttcttagagctgttatgaggattaaatgagataaagtatataaagtgtctcagctgctgatgtaaatttagttattatcattagacgtgtccaaggtctacctcattagtggcaacactaggaccaaaatcctagtctccaaattcatttacagctttcttggcactgtactaataagtgacagtggtgacttaaggatggatggtaacaaagagatgatctcaggtattggaaggcctgttatgtgctgtgtgtacatccaggctagacttggtgcaggtaagggagagggtggcaggttgcacaaccatattggacattgtctagttagttcctttcctgggaacttgtcttcttcactccttaatctctcctcctacttggcttgtgtttcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggtacaacggccatatggttgtagaaccgaaggatcttagagccacctgccctaaatcctaagtgctctagtagatgacaataccagggagggacactgaaggccaacctaaggtgcttggatttgatcttatgggccatggagagatgttgactgatttgaagtacagacaagatcaggttttagttttgaaagatccttctggtggccagaaggaggtagagggtgggctagagatgggaactctagggaggaggcacatatacaagttcaggcaggcaggaagagtacctggggctctgccagagggaatggagaggaaggagatgaactgatcaaatatggaggcagtcaaataggacatgggaggggatttaatgtggggagacagagacaacaaagagttagaggactgaagccttcctttccctcactttggtcctcaaagcccagtccctagagtacgcagctcaagggcatggaggttggtgtgatgttgaaggctgatgaagatgagagtttctaatgaagcaaggccctagggatggcaacttcagggacactgagctctaatcactaaccaggcacttgtccagtcctggtgggtaggataagagggtatggaagtacatttacctccctgcaggatcttggaaggaaaatgattgggaccagagtaatcagtggagaaaaagaactagacaaactgtaatcagggagtcttgctgctacaggaggtcataggaggaagagtcaaagcatgtggtgttggttggaagtagttaaggagggcttcctgcccaatatggtctaaggatggagaaactttgtgggtagagaaacaggaaggggaggtggcctgagggcagttggtgccagatttgatgttgaagcccttgccaaagcccttgcttacttttcccttcccccacaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggcaattg

SEQ ID NO: 4621 - DNA, 107492 bp, human
gcggccgccagactaggcccaagccgcggtctccagtaggcccgaacggccgggccgaggggaatgttgtggaggaggctgctctgaagcaccgttgagcggctggcgccgcgcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctgtaagttttgggggctgcgaggctattactgtcagttttaggatatactgtgaggtacctgaacatttggggagactagggagctctcatcagtttgagggggggctgcaaggaaacgctgccagtttccgagcgatgcaaaagaatccttgcttagtttcgggagtgtgaggaaattctagtcagtttgaggggttttgaatagatccttttgagtttcagggatgcagccagaaccctgtcatctttaaagtacagaacgagctggtcagtttagagatttatatttatttcagttttgggggtgatgagactcctgactggtcggggaaggaatgatattgagagtgatggaaaggattatttaaactctccgaacacgaccccagaactgtgatttgagttgggcgcctagtcttgtctgtcttgttcgtgaaggctttgagtaacctgaagagactttcagggatcccttatctctctctggttggccctatttcaggtggtgagaggagggtcttgtcttgagatacccccagcctcatttttgacgctgtggtttgcgtcataatagagggagccctgtgaaacaggggtcagctaggggagggttcagtgagagatgaaagaagcttcccgaaaaggcttcaggtattttcttgaaacccggaaagaagttatcactgacaacggggccgaagaaggtggggggtggggagtggagagtgtgggggcggtgggaagcctggaaggttgagctccgttctttacgtgtgaaagaaattctaagggccgggtggactttctctggttgccccctacagccgcaccagctgtgttgcatcccggcggcggtaactctattggagaactgagggttggtgcaagggggtggggggcgggggctgattcactctgtaaaaagtgttatttgtgcctagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcaggtaaggagggcaggccaggctacacagggtgcggtggccaggtgtgttcacttgctctctcttcctttctcagctctgtttttagattccggctcaggaccccctctcccagactcaggttctgccatctctccttgcagaacaggacctagctgacattagcctctggtttctccttttcctgtgttttcccctatgtatttcttctttgcacttttcttttgagtgtttttttagatttataagacccccccccccttttctttcctgttacaaagaatcatttttatattcttctctattttattttttattttgttttatttttttcgagacggagtttcgctcgttgcccaggctggagtgcaatggcgcgatctcggctcacagcaacctctgcctcccaggttcaagcgattttcctgccccagcctccaagtagctgagattacaggcatgcaccaccacacccagctgattttgtatttttagtagagacggtgtttttccatgttgatcaggctggtctggaactcccgacctctggagatctgcctgcctcggcctcccaaagtgctgggattacaggcgtgagccaccgtgcccggtcatcatttttatagtctgacaattatgttctgcctcacacactggcttttgggaaaacagtgttgcttatttgaggtagttgagtccataaacagggatttaagttgtggctttgtacttagtttcagagtgaccatgcacaagttgctttgcttttctgagcctcattgtcttcagctataaaatgttatcaaatacatcctttctgactttgcaaagcagtttggatgtactccataaatggaggcagaaatggaagagtattttatttctacagcatttatctgcagcaccatccaactaaattgaattaagcagaatagatgctgggtaaaacaggagtaaaaccactgatgaatttccttcagttaaccgtgtgtgcacataagcacctgtcacccagaattccggagaggttagtgtgtacgataaaactaatatttcattaatgggatttaaatctcagctatggaaagacaaccttgagggggctttgtacactggagcacaacaaaacagtgtatggcaccctcctcctgttgcttgttagattctagaattttcagttgtctggtctcctccagaggggctatttctttttctttttttcttttttcttttttttttttttttatttgagacaaggtctcactcttgtcacccaggctggagtgcaatggcatgatctcagctcactgcaacctctgcctcccgggttcaagcgattctcgtgcctcagcctcccgagtagctgggattacaggtgcacgccaccacgcccggcaaatttttttgtacttttttgatagagatggagtttcaccatgttggccaggctggtctcaaactcctgacctcaagcgatccgcccgcctcagcctcccacagtgctaggattacaggcatgagccactatgcccagcaagctatttctgtttatcacactcaagaccaaactataggtgctggtgctgctaaaatcctgccctcagcagggactgcccccttgccccgtatccaaattcatgtttaactgatctctattgaatatttattgtgtgcccggcacagagttctgttttactgcctcatgttatttaagaggggacaaccctagagggtgggaccttttcctttgccctgaaaataagtggggattaagatgtctttcaggattcctggtgtctttgctagtgctgatcaagtcactcctcagcttaacattcttctttcagtggttcgtctctgggataaaattcagtatcctttatatgacagacaagaccttttgtgatctacttgtttattctcatttcctgccactcctcctctcttgttctttatgtcctagcaagactgaactacctatagttctgggaaaattttatactcctttatgcctttttgtctttgtacgtgcaaactcccactaatgccctctcccctttgcaactcacagactgtaaaaggtgtaaaagtccttcttcctcttggttcccattgcactttgtgtgcgtctttattaaaaagtaattatttaatcatatcatagttataaatatatctgtgtcattcgttagccagagcttcctgagggcagagatgtcttcttttcatttttggtatccccagaacctagttcagtgctaaacatgtaatagatgctgagtacatttttgaatgagttaatgagtcttcatgaaaaaaagctgttgcctggggcccttactttggattgtatgggaaatgtgtaggttcagacctgtaaaatgggctcctgctaactcctcactctggaaacagggaacaggaatgaatgcttcctgactgcttatgtctgccggaccccatgacagggacttgggacaaattatttagtctatatgcaagcctgaaagttggatatttctcttttaaataatgttcttaattttttcttgctcttatagtgagacctgcttgttgtagaaaacacagaaaaagaataaagaaggaaatataactcacctaagtctactactgtctggcacaatccactgttaaatttgttgttgcattaactcccatcttttgacttagaatataaacatatttttacaagatgggattgcgttataaataccattttacaacctattttttatttctagttaatgttacaatgtaattgccagttcattaaatattcagctaaacttgatttctgatatcccacaatatatatgtgtcaccggttaatttggtaatttcctttatggttggacattgtacttttttgaacattatttgtacttttttatattataaataatgtgaggaaactttgggcgttctggaaaggttttgcatcttgatatgagtgctgattaaaacaaaaacattatggaaagcatctttgcctagtagatacttgacatttatttataaggagcaccattgaggccttaaagaattctaaacttacaaatacagaaatgggcttatgggccaggcccctctttaatcacatttctgtggtgagttgtgtgtttctgtgtacactctaacacaagttaactgccttaatttttttccatgaaatacaccaaattttaaaaatctcttttgcttctctctatgggcccccactgaacaaggaagctagctgagaatcaggtccttgggggtggctgctcttgcttactcagtgcattgctcacagaaacacaccaggcttatagtgcgccatttaagtttgtacttcagcacaattggaaattactacatactgtggactttttatggttgcttgcaagagttaagccaacaaattttaaatccacagatacctagaggtgatagaaatctgttcatatctctagtgacttcttttttttttttttttttttgagacagagtctcactctgttgcccaagctgcagtgcagtggcacgatcttggttcactgcaacctctgcctcctgggttcaagtgattctcctgcctcagccttctgagtagttgggattacaggtgcgcgccaccacacccggctcatttttgtattttagtagagacagggtttcactatgttggtcaggctggtctcgaactgctgacctcgtgatccacccaccttgacctcccaaagtgctggtattacaggtgtgagccaccatgcccggcctctagtgacttttgtaggatagatttcttgaagtccagctagggattatggaatataatgccaagttactttttggaaaggttataacaagcgaggcaactattccattttgcagctgagaatctggaattcgtggaagttaagtgactttctgagtgtggatttgaactttgaattatttgattccagagcccaggttctcagaagtgcaaaaaacatggtattgcttcattcttcctgtaagaagctggattttgcaaaaacactttgatttgtacagcggtggttctcaaacttcagcatgtatcagactcacttggaagacctgatgaaacacaagttagggatgccctagctacagtatttctgattcagtaggtaagaagggcccacccttgagaaccactgatttagaacattatcctgtcttgattccttccccttctgcggagtgtgatagcttctgatactgagggatggatggactaacatatcattactgtacaccagtcattctctttttttggtacagaaaaattggaatgaacattctttttatattattcttttttaattcctaagtgagctaacacaggaggaacgaccttttttaaagtacagttcatcaactgggaatttgttcaaaatgcaatttcttgggctaggacttggactcagcagtctatattttaacaaacaagtgatcctgattcaccctaacatttgagaatcattgctgtacaatagtggagaaaactagttggcaagcatttattgatttctgggatttttagcacaaatttcactctacagttttcctgtttataaaagaaatattggttgatacatgcccaagggaataactttggtgtggatttttaactctagaggaaaggacactgatttcagatctgggttcaaattctgattctgttacatattagcaaataatttcttatctgtgaagccttagtttccctgagaggttgtgatgatttaaataaaatggttatagctatcgtttattgagcacaagctagtgttccactcactatgctaaccacttcgcctaattatctttatcttttgggggagttttaaaaattattccatttagtagttataggactattcaaattacctattttatgttggatgtgtactttccgagaattgacccatttcatctaagttgtcaaatttatgtttgtagaattgttcatagtatttctttattatccttttgatatcttcaggtgctgtagtgataattttgtttcattagtgatactaaaaatgtatcaggctgggcatgtgatgtcattcatgcctataatcccagcactttgggaggccaaggctggtggattgcttaagcccaagagttcaaaaccagcctgggcaacatggtaaaaccccgtctctacaagaaatacaaaaattagcagggtgggtggcacatgcttatagtcccagctgcccgggaggctgaggtgggaggattgcttgagcccaggaagttgaggcctcagtgaactgtgatcatgccactacactccagcctgggtgacagagcgagaccctgtctcaaaaaaaccgaaaacaaacaaacaaaaaaaatttgtcttcgtatttgtcagacttgctagaggtttgtcagttttatggatcttttcaaagaacaagctttttgtttcattgactttttctgttgtctttctgttttcaatttaatagatctctgcctttactatttttttcctcctttggtttattttgctctctatctagtttcttgaggtgggagattagattattgatttgagactttcttttctttttttttttttttttattttttctgaaacagcctgttgcccaggctggagtgcaatggcgcgatctcggctcgctgcaacctccacctcccgggttcaagtgattttcctgcctcagcctccctactagctgggattataggcgctcgccaccacgcccagctaattttttgtatttttaatagagatggggtttcaccatgttggccaggctagtctcgaactcctgacctcaggtgatccacccgcctcggcctcccaaagtgttgggattacaggcgtgacccacagcacccggcctttctttcttttctaatgtaagcctttagctgttaagtttcttctcagcaccaatagattttaatatgttacattttcccttttcatgtagttcaaggcattaaaaaaaaaaaaagtttttttttttttttttttttttttttttgagacagtgtctcagtctgttgcccaggcggtactgcagaggcaggatcatagctctcactgcagcctccagctcctgggctaaagtgatcctcctgctgcctcaaggcatttttaaattccccttgaaacttcctgtttgacccatgaagtatagaagtatgttgtttaattttgaagtttttgtagagtttcctgttatcgttctgttactgacttctagtttgatagtggtcagagaatatactttgtatgatttcaattcctttacatttattgagatttgttttatagcccagagtctatcttggtaaatgtttcatgatcactcgaaaagaatgtgtattctgccatttttgggtagagtgttctataaatgtcaattaactactgttggttaatggtgttgctgaattcttctaatccttgctgattttttcttttttcttttcttttttttttttttttttgagatggagtttcgctcttgttgcccaggctggagcgcgatttggctcaccgcaacctccggctcccaggttcaagcgattcttctgcctcagcctcctgaatagctgggactacaggcatgtgccaccacgcccagctaattttgtatttttagtagagacggggtttctccatgttcgtcaggctggtcttgaacttctgacttcaggtgatccgcctgcctcggcctcccaaagtgctgggattacaggtgtgagccactgcactcggcctactcattcattcattcatttatttttgagacagggtctctatgtcacctgggctggagtgcagtggtttgatcatggtttactgcagcctcaaattccagggcttaagcaatctcctcatgcttcagcctctacaatagctgaaactgcaagcatgtgccactgtgtgccctaatttttaaaattttttgtgtggggagggtgtgggtgtaggttggtggtacctccctttgttgcctgggatggtcttggacttctggcttcagatgatcctcccacctcagcctcccaaagtgctgggattacaggcatgaactactgctcttggcccgagttatctctgtattgcttttttcagtacttgctctaggtattacattatacatataacttaccataagcaactgctcttgacattttaccagtttgattgaagagtagaaactttacttttctttttcctttttttttttgagacagagtctcactctgtcacccaggctggagtgcaatgatgtggtctcggctcactgcaacctctgcctcctgggttcaagcgattctcccaccttagcctcccgagtagctgggactacaggtgtggtccaccatagccggctaatttttgtatttttagtagagacgagttttcactatgttgaccaggttggtctcgaactcctgacctcatgatctgcccgcctcagcctcccaaagtgctgggattacaagcgtgagccaccatgtccggttgaaactttacttttctttatatgccttaatgctcttttgtttataatctaattaatcgttttgttgttgttgagacagagtcttgctgtgttgcccaggctggagtgtagtggaacagtcacggctcacctgcagcctaaacctcctgggctcaagtgatcctcccacctcagccccccaccccccagtagctgggactacaggcatgcaccactatgcctggctgattttttttttttttttttttttttttgagacgaagtctcgctctgtcgcccaggctggagtgcagtggcgtgatctcggctcactgcaacctccgcccctccaggtttaaacaattctctgcctcagcctccagagtagctggaattacaggcgcccgccaccacgcccagctaattttttgtatttttagtagaaacggggtttcaccatcttggccaggctggtcttgaactcctgacctcaaatgatccacacgtctcggcctcccaaagtgctgggattacaggcatgagctactgtgcccagcctactcattcttttaggataagtgttggcaacagatacgtttagttttccttaatctgagaatatcttgatttcccttgaattcttaggggatcttttcacttcatatcgaactctgggtttctagttcttttatctcagcgcttgaaaactgttctgctacttccttttgccctccatggtttctgatgagagagcctctgtcattcaaattggtgttctccttgaggtaatgtgtcatttatctctcattgctttcaggatttttcctttgtcttttgcttttaggaatttgattaagccatgtcttagtgtggatttgttccggtttgtcttttgttgtagtcctgtaggttgctgaggctctgttcattttttttccaatctgttttctttctgttgttcagattggataatttctattgttctatcttcaacttactgattcttttctctgttttctccattctgctgttgaattttcatttaagttactaaagaattttcattgttactgtatttttcagttctaaaaattctgttagattcttttctatatcttctatttgtttgaagagattttctattttttgttgacactttctttttttttttatttgagacaagagtctagctctgtggcctagactggagtgcagtggtgcaatcttgggtcacttcaacctccacctcctgggttcaagtgattctcctgcctcagcctcccaagtagctgggattaaaggcacataccaccatgcctggctaatttttgctgacactttctatgtatttatttattttattatgatgatgatgatttttttctgagatggagtttcactctgttgcccaggctggagtgcaatggtgcgatctcggctcactgcaacctctgcctccctgggttcaagtgattctcctgcctcagcctcccgagtagctgggattacaggcacatgccaccacgcccagctatcttttgtatttttagtagaaatggggtttcaccgtgttggccaggctggtctcgaactcctgacctcgtgatctgcccacctcagcctcccaaagtgctgggattacaggcatgagccactgtgcccggcgacactttcaatttattcatttgtttcaggcatgttcttaattgctcattgaaacatttttatgatggcgcctttaaaattcttaaataattccaacatctgtgtcatctcagtcttaacatctgttgattttcttttcttattcgagttgtgattttccttgttcttggtatgacaaataattattttaattatattctggacatttggggcattatgtcacgagatcctggatcttatttaagacttctgtttttgcaggccttctcagacactgcgctccggtggcagaaagggggtaccacttcatgactgccaggtgggggtggaagtacaggttccccacttggtctttggtgctatccaccacctgctaggtgggtggatcctgctgtctctagtcggtctgctttcttcccttcacctttcagagttttatgtttgttttgtatatattgtccagggtttttagctgtacttggagggatagggaggagtgcatctacttcatattgttccagaaccagcagtgataggttaaataatgtgcccaaagctacacagacagctggaccacagatcaaacctgggtctcctctactttcactgtagaatacagtattatagacaatataagcactgtttaagttgttagaagttatggaagatagggaaaatcagatatgtgctatgtgccaggcattgttctggacaccggggtgggggaggggggatacggcagtgaacatgagacagtaaactaacagcttaatatatagtgtgtcaagtgataatacatggtctagagaaaagtaaagtagggtgagcaggagaaggagtaccaccccagggttgaagtagtggttactttatacaggatgattacagatgggttacctatgagcctgaaggaaagcgaggaagggaaccatgctggtaagtaggggaagagtgtttcaagtagaggacataaaggacccaagtggggagcagacctggcatgctaccagtccagtccaatgctattggaacagagtgagtgaggggagagtaatagaagctgaggttaagggtcaggggtgtgcagatcatatacagcagtgattttccaagtatggttcccagaccagcaggatcagcattatctaggaactgattaggccaattcttggatcccaccccagactgactgaatcagaaactctggagatggagccctagaatctgtggtttaacagcctttcagatgcacgctaaagtttaaaaaccatgggtatagggtgtaaggacttggtttttactctggatgggagccacagaagctttttgagcaagtgagagttgtgatctgatttaggttttggctcttgtgaggatagactaaaggtgaggagcaaggtagaagcagggagaatttcggggctactgtagatcattattccttaaagtgtggtccctggaccagcagcatcagcatcacctgagaggtcattagaaatgcacgtttataggcccaacccagtcctactgaatcaagatgtctggggatggggcctaggaatctgtattttaacaagcttaccaggtgtttctaatattccctaaaatctgagaaactttggtctagttaggcagtggtggcttaaagcagagtcagtgatgatgagaagtggttggattttgaatatatattgatacaggatttgttaatagattggattggggttgtggaagaaggaactcaagaatgactcaattttgaagaatttggtgtaaaggggactagagtaatggggcagagactgaggggatcacaaaagggttttttgtttgggttttttttttttttggagatagaacagtctgtctgtgtgcatgtcagtgcatatgaagttattccgttggtgcatccagaattcagtgaaacctgttatatgacaaactcataaaggagacacttcctaggtacgctggaacttgctgtgtcctttgcattcctttaagtcctgtgtgcctggagttggaggggtggggcggtgggaatggtggatgcttcagcttctggttttatagatggtgctctgtctggacctggatccttgggtaccctcagaaggcagaggttgaggagataagaagccagacaggatcttgagcaaaatcatcatctctcaggcatctccaagtctcagctcccactcagttccacatccctggaagagttgagtgtccattttggagtgctcataacacttgactgtattaatcaccccacattatatcctggttacatattgtagtgatatagtagagtcacaaagtcctgaatttgtatcctgctctgctacttagtagttttgtaattgccaacaatttacttaaccactcagacccagatttctcatctgttagattaggataatattaacgatgatgatgatgatagctaatacttaacatgtgccaggaactttaagtacttaactattttagctcatttaatcctcttaaccaccctgtgaagtgggtactattagtacttccatttcacagatgcagaaactgagatgcagaaaggtgaagtataaattgcttaagttcacatagctagtgagtggcagaggtgagattcaaacccaggcagtttggctcctaagcctgtactttaaacctctgcttctgtgtttaatgtctgtgaatgttgtacggaaggccctgatttgttgtggagattaaatgtgataatatgtgaagttcatagctcagtttttttctcagtgccttttatgctaacttcaaattcattcactcactatcctgttaccttgctttactgactttatagcacttacgaaactgttttgacactgcctctctgtctcccgctctaaaatgtccagtccatgagggcagtgtctgctcaatcaatatttgttgaatttatgcactcatttacttaacaaatactgcttaccgtgtgcttggctttgcagtataccatggggataactcatcttaatcacaagacctggtgctataataattatcctcttgactaaggaagctactcagagcaaatcagcatttaccacccttggtcccaggtggtaactatcgagacagtgcagccagaagcccgatttttcatttgtctgcctccctgatatgaggagttgtctagcacgttgatgtttgttgaataataagtaaggcaagactgagagatgggaaaggtgaggacttttggtaaataagatacactatctggcaaatgtagtggggacagacagcaggtaagtgagcaattccaaggcctcgtggtgaaggctgaaatagggatagtgttgtgggggtgccacagcagcagggaaaaggaagagcaggaatgttccaggtagaaggagatacctgtgatgaaacccagaggctagagctagacagagtatggcaccgagagtccgctggctttttagagcagagctggcttcatgggtgtgcaatcgttatagtcacatggtgccccatgcctgaggtttaatgttctgtggtggttgtcttgaaattcttaataattttgcctttgattttgtgattggtatgtgatggaacaatggagtgtgcgctggggatttaagagtcttggctcatatgtggttctacctcctgctgccattctacctccccgaacaggttcttggctagctgcctggggcactgggcccaggtgcaggtgtggacagagtcggttgggttcatgtaccctgtgtactaagtcaccgggcagggccccagggtacttgtgtgggcctgcactcgccccttgagttatccctatacccaagggagcgtgacagtaaatagcatattaaaactgcatggtaagttgagagagagaccatggaagaaaggaaaaagcttttctattttttgaacagggagctcccacttttcatttccattaggccccacagattgtaagtgggctatgcagtaggaatgtctcccccagcatacgctgtgtgtgaggggaaagacgtgagctcagccagagaggcaaggccttttgggccatggtaagtttatactttaccttaggaaaaatagggaccctgtgaggcattttaagcatgggttgataggatcaaatttgtgtttttaaatgatcactttggctgtagtgtggagggccgattgggtagggacagaataggggccaggagtccagttaggagggcaggacaataactgagttagagataatagtggcctgaactagcgcaggggcagtaaggatgacaaattaacacaattgatagctaataaagagagttgataggacatgctgataacttggataataacaacaaacatacacagcacttactatgggccagacactgttctaaacactttctatatatttagttcatttgcttttgataacaaccttgtgaagtaggtacagtttttatccccatcttacaatgaggaaactgaggcacagagaggttaagtaacttgtccaagatcccacagctagtaagtggcacagccaggatgcaaacccagagaatctggacctaaagtcagtgttcttaacttgatgctagaacgtctacttcagggtatagtggagggagagggctagaggtgaatcagtgatggctgccaggtttctggcttgaatgcctggtgaggttatggagccatttgcagaagtgggaaacctaagagaagggagcatgtttaggtgacagacagaaggagaaactgagtttggacatgttgaatttgaagtacgtaagtggctatccagtagaaatgtctcacccaggagacatttggagggaagggtctaatctggcttggagttatgagtgcatagagggcacatggagccctgggagtgagaacagtgaggaaaagtgaggagaaaagagtgcccaggtaagaggacctaagaaacttcaacatttaaggactgggcaggagaaaaagagttcatcgggaaaaaggaacagccaaagacatgattaaaatcacatcacatccctactcatagtggctgttactccccagttcttgtggctacccaggaaaagccagagtgctttacagtggcctacaacaccctactacatgagtctattgcctttctgacttattactgtcctcctacctctctactctagaacactctcctcctctctgctaccttcggagtctagggatgctcccaccacagggcttttgtacttgctgttcttattgggatgctcttccttcatagccacatgaggggcttgctcccttactccctttgggtctttattcaaaagccattttgtcagtctttccctgtcttccctatctaatatttcaccctcactaccattcttcctggcccccccattgtgtgtgtgtgtgtgtgtgtgtgtgtgtgtgtgtggtgtgtatagttatatattcacacatacatattcctctatatcccccttcctgtttttttttctacctaggtcttctcactatccagcatacaatgtgtttcaccaattgcattgatttatcttgtttcttgtctgcctccccactagaacatcagctctatgagggcagggatttttgtatgctttgttttttgtcttcgtctcaccagcacctagaccagagcctggcggatgctcattaaatgtcagctgaaggaatgggcaccagccagatgggacgttatagaagtcaaggatagagagcttgtcaggtggagagtgtacagggttggcagggcgaaaatggtgctaagaggttaagggagataaagcagagaagtacttattgcatatatcaacaaggaggtcaggaaaccagtgagatctattttaaagaaggtggggactaagatcagactagcaggagatgaatcacaaagtgcatatagcaaccctaaaaaagtatcgatttggctctgatagaacacctctggatactactaggcagctaagggtgggagggagactttttactgtatatacttctgtactctgagttttgcaccatgtacagctgttacttattcaaaagaggagtcattatcaagcttcgtaggtttatttacttcatttttaagctgcataggtttaaagaaagaatgtgtttggctgtgaaggggcggacagaagggagggaggatgggagggcgggtaggtcttggttttttaatttgtaaacatcaatagacttgtttaaatgctattgtgaagagaaagagagagattgaagatactgcagaaagaaggaataattgattgagaaggtaagaaaacatgtgacccaggtggaaaacttggctttagaaggaaggaaagatagtacttttgttgtgataggaaaaaaaggatgggtgtagaaggaggtagattggtgatgagaagttaaggtagttcacctctgattacttaattttctctaagaagtaggaagtgcatcgcttcttggtcttttggctaagatcaagtgtagaagtaggaagtggctggcatgatggctcacacctgtaatcccaacactttgggaggctgaggtaggaggatcacttgaggccagaagtttgagaccattctgggcaacaaagcaagaccccctctctataaaacacacgtacagacacaaattaggtgggcgtggtggtgtgtgcttgtagtcctagctacttgggaggctggggcaggaggatcacttgagcctaggagttaaaggctgcagtgaactatgattggcaccactgctctccagcctgtgcaacccagtgagaccctgactctaaacaaaacaaaacaaaaacattaaggaactcaaagaatgaaagcaaagagtgcttaacaacaacaacaacaacaacaacaaaagccaaaaccaaaaaccagaagtagtaggaagcaaggtaatttttgagagagaagaggcaggtagtggggtgagagatttgacacagccacagtagataatgagagagagttgagtggggaatttcagaaggattgtcaggcagcatgatccagatttttttttttttttttttttgagatggaatcttgctttgtcgcccaggctagagtgcagtggcatgatctcggctcactgcaacctctgcctcctgggttcaagctgttctcctgcctcagcctcctgattagctggaattataggcgcccaccaccattcccagctaatttttgtattttaagtagagatggggtttcaccatgttgaccaggctggtcttgaactcctaacttcaggtgatccacccgcctcagcctcccaaaatgctgggattacaggcgtgagccaccgtgcctggccaatccaaatattttggacagtgaatttatgatggcaccaatccaatgggttatttttctctagccacatctagtggtctagagttaggtagttgtactgagccagggttagggtttgcatatggggatgaaaggcagtggggcaagtgagggtatctgtaagagaatgattgaagtgaggaatgctggaatctcaactagatagggaaggagggtaaagtcaagaatgtgtgaataggtgaaaagtatgaggataaagagttttgagggcaaagaacaggttgtagtgaatgagagctggatagatagacttgtggtcagagagggcgatgtatgagtttcatattccagaggtacagcagttgctggtgttgacagggtctgggggatggtcatgagagttggtagctgaaatgggagtagaggtaacagtctctgaagatgagaagatcaaagaactaagtgcctggaatgttgtgtctccagatggatactgatttcatgtaggatgttgtcaggactcgggatggggaagatctgagcaggttcttcagcgagtgaaggggtgtgttggggagatgggtatgtggcagtgatgaagaggagtaggaagtggtatggctggatggtgtggaactcagaggagtgggagctcttacacaagggtagaggagagatgatctggaagtctcaccagagagtgagagggatggctacccacaacccagtcctgagttatgagggtatgggagaatgtgcagctataagggctctagcacaatgctgcttagattttctgtggcaaagaaccaaggcacttttaaaatttccaatctataatgggccgatccttttatgatataaaaaaagaattactagaaaaaaatggtatgaaccggccgggcgcagtggctcatgcctgtaatcccagcactttgggaggccgaggcgggcggatcacgaggtcaggagatcgagaccatcctggctaacatggtgaaactccatctctactaaaaatacaaaaaattagctgggcgtggtggtgggcgcctgtagtcccagctactcgggaggctgaggcaggagaatggcgtgaacccaggaggcagagcttgcagtgagccaagatcgtgccactgcactccagcctgggtgacagagcgagactctgtctcaaaaaataaataaataaataaaaatttaaaaaaatggtatgaaccaaaagacatataaaagacaagcccaaaattttattcttagattgaacggatataaaattattctgttaaattgctgtaaaaacttctgcataatagtgatgcttactcttactttctgtacttaccacagacctgtagtaaatagttcacagaccggcattagtctgtggaccacactttgagtggcaccggtgtagagaaaatgattttcccgtaggagaagctgcattcagttaagcctggaaggtgaaggagtgtttgttgaagagagtgccaatgttgagcagtttgtttaccaagttgggaaaggggatgagcagcgggtgtttagagtagagaaagcacatagccacatagggtgaaagtttaggggagagagaggtgtccagagggaacaggggtatgagatagaaagcatgcagtccagggaactgagttaatgctacaaggtctggggaatatctttgaagaagttttaggcaggtgaaaggtgaggtccggactggacttctagcacttactgtgaaaccggatacttactgtgtatcagactttatgctcactgtgctacacacattagtattatttttgtagagatggggttaccctatgttgcccaggctggtcttgaactcccggcctcaagcgatcctcccactttggccgcccaaagtactgggattacaggtgtgagctaccgcgactggccatgctgtgcactttatatacattatcttattgaatccttaaaaaccctacaaagttgatggtgatatccctagtttattgataagctgctggtttataggcatgagattattagttgggaatatatttagttgggatattgggaagattattagttgggaagtcctaatcccaggaagtccatttatgagcatgatcttggctgaaacaacttgagctctgccttaatgttctctgctgtgtgtggtaaaccaaacattttaagacttgggtcttctttttttttttttttttttttttggagacagggtcttgttctgtcacccaggctggagtgcggtagcacaatcatggcccactgtagcctcaatctcctgggttcaagggatcctcccagctcagcctccatgctcagctaaatttttttgtttgttttggtagagatgggggtctcaatttgttgcccaggctggtcttgaactcctgggctcaagtgatcctcctgcctcggcctcccaaagttctgggattataggtatgagccactgtgactggcctaggtgtttaattttagcaagaatttatttggagggctgctggtgccttccctagtaagggaaggttgaattttgtgagattaccacctcatatacatgcaaagtcaaattttcaaaattaagtaaatctttttaagtctttaaaatgtgaaataagcaacagatgtttattgtaggaaattagaagcacagataagataaaaaggattatctgtaatttttcatttagaactactgttgactataaatttttttttttagtctttttcgtttaataaagtatctcaagtttaaaaattaggttataaggctgggcgtggtggctcacacctataatcctagcacttcgggaggcagaggcaggtggatcacttgaactcaggagtttgagaccagcctggccaatgtggtgaaacctcgtctctactaaaaatacaaaaaattagccaggcatggtggcacatgcctataatcccagctaattgggaggctgaggcaggagaatcacttgaacccaggaggcagaggttgcagtgagccatgatcacaccactgcctaatacagtaacccctaaccacatgtggctgctgagcgcttgaaattttaaattttatttaattttaatggatttaaacataaatagccacatgtacttaatagctgttctactggacagcactgttctagacctcataaaaaataaaatttccataaaccttggctgtttttctctttttcagttgtgttggtgttgaagaggagaaggctgctgacattgacctctaccactgccccaactgtgaagtcttgcatgggccctccattagtaagtagatcttagggtttcctagagaagacaatccagaggagagacaaaggaaaggaaatttgggggagtgattgcttttgcctgagcacttgtgattcttcttcctcaggaaatagcagaagcctatgcaggctccacaggccagcacctatctcactaagaggacagaagttcataacttcacctccctcccttcctaaggcttatctagagaaagtacccatccatcttcaccaggaactttcctgaatctgtgagggcctcattgactccagatgctccaaggggtggttagattggaagagaaggatctgctgaggcctttgttcttggtatcatagctcatgaccgttctgactcacaatctctcatgtttttctggcttagtgaaaaaacgccgtggatcttcaaaggggcatgatacacacaaggggaaaccagtgaagaccgggagccctacgttcgtcagagagctccggagtaggacttttgacaggtgaggaaccctgcctccagtggctggtgaatgccagggctctgggaagctggaactcacctcttcccagctttcccagtggctgtcccattaggagcttccccagtttgtgagtatcttcagggctctgcaaattccttctggtttggtcaattcctggaaaacttctggtagttgggaggcagtattcacctaagttagatacttacattcatccaaggaatgctgactagaaggagtcttaggatcagaaagtttaattctctcatagagaagaagaaactcttttaatataaaaaaattattggtcatatatctcttttatgatcgaaaagaggttttatctttttaaaattaagctggccttgttaaaagtaaattacatgaaataagcaaaaataatgagttaaaaaaaggaacaaagcattctcctttgcttggttttttaattcagtagaccatgttcaggttttttaaaaataattgcaactggccgggcgcggtggctcacgcctgtaatcccagcactttgggaggccgaggcgggcggatcacgaggtcaggagattgagaccatcccggctaaaacggtgaaaccccgtctctactaaaaatacaaaaaattggccgggcgtagtggcgggcgcctgtagtcccagctactcgggaggctgaggcaggagaatggcgtgaacccgggaggcggagcttgcagtgagccgagatcccaccactgcactccagcctgggcgacagagcgagactccgtctcaaaaaaaaaaaaaaaaaaaaaaaaaaaaaaaataattgcaactttgattttagattcaggaagtacatgtgcaggtttgtttacgtgggtatattgcatgtgtgaggtttggggtgcaaatggtcccatcacccaagtagtgaacatagtacccagtagctagtttttcagccccttccctactacctccctcccaacttgagtggtccccagtatctattgttcccatctttgtctatgtgtacccaatgtttagctcctacttaaaagtgagaacaaaagcagtatttgattttctgttcctgcattaattggcttacgataatggtctccagctgcatccatgttactgaaaaggacatgatttccttctgttttatggctatgtagtattccatgatatatatgtaccacacttttctttatccattccactgttgatgggcacctagtttgattccatgttttactattgtgaatagtgctgcagacatatcagtgcattcgtctttttagtagatggtttattttcctttgggtgtaaatccagtaatgggattgctgggtcgaatggtagttctcttttaagttctttgagaaatctccaaactgctttccatggtggctgaactaatttacattcccactaacatggtataagtattccctttgctctgcaggcttatcaggatctgttatttttttttttacttcttttcaggttttctgtaaccaaagtgttaattggaataagtgttccttcaacttaatgtttcttgttttatttgtttatttaaaggcagaaacttctcctctctactctggactcctcaggttctttctccaaagtcaacccgttatttgtagatcctttcagaaatggtttttgcatatacaaacatagatttttttaattcctttttttgacacaaatggaaacaactatatattgttctgtatcttgcttttttttaaaaaaatatatatttgagatcaatccataatagcacatacagatgttctttttcatggctgtttaatattacattgcatggtgtaacatttatttaaccagtcctctactgagggacgtttaagttgattccagtattttgctattagaaagaaatactgtaatgaatatctttgcacttaagtttttgcatacgttgccagttacatccatagtggctataccatttcacactcccacagataatgtgcggagggtgccgattttcctatatcctagccaatatttgtttgtttgtttgttttattttatttatttatttattttgagacgatgtctcgctcttgtcccccaggctggagtgcaatggcgtgatctcggctcactgcaacctccgcctcctgggttcaagcgattctcctgcctcggcaccccgagtagctgggattactggcgcctgccaccacgcccggctaatttttgtatttttagtagagacggggtttttaccatgttggccaggctggtcttgaactcctgacttcaggtgatccacccgccttggcctcccaaagtcctgggattacaggtgtgagccaccgtgcccagccaccaatattatttattatcaattttttttttgcctttctgataaaataaatcgtgaaatcctgctgttcccacttgtacttcttttctttctttcttttttttttttttttttttgaggcggtgtcttgctctgttggctaggctggagtgcagtggtgcaatctcagctcactgcaccctccgcctcctgggttcaagcaattctgcctcagcctcccaagtagctgggattacaggcacgtaccaccatgcccagctaatttttgtatttttagtagagatggggtttcaccatgctggccaggctggtctcaaactcctgacctcaagggatctgcccaccttggcctcccaaagtgctgggattacaggtgtgagccactgtactcagctcacacttgtatttctttaattatgaaggaaataagtagattttttttttgagacagggtctcatttgagacaggctggagtcgggtggtgcaatcaccactcactgcagccctgacctccctagcttaatccatcttcccacctgcgcttcctgggtagctgggactacaggtgtgtgccaccacgcccagctaattttttttttgtattttttgtagagacggggttttgccatgttgcccaggctggtctccaactcctgggctcaaacaatctgccttccttggcctcccaaagtgctgggattacagttgtgagctattgcactcagccttagatttcatacatttataaaccagcttgattgttttctctgtgaactacttgcttgttttataggcattctgttgtgttactattactgatttataacagctttcttggagaaaattttaatttctatatggttaagtttattactatttttaatgactgctgggtttttcccaggtttttctactcttaaagctttattttttggaatttaatctttggaccatctaggattatgtaaagaatgagataggcaggccaggcacagtggctcatgcctgtaatcccagcactttgggaggctgaggcgggcagatcacctgaggtcgggagttcaagaccagcctgaccaacatgtagaaatcccctatctactaaaaatacaaaattagctgggcgtggtggcgcatgcctgtaatcccagctagtcgggaggctgaggtaggagaatcgcttgaaccctggaggcggaggttgtggtgagccgagattgtgccattgcactccagcctgggcaacaagagcaaaactctgtctcaaaaaaaaaaaaagaatgagataggcattgagcttgagcttaatatatttgtcccaacacaagttgtcagagttgtcaaatacaaatctttcctccaccatgatttaaaagaaaactattttctgcaccatgatttaaagaaaactattttctttcttttctttaaaaaaaaaaaaaaaaaaaagacagggactctctctgtcacccaggctggagtgcagtggcatgttcaaagcccactgtaacctcaactcctgggttcaagtgatcttcctgcctcagcctcccaagtacgtaggactgtaggcctgcaccaccatgccctgctaattttgaatttttttgtggagacgggtttagaaatgatgcccaggctgaaactcattaagtatgcacgttgagaaagttgttgtatatgcatgttgagaaagttgttgtaaaaatgttgttgttttgtttaaatcagtcttttctctttgacagtgttttaaattgggtaatgctgctcttggtttgaacaaatctgtcaaacttgtcagatgtgtcttttctttctggccaggctgttgactgatttcttcttgtcacccagagaagagcaccatgttggcagaatactccccacctctgccagtgacctggtctcttgccttggacagatcatttcttccctggcagatgaggtttttggcattagttgccagctcacattaagtcccctcataaaaaccccacctcttgggtgagtggcagcctccaataaggcctttagtgggcagggcctcaggctcaagctttctctcctgcggcccacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggtaagacactacagacccttttaactgtaacattgttcattcctgtcaagatctgtgtcccttcccctccaatctgtttttgcatttcctctgtaaccatcttgggaatctcaggtgaaatgccttgtccaaagtcattctttggcagagatagagtcaaaatcctagtctcctctttgttctcctttcatgcattcactcattcgtttatcagagacagggtctcgccctgttgcccaggctggagtacagtggcgcaattaactcactgcagcctccacctcctcctgggctccagggatcctcaaacctcaacctcctgagtagctgagactacagggatgcaccaccatgcctagctagttttgtttattttttgtagagatgatgtcacactatgttgcccaggctgatctccaactactgggctcaagcgatctttctgcctcggcctcccaactgggattacaggcgtgagccaccacgcccagccccttctccttttaatagtccataaaaccccaggttgagctccgttttttacctgggaagttctagggatcattgtctgtcttctgttgaaatgagaaagcttttgactgttgttctcacatgccacttgttgtctgggcatgagtttctggggagaggaagagaagaaatggagaagcaaggcccaggcagatggactactatgtgtgaggctgtgtgtctggtagttccattgccctagcagggcacatagatctaaggaaagtgcgatgggttccttcccctgccccccaaacaaacacacacatatatgtacagtgtcagtggagagaagctttgagtgtaaggccattctagggactgatgaggggacaagagagtcttccacagtccctgagactacttggtgcagaacctatctctttactccaggttctgacaaagagattgatgtgattgatgtgacccgccaggctgactgcaagatgaagcttggtgattttgtgaaatactattacagcgggaagagggagaaagtcctcaatgtcattagtttggaattctctgataccaggtaagaggtgcaggaataacaaaaaaacctgacaaagtgcctgaaacttgtgtgatatatctagtgtatattcgtgtttctctctctttttttttttttttgagacagagtcttgctctgtcgcccaggctggagtacagtggcacgatcttggctcactgcaacctccgcctcttgggttcaagcaattctcctgcctcagcctcctgagtagctaggattacaggcgcccgccaccatgcctggctaatttttgtatgtttagtagagatggggtttcaccatgttggccaggctggtctcgaactccctacctcaggtgatctgcccgccttggcctcccaaagtactaggattacaggcatgagccaccgcaccttgcctcgtgttcctttctcttcttcctggtggtttcttcctttgggatggcgagctgggttatattttctagggtagctgctcacgttgtaacagttgagtcatatttctcctccacagtttctagcattggatagattacatagtagctattttaattaatttttgtctcctttttcaagaccttaggacacccttctttgaccttttcctcctatatacaacagtgccacagtcactgtgtaactggtgggataggtcctcagttcctggaaatagatttactaaaattacccccatgtaggtttcttacatttaaaaagaaaaagagaaacctatttacctttaaatgattctatctggactcacacacacagtagatacgtatatagtcttctctttgggtcagaaatgtgggaaataccaagaaatcataatgtatctttttgcccttaggaaacttactgtctgattatttacatttttaacttttaatttgtagattgataggaagttgcaaaaaagtgtacagggaggtcctgtgtactctttagccactttccctcaatggtaacgtattatgtaattacggtacaatattaagacccttgctgttgtgttttttttttttttttttttttgagacggagtttcgctctgtcacccaggctggagtgcagtggcatgatctcggctcactgcaagctccgcctccctggttcacgccattctcctgcctcagcctcccgagtagctgggaccacaggcacctgcgaccacacccggctaattttttatgtttttagtagagacggggtttcactgtgttagccaggatggtctcgatctcctgacctcgtgatccacccacctcggcctcccaaagcgctgggattacaggtgtgagccaccgcgcccggcgctgttgtttttaagatgcaaggttaaacaacctgagagtgtttaaaaactgtatttgtttgtttatacttcacttcatcctgaaagactattcaaggtagcttacagagatgtggagaagccaaaaaaaaaagagagaaaactagaacaaaagtgaaataagattgggaaatagaatgcatgtggtgggtgctcagcacatttcccggttggtggaaatggactatagagttttcagtgaatttcctgaaggtcagaacaaagagaggagtgcagtattgtaagatttgtggctttacgtaggataaaagcaacagatgtttcagagaaacatttctttacctggaactgagccctgtgaggttgctctagtggtttctcataaagaagacactatgagatggggatagtgcaataacttctataatccacatgccaagtgagtagtctggagtggggctggggagtatgagcatttagtggaggaaatgaacacctttgactggagaagcctgtggagcttggacttgggacttctggagatgagtagaatgaggatactgaccagacttacagaacagaaataagtgtcctatgtgcctttggggattctgtggagggaacttgttctctgacttatctgaccctcactgaactgtggggtattttattcaggcctcaatcttctcttcctaatcagctgacatctgctctccaccccttccttggtagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaaggtaggaatgcgcatggcttctggaggcagccaggccttgggcctccctgtacgtgtcacatggcagcacagaaacattttgaatcagtttgatttacattttgaataaaaaaaatttgatttggccgggcgcggtggctcacgcctgtaatcccagcactttgggaggccgaggcgggcggatcacgaggtcaggagattgagaccatcctggctaacacggtgaaaccccatctctactaaaaataaaaaaaattagccgggcttggtggcaggcgcctgtagtcccagctacttgggaggctgaggcaggagaatggcatgaacctgggaggtggagctttcagtgagccgagattgtgccactgcactccagcctgggcgacagaacgagattccatcttaaaaaaaaaaattgattcaaaaatgtttgacgaatcaaacgtttttgaataatagcagatgcctgaggttttcctggttgttaccttcttttttgttgttgttgaggcagagtaaaaacaaagattttatttatttatttgagatggagttttgctctgtcacctaagatgacagttgccagtgctggactgcagtggcgtgatctcagctcactgcaacctctgcctcccgggttcaggcgattcttctgcctcagcctcccaagtagctaggattataagcgcccaccaccacgcctagctaatttttgtatttttagtagagacggggtttcaccatgttggccaggctggtctcgaacgcctgacctgaagtgatctgcttgcctccacctcccaaagtgttgggattacagtcgtgagccactgcacccagccgttcttaccttcttaattgaaccagtttatactcatatcagcatgtatggaaatgtccacatttactttggaaattcctggtaacatgagaaacttccctttctccaacattattgaggtataatttatatactataaaattcatccattttaattgtacaatttgatgaattttgtcagttgtatatagtcatttaactgccaccacagtcaagataaaacctgtatgagaagtctttttaaagtcaggatttccatagtttcatttttagtaattgttacaattttgtaattagtgtattgtcagtgactatgaaggatttttgaggtctggaaaacaaatttcttaaatgattttggttttcaccattgttcagattatttagttttcttttttattattattatttttttcttagaaacagaatctgtctctgtcacccaagctggagtgtggtggtgcagtcataactcactgcagcctctcactcctgggctcaagggatcctcccacctcagcctcctgagtagctgggactataggtgcatgccatcactcccagctaattttttttaccttttttttttttttttttgagacagtctctcactttgtcacccaggctggagtgcagtggcatgatcatggctcactgcagcctcgacctgctgtgcttaagctgtcctcccacttcagcctcccaagtagctgggactacaggtgtgcaccaccacttctggctaattaaaaaaaattatttttgtagagactagctctcactatgttgcccaggctggtctcaaactcctgagctccagcagtcttcccaccttggccctcaaagtgctaggattacagacgtgagccactgtgtccagacaatttttttactttattttttgtagagacagagtcccactgtgttgcccaggctggactcgaactcctgggttcaagtgatcttcctgcctcaacctcccaaagtgctgagatttcaggcttgagccaacatgcctggcctagttttcttatcagaaaagtcaaaggaaagaatggaaaacttggattgtggctcttgtccaagtgatcacaagtccttacctagttgtttccattggtttatcatttaggaagtagaatgtgtaaatgaaagtgctattatgcaaatgttaggtttaactcttttattttaaaataatttcattttatagaaaagttaaaaaataatgggaagaatgtctgtctgcccttccctgagattcctcaaatgttaccattttattatattctctctctaaagcaaacacaataaaatggttatatatatatttttttcctgagacatttgtgcgtaaagacataatatttctttatatcttaataattcagttgtagttcttaactacaagtttgtcttaaaactttgtcttaaaaacaaagacaaagtcttaaataatttgtatagttatcaaaatcaggaagttaacattgatatactagtacctaatctacagacctgattcaaaattctccggttgtacacctgatatttctagtgttacttttctacattgaaatttattatcatgaaatactggttaaaccaatcatgctgtgagaatatatttgtgctactgggtttttgtttctttctttttttttttttttttttgccaaattatctttctggtgtttatccaggcaaaacacaattaggaaataaatgttcttccaaaagataatcacataacatataatcttccagaagtccttgggcgattactgaacttttaaacttttattagctttgattgcaggtgtgggaaggaacactctgtaaatggcatttgaaggcaaattcaattttcttctcatcagtaatgtggccttaaattctcctaaggctactagtattgatctactcatctgtagaggccattctttatttggcattgtgtctaaaataggaacacttggtgtacatatgtcttaacttgaacaattttgtttgaaatgccctttccaatttgtttttgtcaagtttatagaaacttaaaagtacaaaaagcaaagtgaccttttgaagttttccaaatccacaaagaaatgataattggatgggtttgggcaagaactctggcatattgccatcgttttggagcatgggagaaatacccctttggagtacccgttaaggacttttctggaaacccttggtatttttgtcacttcaacctctttttgtttcagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacaggtcttcccttgggtgcttctgggagggtttggggagggtggaaagaagaagggagcttttggccccacagcatattaatctgattacgtgggatgtctttctcatatcagcgaaaggcgcagaactgggcttcaagaaatttcatgtggtagtcagtgggcagcatggtcacctggggaggctgaaagtggggaatgtccaggaggaggctgatggacttctttgtcctgggttgatgtcatctgggtgaacagagaacatgactctaagccccgtaactctagggatagtgcctgggaggctggcattctaggctctaagtcagaatgacctgtggtggggatagtgctttttttccctaaacagtttgtacctgggcttcactcttagaattatgaattcttaggtcttgggtgggatctgagtatatttattgtgaaaaaatcccccagttgtctcaatttggggagagttgacatctttacttgattaggtcttatatgaatacagggtatctctccatttatttagattttctttgatttctttaatcagaattagtgttaaattttcttaaaatgtatagtagaattctctagtgcaatcacatatgcctggagatttgttttcttgggaagttttaaattaacattcaatttaaaaaatctttaaggttattcagattttctatttcatattaaataagttgcgatcatctgctcttcaaggaattggtctatttaatctaaattgtcaaatatatgtgtggagttgttcatagtgttttcttttttttgagatggagtttcactcttgtcacccaggctggagtgcagtgatgcgatctcgtctcactgtgaccactgcctgcatcccaggctcaagagattctcttgcctcagcctcctgggtagctgggattacaggcttgcactaccacgcccggctaatttttgtatttttagtagagatggggttttaccatgttggccatggctggtctcgaacttctgaccttgacctcaggtgatccacccgcctcagtctcccaaagcgctgggattataggcgtgagccaccgcacccagccatagtattttcttattacccttttgatgtcttccaagtctctagtggtattctttgtatcattcctgacgttagttatttgtgctttctcttttgtttgtgtcaattttctataggttggtcaattttattgatctttccaaagagccactttttttttttttttttttttttttttttttttttttctgagacagagtctcactctgtcacccaggctggagtgtagtggtgcgatcccggctcactgcaacctccgcctcccaggttcaggtgattctcttgcctcagcctcctgagtagctgggattacaggtgcctgctgccacgcctggctaatttttgtatttttggtagagttggggtttcaccgtgttggccaggatggtcttgatctcctgacctcatgatctgcctgccttggcctcccaaagtgctgggattacaggggtgagccaccgcacccggcccacttttggttttattgatttttctctgttgtctttttgttttcagttgtgttgatttctgcttttatctttatttttccttccctctgcttgctttgggtttattttgttctttttctagtcttgagatgagagcttagtttattgatttcaggctttccctaaatttccctctcagcattgatttaggtgtgtcacacaaatattgacatgttgtattttcattaagttaaatgaggttttgaaaaattgagatacatcttaaatattgtaaaatttaccattttaaagggtacaattcagttctttgtatatttacaaggttgtgcaacatcactgctatttaataccagagaatgttcattatgttatttatctcctttttgagatggagtctcactctgttacccaggctggagtgcagtggcacaatctcggcttactgcaacttccgcctcccgggttcaagtgattctcctgcctcagcctcccgagtagctgggactacaggcttgtgctaccacacccggctaatttttgtgtttttaatagagatggggtttcacccatgttggccaagctggtcttgaactcctgacctcaggtgatccacccgtctcagcctcccaaagtgctgggattacaggcgtgagccactgtgcccggcccgaatgttcattgttttttaaaaaaaccctatactcattagcagtcactctttattcatttgtctgccagcccttgacaacccctttttcacttcatttgtgtatggatttgcccttctgaatatttcatatagatggaatgttgtaatatgttgtcttttgtgtctagcttctttcacttgtaatgttttcaagaatcatccatgttacagcatttatcagtatgtccaggctggagtgcagtggcgcgatcttggctcactgcaacctctacctcccaagctgaagcgattctcctgcctcagcctcctgaatagctgggattacaggcacctgccaccactggcctgggtaatttttgtatttttagtagagatggggtttcaccatattggccaggctggtctcgaactcccaacctcaggtgatccacccacctaggcctcccagagtgctgggattacaggcgtgagctactcctgctccctggcgagtgcatctttttttttttttttttttttttgacggagtattgctctgttgccaggctggagtgcagtggtgcagtggcgcgatctccactcactgcaacctccgcctcccaggttcaagcgattctctggcctcagcctcccgcatagccgggactacaggcatgcgccaccatgcccagctaatttttgtgtttttagtagagacggggttttaccatgttggccaggatggtctcaatctgttgaccacgtgatctgtctgcctcagcctcccaaagtgctgggattacaggtgtgagccactgcgccgaccacttcgttctttttaacagctgaataatattctgtggtgtggatatgccacattttgtttatccattagtcagttgatagacatttgagttgtttgcactttttggctgttatgaatagtgttgctatgaacattcgtgtacgagttattgtgtgaacgtaagttttcatttctcttgggtatatatctaggaggggaattgctgagtcatatgtaactctgtgtttaactttttgaggaactgacaaactgttttcaaagcagctacatgtaccattttatattctcaacagtaatgtatgagaatttcagtgtcttcacatcttcccccaatgcttattgctgtctctttatgattatagccatcctaatgggcgtaaagtggtatctcattgaggttttgatttctgttttctggatgacctttgatgtttaacatctttccaaatgttcattggacacttgtatagttttttttggagaaatatctatttaaatcttttgcccattctttaattagattgtctcttcattgttgagttacaagaatttatatactttggatactagacttttaccagatatgtgatttgcaaatattttctctcattcttggggttgtcttgtcacttttttgatagtgtcctatgaaggacaaaagttacaaattttgatgcccaatttatctatttttttttctttatttgcttatgcttttggtgtctaagaggcttgcttaattcaaggtcatgaagatttatgcctatgttttcttctaagcattttatagttttagttcttacatttagatctttcatccattttgatttatattgattttgtgtatggtatgaggtaagggtccaatttctttcttttgtatgtagttctagttgtcccagaaccttttgaaaagactgttctttccccattgaattgtcttgacacctgtgtcaaaaatctgttgaccaaagataagggtttatttctggaccttgaattctattctgttgatccttctaacagtgtcacaccatctcaattattgtacatttgtagtaagttttgaaattgggaagtgccagtgctccaactttttctttttcaggattatttggccccttgaatttttttttttttttttttttgagatgaagttttgttcttgttgctgaggctggagtgcaatggttgcggtctcagctcactgcaacctcagcctcctgggttcaagcgattctcctgccttagcctcccgagtagctgggattacaggcacccgtcaccatgcccggctaattttttcgtatttgcagtagagacggggtttcaccatgttggctcagctggtctcgaactctagacctcaggtgatccacctgccttggcctcccaaagtgctgggattacaggcgtcagccacagggcccagccggtcccctgaattttcataagaattttttggttcagctttcatataggttttctagttattttgtagtgtttgctctaattattactttatacatacatagcatatcacagtctactagtatttacatattacctgtttgagggaagggttgaaaccatacctcttttttttgagacagaatctcattctgtcacccagcctggaatgcagtggtaagatgacagctcaccacagccttgacctcccaggctcaagcaatcctcccacctcagcctcccaagtagctgggaccacagatgtacactaccacgtctggctgatttttttagttttagtggagatggggttttgccatgttgcccaggctggtcttgaactcctgagctcaagtgatccacccacctcggcttcctaaagtgctgggattataggcgtgagtcaccgcaccgggcccaaaaccttacctctttttacatccctttatccttcgcatttttctacaattagtcatgttttacatttttccatgtatttgtcttaaatatttctcttcatacattgattatgagattgacgtgctacccactacaccaagagggctactatcctctgcgtatgttgagaactgtatcacaaagttttataatttttgctttccctatgaaacataatttagaaaactcaagagaaggaaattctatggtattcacccatgtttttactcatctgtttattctgttttcctttctggtctttagagtttcagggtaggtctactgtcgacaagttcttagtttttttccatcagtaaatgtcttgattttttttttctttcattcctgaaggatatttttctggatatagaactctgggttaatagttcttttctttcaacacctaaagaatgttttgctgtttcgttctggcctctgtggtttctgatgagattttggctatcatctgaattgtttttcccctatagataatgtatcatttcttgatgctttcattcttttttttttttttttttaagttttctgcagtttggccatgctgtgttttttttggtgtggatttctttgggtttataatgctgaatgtgttcactgagcttcttgaatgtgtaggtttatgtcttttgctgtatatgtgaaatttttagccattatttcttttcctttttttttcttttctttctttctttcttttttttttttgagagggagtgtcactctgttgctcaggctggagtgtagtggagcgatctcggctcactgcagtgtccgcctcccgagcagctgggattacaggcatgtgccaccatgccctgctaatttttgtatttttagtacagacagggtttcaccatattggccatgctggtcttgaactcctgacctcaggtgatctgcctgccttggcctcccaaagtgctgggattacaggcatgagccaccgcgccaggctgccattatttcttgaaatacttttttagactcatgctctaacttctgctggatctctgattacatgaatgttttgtatcttgtcttagtcccgcaagtccttgagtttatttttctgtgtcttttttctctttgttcaagttcagattgggtaatttcggtttctctgtctttgcattttctgtttctttcttctgttgtctccattcttctgttgagtttgtcaattgcattaattttagatacagtatttttttttttttgacacagagtttctctctagcacccaggctggagtgcagtggcgtgatctcaactcactgcaacctctgcctcctgggttccagtgattctcctgcctcagcctcccaagtagattacaggcacgcaccaccatgcccggctaatttttatatttttagtagagacagggtttcaccatgctgatcaggctggtctgaagctcctgacctcgtgatatacccacctcggcctcccaaagtgctgggattacaggcgtgagccaccacagctggcccagatacagtacttttcatttctaaaattttcttttgtttcttgtgtatttctttgctgagaatttctatttcctatttttgtgtcaagcatgtttggaattgctcactaaggtattcttatgatgatttcttatgatgatttctttcaaattcttgttacataattctatatttgtctaaccatatattgtcttatatatattggattgtctattgttttacaagtctgtttttctcttcaattatcaatattattgatacgatttcattggttttttagaatgtttaatacatggtgaggcaggtcattcactcccacccaactcccacccccatctgcttttctcttttatagttttctgttcccaggcatttattcatccatctttgaatcctttgcctggtctagtccataatgacttttctatactgggcatttagtaactgatggattgaatttgcccattagcggtttgagttaattaattgacatcttggtagaaatgcccacacaccgggtgcaatctacttagggccacaagcattgagtgtctactgtgtgccctggtattgggctaagtgctaaggacaaaagattgataggctgtttcagtataatattctactagccacaatagcaccaataggggtattcaccactagttttggaagcacagagaagagtgcttagtctagccataggtttgtgaaagtcttaggagagcaacactagaagggtgagtagggattaactatgaaaagaaagacaggaatggcatttcagacatagggaaaggtggaagaaaaccaaaactgtgtgaagcagcttatggatactagagcttaaagagcaagggctggggtggatgaaagtgaaaaggtaggccgactgaacttaccacagaggcgattgagggccattgaaggtttatttagtttctaatgaaatatttcagatgtaccaaaagatataaagaacaatataggccgggtgcagtggctcatgcctgtcgctgaggctggagtgcaatggtgcgatctcggctcactgcaacctctgcctcccgggttcaagtgattctcctgcctcagcctcccgagtagctgggattacaggtgcctgccaccatgcccagctagtttttgtatttttagtagagacggggtttcgccatgttggtcaggctggtctcaaactcctgacctcaggtgacccacccgcctcggcctcccaaaatgctgggattacaggcatgagccactgtgcctgaccctaatttatattttagatatatcgcttaggaatggatgtgaaggatagatttgagattattgtagagcagtggtttgcaaacagtcggtattcctttatactcttaaaaactattaaggacccagaagagctttttattatgtggtttatatttatcaatttttaccatataaattaaaatagaaaatttaaaagtacttgttaacttattaaaaaataattataagcccattacatgttagcataaataaaattttttttatgaaaactgttttcaaaaatgtttagtgggaagaatgacattgttttacatctttgcaaatctctataatatctaggttaatcaaaaattgttagaaccccagatctgcttttgctttcattctgttggatgtcacatcatgtacttcctggaaaactccactgtatacccatgagaataagggtgaaaaaggcaaagaacatcataatattctcatgaatatagttctgagtggcatctcagcttctctcaaagagtctcagggagcctaaggattccttggaccacaccttgagaacatctggtgttgggaagccagtttggaggctaactgctcttaaggagttgggtttgagatgagtaggtagtggagataatcagaggaagaaaggccctcttccagctttgattttgccttgttacactgcagggtggatccatgctgtgctgacgcctgtggactgccttgcctttggagggaacttcttacacagccttaacatcgagatgcagctcaagtgagtactgaaactgtggtgattctatgttggccattcctgtctgctagagtgaggagtataatgtagaaggaggggacatggccagaaaggaatggttcctcgttcctgatcatgttcagctgaagattaacaccttttctgcacttagtagttatttgactttgggcaagttatataacctttgaacccaagtttcctaatgtgtaaagtcagatcttgcagagtcattttgaggattagagatacaaagcatccagaacaaaacctgattcatagtaggtgctcagtaaatgaatccttgtttttgttgttggtgtttcctccttctagagcctatgagattgagaagcggctgagcacagcagacctcttcagattccccaactttgagaccatctgttggtatgtgggaaagcacatcctggacatctttcgcggtatggagccctttgccaactgtcctttttgcccctctcccctgagtgaatgagtatgtgtgtatgtgtaagtaacgcagtcaagacatgatactatttcattaccagaaagatctcagtatataaattaaaatcatgttgtgtaccgtaaatatgttcaatttttaaaaagtgataattagtgctttaaaaaaaatctccctagtgctacccgcccagccccgagccccttcttttttgagataggatttcactcagtcacccaggctggagtgcagtggtgtgatcatggctcactgcagcttcaaactcctgggctcaggcaatcctcctgcctcagtttgccgagtagctaagactacaggcatgggcccccacacctggataattttgtaaattttttgtatgaacagggtcttgttatgttgaccagattggtctcaaactcctggcctcgagtgattctcccacctcagactccttttgctggggttacaggcatgagccacagtacccagcaatgctacccctttatagtccctttatagtttcacccactctcctcccttgtaccatccgtaacttctggaaaccactaatctgttttccatttctataattttgtcatttcttttttctttttttccgagacacagtctcactcttgtcacccaggctggagtgcagtggcgtgatcttggctcactgcaacctccatctcctgggttcaagctttgcctacctcagccttctgagtagctgggattacagacacccgccaccacactcggctagtttttatactttttttttttctttttcttttttttgagatggagtctcgctctgtcaccaggctggagtgcagtggtgcagtctctgctcactgcaaactctgcctcctgggttcaagtgattcttctgcctcagcctccagagtagctgggactataggcacgcgccactgtgcccagctaatttttgtatttttagtagagacggggtttcaccatgttggccaggatggtctcaatctcttgacctcgtgatccgcccgcctcagtctcccaatgtgctgggattacaggcgtgagccaccacgcctggccaaatttgtcatttcaaaaatattgtataaatggaatcattatagtacgtgaccttcttagattcacttttttactcagcataatacatggcaaggcatggattttaacctttttgtttagcaagtgtgactgaaaatattggatcacagtgaaatgatctctatttcctgctggttaagataaaaagttcaatttggatagtctgagagtttcctggatctgcttcccctggggataaggcccagtcctgaccgtcctggcatcattgttttggttcctgggcgttagcccagttggaagccactttacttactgggtttcctctttccttgtctgatccagaatagaatgggtcccttacttaggcctgagattcttcaagttgacttggccaggagaaatcagtattgatgagttataaagaatctcaggggccatgagtacagcctcgtagccaatacctcaagctcttattctgccacctagactgtcacttaagtgttcaatcagatgctggatgactaactgctcattacttattctaaacagcttggttcagtagaaaattatttatagagcctaaatctggctgtttgtagtagcctcctgacataaggcagaacacagctaatccatcttctacattaatggcccttaaagtctgtgtaggtagagctcatagtcctcctgagtgttctcattttgaaacccaggaggcacagtaatgtcatggaaggggcccaagcctcagattcaaatacacatggttttagtcatggctctagcacttgctaggtgtgtgccctgggtcttgactttgcctctctgaacctcaattttctgggctgtataatgaagataataccttgcttacaggataggtataagtgttaaatgagataatagatatcacattcctagcacttagtaggtactcagtgaatgaacactatcagaagaactgagatctgcagttgtgctcagaaccttgagcattttctctggttgtcttaacaaaagtcccaagtccttcactttcctgcatggctttgttgacactctgctttcctctttcctcctttaggtttgcgagagaacaggagacaccctgcctcctacctggtccatggtggcaaagccttgaacttggcctttagagcctggacaaggaaagaagtaaatatgcatatttctctacctcctctggagttttgccctttgtagggactggatttgggtagatgttttggagagacagaagagaccagagaagcttgtgggctcctgggtgtagagtggaggtgtgggctaggattcctttgattacattttaaaatctttctttctgatgataaaaagtaatacaacatcacactagagaattagaaaaatgaggaaaagcataaagaaggaaaattatcacctatgatttttacactcagcgggaactgctattaacacttgtgtacatttccttctggtcttttttatgtgcattttaaaaacataattactgtcacactgtgtggttgacccttgaacaatgtggaggttggggtgcagaccctgccccccaatgcagtcaaaaatccacatataacttttgcctccctaaaaccttaactgctaacagcctactgttgaccagaagccttaccagtaatatagtcaacacatattttgtatatgttatttgtgttgtatactgtattattacaataaagtaagctgaaaacatgtgtttactgttcataaagtggaaatgaatcctcataaagggcttcatccttgtcttcacatggagtaggctgaggaggaagaaaaaggagaggggttggtcttgctgtcccgggtggcccaggcagaagaaaatctgcatataaacggacccatacatttcaaacccatgttgttcaagggtcaactgtatatccagttttgtgtttgaatctattggtttgtcttaattttcctgtgtcaccaaagttctccagaaacatttaatagttatgtgatattcttttgcaggaatgtaccatccttgcctaactacttgcttattgctgcttcctttttatttctttgaggggatagttttaaagaatcagacagtaaatatcagtctttgtccctcatttcttgattgtttcttcaggatggattcctggaagaacaattactgaatcaaagtatatgaaaaaatgtaaggctcttgatgcatactgccaaagtgggttttagaaatgtacaaatgtccatttatccaactgaacattaatcaactataaaaaaaaataagaaagctctgtatgtactgatttggaaagatctccaaaatttgtcaaggtgcacaaccgtgtgtatagtgtgccactttatatgtaaaaaggggagaaataagaattatgttagtatatacttgcctggatatatgatctgggatgtagaaactaatgaaaatggttacctgtgggagtgggatgatgggattgatggcaggggcagggtgggattgatggcagggacagggtaggaatgaagcttttcaatatcattttattttattttattttattttatttatttatttatgagacagaacctcactctgtcgcccaggctggagtgcagtggcacgatctcagctcactgcagcctctgcctcccaggttcaagcgattctcgtgcctcagcctcctgagtagctgggattacaggcatgtgccaccacgcctggctaatttttgtatttttaatagagacggggtttcaccatgttggccaggctggtctcgaactcctgacctcaagtgatccatccacctcagcctcccaaagtgctgggattacaggcatgagccaccacacctggcctgcctttcttttctaatgtaagcctttagctgttaatttccttctcagcaccaatatttgatttttgacctatgtgaacgaattaacttttcagaatactgaatttaaaaaacacaccaagaaatcaagagaagaagaaatgtcaacatgtaatcttaggcttcagatactccctttcctgtgtatactgtgaccaaaggtcactgcactgcaggcttaacttgtacaatctccttagttcctgttgccaaccttcccctcggatattcttggatttcatattttgagccttcccttgctccctgggctcacctacacctggaccttagcctgtgattctgtttctccacacctctcaggtgtggctaccttgggtttcatctctgacacctcccatggagtgaactttagagtgactgtgtcccaaaaacaccaaaagggaggtgggtgtggcccaagcactcatgactcaggatggacccagggaccaagggatggccccaaacagagtgatcagtgggagctggagtagagtagaacacagttctgagaagcccatgctcatggaaggagtcttttgtgaagtgcagatgatttgtaggggaggaacctgctccctcacctttccagagaccctggtctgggaaggaggaagccataagattatttagctgggtcacatggattctcagctccccgcctagccaccaaaataaattccaccagatagatgaaaagagttaaagggaaaaaagagaattaaaccatgagaaacaaggaaatgctgaggaattttttatcagccctctggatacagaaatgaagtgaaaagtggtagaaaaaaaatcacaaaggaagaaaaccttgagatctacataaaaatgtaaatctcggtactcaaaaagagggcaaacgaaagagagacaactaacagggatcgctctgggttgctgttgagctagctgtgggccagcagctgctcagcacagagttctttcctcacaagtggagaggctggtttgtccccactgatctccctgaggtccttgacttttttgaggggtgtggcccaaacccacaacttagttcctaataccttttgatactcttttattagatagatgttttacaaatattttctctcagtctgtgccttacaaagtagcagaggtgctgaaatagaggtttttcaaaaaagttttgctttttaagtccagttgatcaacttttttcttttctggtccatgcttatgtcctatctaagaaatctttgcctaactgaaggccacaaagaactcctcctctgtctaaagcaggggtttccagccggggtgcagtggctcacgcccgtaatcccagcactttggaaggccgaggcgggtggatcacctgaggtcaggagtttgagaccagcctggccaacatggcgaaaccccatctgcactaaaattacaaaaattagccgggcgtggtggtacgtgcttgtaatcccagctactggggaggctgaggcatgagaattgcttgaacccaggaggtgaaggtttcagtgagccgagaccaccacaccactgaactccagcctgggtggcagagtaagactctgtctcaagaaaatagtaagaagtaaataaaatatagcaagggtttccaaccttttggcttccctgggccaccttggaagaagaattgtcttgggccatacgtaacgatagctgatgagctaaaaaaaaaaaaaaaattacaaaaaatatcataggctgggtgcagtggctcatgcctgtaatcccagcactttggaggccaaggcgggtggatcacctgaggtcaggagttcgagaccagcctggccaacatggtgaaaccccgtatctactaaaaacacaaaaaattagctgggcgtagtggctcactctagtcccagctactgtggaggctgaggcaggagaatcgcttgaacccgggaggcgggggttgcagcaagccgagatggtaccattgcacttcagcctgggcaacaatagtgaaactccatctcaaaaaaaaaaaaagtctcataatgttttaagaaagtttgctaatttgtgttgagttgcattcaaagccatcttgggcagtgggttgggcaagcatggtctaaagggtgtatagttttaggttttacatttaggtctatgatccattttaagtttgtgtttgtgtgtatggtgcaagatagggattgaggtttgtttgtttttgtttttttttttgcatgtggatatccaattggtccagaatcatttgttgaaaagactactctttctccattgaattgccttggcatatttgtccaaaatcagttgtctctttatgtgtgggtttattcctcatgcctcttgtttgacaggctctgccagaccatgaggatgagatcccggagacagtgcgaaccgtacagctcattaaagatctggccagggagatccgcctggtggaagtaaggagcatggggcagggaagaaaaggcatttggaaaggccttgaggctcaagtggcaggttaggcctctgcagttagcatgagagcccaggggaagggtcgggaagaccctaccaaagacccaattcattcgttcaaataattattactgtgtttcaagtgtgccgcacattgggctaggctcttaaaatacgtaaatagtgcctgcccacaaagaactcagcctaatagaggaccctgagcaaagttaacctctttgagtttcagtttcctcatctctaaaatggggataattgtacctactcgaggattgttaaaaggattaaataaggtaatgtgggttgagcacaaaaatagagtgcttggcacacagtaggtgcacagtaaattctgacggtgggtcgtggtggtgggtggtggtggtagttgtagttgttgttattattaatattttgactcagtctctgcattctgcaaaatgacagttctctcggggtgaagatgattacaaagccatgtttcaacaggtggcatataccacgaggcagtaaggtatagtggtaagagattcagagaaacctgggttctggttcctgctctgtcacttgcaagcctttcagagcctcagtttcctcatctgtaaagtgaggataacatcaacctttcaggattttgttaggatcaaaagctaatatatgtagagcccctcgcacagtgcctggcagagtaagtactcaataaatgtgagccattgttattagtagactttaatagcaaagagagaagttggtgtgggatggtgaagtagcagaggcaccagaggagaattcctttaagctcagaagctgtaaagttttatttagtgcccaggatatatacatccatgctgaagggtggtcaaagtgagctgggaagttgtgcttctagcctcaatgcttgcagcatgtttcactgcctacaccatagcttacagtgtccacctcctacctctcattttcctccagtcccatctgtcaaaatcattcaggatagttaaaggcttaccttttctccagcgcctctcacttaaaccacaaaactttgggctggttggaagaggacttagagatagattatatgtggtccatgggctttcaaatgttttaaagcaatggaatcctttttttaaaatgacatcttaggtggaagcccaatattcaaagcataactgctttgaataagatgaaggtgggaggcccagggctccacttgttcttctcattcgccttctaccttcccccgattctcggggctcctcccaagaagctcaaaggagccacagaacatcttcaaaaatcacctttccagtctagtcctttaattttacagctaagcaaacagtctcaaatggtcagataactttcctgagctagttacagagctagctagcagcagaattaggactagaacctctccttctctcaaatcctgtagtccttagaatttgaaccacacagattagtacttgattattttctgtctcatgtcagctacttaatggagtattttctctccagttttgacagtagtgctttgctcgtcttcttacttgtcaatggctgggtaaagaaatgccacccaataaattcttgatgactcattatgtaaaagctagggtgtgcatatgtggagcatctataagccacttccatggcagtaccaccagtaccaggaacagacctctgctgttagtgttgagagaacccttgagtaagctctaaccccctcatgtactaacactcttgtaggacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaaggtgggtgctggcccatgggttcagcccaacccttttgggtgtcccttggaagagcagggtttcaaaaagcaggctatcctgtctggctgccatgtcccttagaccccctgctgtttggctaccagtcccactcatttaataggcatttattgagaccttttctatgccgggcactgtgataggtgctgtggatgtgactctcaagaggctgacaggcgagtgagaaagacaggcataaaaacaaatgagtgcaatcaagtattgtgaatgccacaatcaggggtgtgtgtgggaccctgagatacagaggagggttgattctgtctgggtagggaagattttcaggagctcttttcagaaaacataacacttagctgaattttgaaatgctgggacgggaatgagatttgaaaacattgcgtgtgtcaggttgtagtcttgagcaggtccttgagaaaagccctccaccagggctccatcttgcctcaagattgtgattctctccatgggcatctgaagatgtgccccctcttttttaagggaacatggttcacaagattgacaggtgtcccctgaaccaaccacacattttcaacctcctgctcctgtgatcagtgggggtatggggggacagtatagcagaaggccttggctcaggtggttttgacagtgaactgaaccagtgaaaccagagggaacttgccatcgtgattcccatgggagtcccagacaggtaacggctgagtctcctacttctacagttcaacatcactggtgcctgcttgaatgactcagatgacgactcaccagacttggaccttgatggaaatgagagcccattggccctattgatgtctaacggcaggtgaggtgggaaggaggagcacagaggtactgggactgtcagtggtaatatgccactgagacagggcatggaattggaatctaggggttgggacatgggtaggagggactgtacttagggcaatacctagatattataatgtattgttgcttagttcagagaaccatggtgtggtgttggaggtgggtagagtgagaggtctgaaatcgaattggcaagcctgagaaagattttatcagttctagaaacttcagcaagtcattgggagagaaccactggcagcaataagtatagcatacttactaaaagcattagttttttctataccttttgactttcgattagatttttaggaatttagtttacagaaatccttgcacacaagtgtgtaacgataaatgttcagtgttcactgcaccattgtttgtaatagtaattggaaacatccaaatgttcatcagtaagggctagataaataaatgatggtacatctatagaatggaatatcatgtagctgttaaaaagaatgagacagttaaatattgacacagaaagatgttcaaggtatatttttaaaatcaggttacataataatacataggaatagttccatttttacttttaaaagggcatgtatgcacatgtgtatatgtatgcacgtatggaaaagctgtatatagacatttgtattttttgaagaggtttaaaaatgcaatatacaagcgttagaaataaaacagtgtgaaagagcacacagtgaaaaatctcacacccatctctctttccctgttaccttcccatggacaaccaatgtcagtggtttccttccagagatatgtatgtacatttaggcaaataaatagtgtgttatatatatgtaaatacctttaaaaaaaaatagagatggggtctctgttattgcccaggctgagctctaactcctagactcaggtgatcctctcacttcagcctccagagtgctgggattacaggtgtgagccaccttgcctggcctagttatatattttatacttctcataccaagttttgttttttttttttttttttttttttgagacagagtctcactctgttaccaggctggaatgcagtggtgcgatctcagctcactgcaacctctgccctgctcggttcaagtgattctcgtgtctcagcctcccaaatagctgggactgcaggcgcatgccactatgcccagctaatttttgtatttttagtagagacagggtttccgcatgttggccaggctggtctcgaactcctggcctcgagtgatccgcccacctcggtctcccaaagtgctgggattacaggcatgagccaacatgcccggccttgttataccaagtttttaacagtggttatccctggaaagtacaatagggaaggtaagagcaaattttcacttcagtagcatttgaattttgtacaatgagcacgtatttacttttctttaaatatttatttacttttctttaaataattttaaaagaacaagttctaaaagaataaaataaaagctgtttacaacaaaattatggacttgggaatcaggcagtccgaggtttaaatcccagctgtgacacatattcagtgttctactttggcaaactaatgaacctatctgagcttcagtgtcctcattatatgtattctatagttaaaacttaccttagggttgttggaggattaaatgagataatatacgtagaacgttaaccacagggcctgccatataattaatacttaatacatggtagttcttataaatatgatgatgaagatagagacaaaagaattctccatgaagatggtgataatgatgtgggtatgaccagaatccaagaagattgtcagaaaccctgaaatacatagaggcaggggaaggcagtaagggctattttctagatactcagaacactagacatcagcagtcaagagccaagtgcagagtatgaacgatgtaggaacacaaacaacaaaggtagcttaattgcctccttgtaggaaaaggttaccttcaggtccatctgggcccatctgggtggaaaataagggaaaaaggagtgagagtagggcagattctgaaagcaacagagctattcttggggtttgagaatccagttactaaagtgtaagattagagagaccgttgaatattgcctttgtccagaactcatgataggtctcctggacaggagaaaattcagagtcctaggagtctagcctataatggctattgaaggtacaataagacatttcctgcccctgccccacccccagcagtccttcttgtgctgctgcctattacccgctgcagctgtcagaagctgttaagtgaacccagatagtcaaagtatagaaatatttacagatgatgtgatgctatgtctgggcttctctccaaacttggtgttttgaagagaatgaggtgtagatgaaacaagactggctgggttgataattgctgaaacttagctgagtgataggtatatgagaattaattctacttttatatttttgtgtatttgaaatttttctttaaaatttttttaaaaattattagagacagggtcttgctgtattgcctgggctcaagcagttctcttgcctcagcctcttgagttagctgatactacagacatgcactaccacaacccagctgaaatttttaattattagaagttaataaaagatcagggcatacatagctgtcatttattgagcatctcctctgtgtcaaagtctatcttagctgtttatatacactattttatttaatcctcacaaccccaaaagtaagtagtagtatccccattttactaaggtgaaaactgagagtcagagaaccttataatattacctacatggagcagttgccatggatcaagctctgtatgagctcatttaatcctcaaccctctgaagtagaaaataggtcagttaaatgacagacaattcactgaaagtcaatttaaccaaattactagttgctaaatgtatcaatttactgatttaccaaaaacatgtttctttttaactgtttatgaggtttttttcagcagtttgtattggttaatatcgtctactatgtgtaacaggattatctaagccactttttgagtcctgaacaaaggcagtgttcatttcaaccagcaatcatgagtgtcttcacttactggccaacgtttgttgttttttttttctttttgactgtagccattgaggtttttccagcagtttatattggttaatatcatctactatgtgtaacaagattatctaagccacttttgagttctggacaaaggcaatgttcatttcaaccagcaatcatgagtttcttcacttactggccaacatttgttattttttttttcttcttgactatagccattccggtggatgtaaagtggtaactcattgtatgtgttttttaaaaaataaaaattgtggcccggtgcagtggctcacagctgtaatcccaacactttgggaggccagggtgggcggatcacttgttaggagtttgagaccagcctggccaacatgacgaaacccttgtctctactaaaatcataaaaattagccagacatggtggtgggtgcctgtaatcccagctacttgggaggctgagacaggagaattgcttgaacctaggaggcgggaggttttagtgagccaagatcatgccactgtactccagcctgggcgacagagcaagactccatctcaaaaagaaaaaaaaaaaaagcaaatataaaaattgtctatatttaaggtatacaatgtgatatttgataaaatctatactgtgaaatgattatgccagtaaagctgattaacatatgcatcacttcacatacttaccatttttgtgtgtgtttgtggtgagaacacataggtctactctcttatgaaatttcaagtatacaatacagtattttttttttttttttgagacggagtcttgctgaggcaagagaattacttgaacctgagaggcggaggttgccgtgagctgagatcatgccattgaactccagcctgggtgacagagcgagactctgtctcagaaaaaaaaaaaaaaaaatttttttttggatacaaatcctttgccagataaacgatttccaaatattttctcccagtctgtggcttatattttattttcttaatggtttcttttgaaatacaaaaatttttaattttacttaatcccaggtcataatgatatttttctgtgttttactctagttttatagttttaggttttacatttagatctatgatgcattttaagttaatttttgtatatgatgtgagataagggtccacatttatttctttgtatccatttttctcagcaacttctactgaaaaaaaccatcctttccctcactgagctgctttagcaccttttgtcaaaaatcatttgatcataactgtacgggtttattcggaactcttttccactgctgtatgtctgtctttatgctggtattgcattgccttgattaccatagctttagagtaaattttggaattgagcagtataagtcatccaatgttctttttcaaaattattttggctgtgttaggtcctttctatgtccatgtacgttttactatcagctttttatttaaaaagctggctggattttgatagggattgtattgaatctgtaggtcaatgtagagagaattgcaatcttgctagcgactaacaatactgctagtgactgtttttatgttctccttcccttcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaagtgtgtgtctgttctttctttttcctcccctgcccgtttttttgtttgtttgttttgagacggagttttgctcttgttgcccaggctggagtgcaatggcacgatcttggctcactgcaacctccgcctcccgggttcaagtgattctcctgcctcagcctcctgagtagctgggattacaggcatgtgccaccatgcctggctaattttgtatttttagtagagatgggatttcactatgttcatcaggctggtctcgaactcctgacctcaggtgatccgcccatctcagcctcccaaagtgctgggattacaggtgcaagccaccacgcccagcccttgcccattttatatttgtttttggccctcttgatagacttaagaccttaggcctgagcttgttgacattttgctatactatgttctgtaggccttcattgtttcctttgttctaaagatttatttatcacctgatccctaacctctaaattagtcatctgtggtcattacttccaagaaaattagtcttatttttttcttctgggtatttggctgaaatgctaatcatagcttcataataagtgcattccattgttttctagaatttccccggaaattgccccgtgcgaagccttgctctgaccccaaccgagttcgtgaaccaggagaagttgagtttgacattgaggtaggattctgccctggatctagtcttctgctcattctggtgatagagacagaagacagattgtcattctagttgggggatatgcagggaggaagacatcctttgcattcatttcctgaataatttatttattattactattattttttgagacagagtctcctcgctctgttgcccaggctggggtacaatggcatgatcatggttcacagcagtcttgacctccggggccagctcagccttctagtagctgggaccacaggctcacaccaccaatgtagctaattctttaaaaaaaatttttttttgtagagatagggtctcgctgtgttgcccaggctggtctcaaactcctgggctcaagcgatcttttgccttggcctcccaaagtgctggaatcacagggtgagccactgcatacagtgaaatatttattaagtgaaagattgtgtgccaagtgctgctgagcatataaatggaagatttcaatttagttgaaataccttaaacatcctttaatacagaatagaatgaaagtcagtgtgggccgggcgtggtggctcacgcctgtaatcccagcactttgggaggctgaggtgggcgtatcatgaggtcaagagatcaagaccatcctggccaatatggtgaaaccctgtctctgctaaaaaattagctgggcgtggtggcacacccctgtagtcccagctacttgggaggctgaggccgaagaatcgcttgaacccaggaggcagaggttgcagcgagccgagatcgtgccactgcactccagcctggcgacagaacgaggctctgtctgaaaacaaaaaataaaaagtcagtgcgatgtagcagaaagagtatgtgatatggagtatctgatgtgaccttacacaaattatttaacttccctgagccttagttttcttatctgtttaaaatgggagtatactacctagctcacaaagatgccttggaaattaagataaaagaatgaatattctgcttagtacttggtctatacttggtgctcagaagatattaatatcaggagtcagatcatcgcccctgtactggggccttaccagaccaatcctgggcagctgaggtgatacactctctctccaacaggaggactatacaacagatgaggacatggtggaaggggttgaaggcaagcttgggaatggtagtggcgctggtggcattcttgatctgctcaaggccagcaggcaggtggggggacctgactatgctgccctcacgtgagtactggcttttatctcccctttccaggctatcagacagcaacccccgctcccgcccaaggtgccaggtcagccaatcagtagatatttatagagctatttaaagggacaaagaattatccagggcatttgggtgaaagaataaagtaggcatgaaaccactcctaaggaacttaagatctgatggcaataagatgtatagacttcaagaggaatcaattttgggcacttaggaagttgggaagaggggctggaagagtcaagcaaggagaattgttacaaaaacaatgaaaggaaagaatgcagcatgcctaaacagggagggaagtgtgccccttttttgccaccttgcctgctgtctgtggagagacaacacaaaaaggactggcttttcgtgaaagcaatctatgatactgtcttgatccttaaacttaattccaaatttttcactttggatgattctcccctttttcctcccactttgatcctcatagctatcatccctcctccctgagtattctgatgaccgatttactctgacagctaaaaacaactctctcagtatttctcctctgttccttgcagcgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatagtaagggcagctaagcacatgggttcaggccagaaggggtctcctcagtcccagtctccatcctagtcccaatagaggacagcttgtagtgaacaaagtcctggtcttaagcctgatacttagtttctctaagccatattttcctaatttgtaaaatgggaatatctcacaggttaatgttaagaatttgagattatgctcacacagatcatctggcacagtttcttgctcatgggaagccttcaaaaaatggtagttataatttgctatcatctatttttactaatgtccaacctttaccgctggtgactctttttttctcttgcctgtttgactgccatcatctgtgtcatttgtgtcctgcgttggccagtttgtcccttgcagagatacataatgacctttcagtgagctttttacatttaagagatgactcctttttttaatccaagattttattgagtaccacagtgtatcaggcactcttgtgtaatacaggtgactgtataatgtaagtgctttttgttttgttttgttttgttttttttgagacagaatctccctcattaacccagggtggagtgcagtggtgccatctcagctcactgccacctccgcctcctgggttcaagcaattctcgtgcctcagcctcccgagtagttgggattacaggcgtgtactatcacgcctggctaatttttgtatttttactagagacaaggttttgtcatgttggctagggtgatctcgaattcctggcctcaagtgatctgcccgcctgccttggcgtcccaaagtgctgggattataggcgtgagccatcgcgcccggccattgttttaatatttcaaaagttatacaaatatggttaatgcttattgaccaaaattagaagaagatggagaaagcaaaaattctttttgactaacactgtttcctctctgaacccaaagataacctttgtcatcattttcatgtataccttttattttgttgtgtttacattcatatgtagacagaagtgtagttttagtgtgtgtggttctgcaacttgcttagttttctttcaatgtcagtgcagagatataccttatcaatacagagatctatctgctgcatagtgttctgtaatatagaaatatatcatatgtttaatcattccctactgattgacatttaagttgttcctaagtttttacttttactaacaatgctgcaatgaaaattcttacagtaaccttttgtacctgtgtgccagttaatatttttctaggggggatagacctgttgagttgaagggtatgtagaagacaaatgttaataaatagtgccaaatttccctccaaaagggccagtacatgatcagtgtatgaaacatacctgtttacccatagtcttaccagcaatggatactatcagcctttttaatttttgccaaccttatggcaaaagatggtgtcttgtttgttttacgtgtttattgactcttctttattccttttctgtgaattttccattcagtctttcacccatttttctgttgggatgttttgtttttcttattgatttgtaagagttccttatatattctagatgtgttggagtattttttgtatattctggatttattgaaaaatatttccttttaggtttgtgtttaattttattatgtctttctagcatgtagatgattttgatttttacattgtcatctttatcaatttttttttttttttttgagacacagtctcactctgtctcccaggctggagtgcagtggcgcaatcatggctcactgcagcctcagacctctgcagtcccacctcaacctccctggtagctgggaccataggtgcataccaccacacccagcttattttttgtacagatggggtttcgccatgttgcccaggctggtctcaaactcctgggctcaagtggtcctcctgccttggtctcccaaagtgctgggattataggcgtgagccactgcatccagccatctttatcagtttttaatagttttttgtattttatgttttgattaagaaggccttcttatattttcccctaaaacttgtataggagttaaaattttagctctttatctggaattaagtttttgtgaattgtgggaggttagaatctaactttatttttttccacatcagtagtcatttcccccagcaccatttattgactaattcatcattatccccctgacttgaagttctacctttgtcataaacgaaattcccatatatatggggatttgttttccactttagtccaagttctgtaccttaatagctatatgaccttggtcaggctagttaacctctctatgcctctctgtgatagtcatacctacctcataggttgttatgagagttaaataaatatacagaaagcacttaaaacattgcccagcacatgataagtaagtactgtgtattagatattattaatattattctgttccataaaatcaacttgtcaaaacaaatttttattttaccaaacagatgctaaaaaagaaaatgaaaatcaacttgtctattcctgtgacaataccatgtaggttagttaccacagactttgtttctggtagagcaaatcccctctgcagaccttgctgtgaacctgaggagaccacagatgctcaccaaggctctcatctttgagctaagctttgatttgttttagggacatgccaggttcccctggccacccactctactgtgagcagtcaaatcacattgacctgcagctaagatgtctggacttgatttaaccgctcctcttagaacagctcactcagcctctcctccctccttcgcctccctactttgcccagcaaccatggaaaggcagcttaccaaggagagacctccctactttttcttatttttccagaatttcgaggctgctgttgagctttttctattccagatggattttagaatcagcttttcaaaggattgcatggtgtttgtggattaatttatggagacctatctttcatcagaggcatttcggctatactgggatttgcgcattcctgaatataacctcatgtcctgaaaatttgtgcactaaaaacaataaggcaggcaaaaagagattagggccacagccctcaaaatctatgtgactttgaagccaaaatacagactcaaataatagcagttctaagttagagcccaatggcatttgtacccggcattatagtcagtggcttctctatggccttaagctctggactcagacttcctctttccaaatctggattcttttgagggcatttggttaaatagataccagcttcatcaaatcaaaatctgatccagggcctagtccctatcaatcttttttggcaaaacaaacaaacaaaaaaaaaacagagggaaatgtctttgcaacttctttatctgctctgtcaggtagcctatcccatcagaactaaattttgtagaaaatagtcaccatttattttttctctggtaggcaaacttgtgtgatttttaatttttgtctgtatgtcttcttatgttgctaaggctttctctgtagttgtgaaaaagtctaccactgattggttgtaaacaactatggaaaattgtttttgaactggtacaacttctgaacagcattgaaatcattgttttgtctttttgttgttgtttgtttgtttgttttgagaccgagtctcactttgtcgcccagggtggaatgaagtggcgtgatctgggctcactgcaatctctgccttcctggttcaaacagttctcctgccttggcctcccaagtagctgggattacaggcacacgccaccacgcctggctaattttttgtgtttttagtagagacagggtttcaccacgttggccaggccggtcttgaactcctgacctcaagtgatccacccgcctcagcctcccagagtgctgggattacaggcgcgagccaccaggcccagccagacatctttctcttatttaccttttgggtatgagcagcagccatcttttgtttctgtcttcaaacatagtctgtctctatttattcaggtcttcttgtatgtatctcttctttggtttatttcttcttcagtttatttctagaaattttattttggttcgtaaaattggcatctttttatgtattacgttttctaattggctattgctaatacggaggacagtagttgattctttcccatatcaatcctgtattggactaccttattatactgttattagttctatttgttttcagtttattgtcttgagttgttgaggtagatgatctgtgtgtcctgtattagtttgatagggctatcataacaaaatatcacagactgggtggcttaaacaacagaaagttatttccttacacttttggcagctgaaagttgaagatcaaggtgctggcagagttggtttttcctgaggtctctctgcttggcttgcagatggccttcgtcttgctgcctcttcatgtggtcatacttctgtgcatatacgcccatgacgtctctctgtatgtcctaatcaccacctcttataagaccaccagtcagattggtttagggcctactctaatggtctcattttaacttaattatttcttaaaaggctctatctctaaatatagttacattctgaatactaggggtaggtcttcaccatatgaattttaggggacaccattcaacccataatatcctcctcctctccagtattcatacctctagcttccagttttattacagtgttgagtcatagtggtgatgggggcatccttgtgctgttttcagactttaaagggaatactgccagtctttctccactcaatatataggtctctgttagactactctcatagagttcaggggagtctctagctatttatttacttatttagacacagtctcgctctatcacccaggctggagtgtagtggcgcaattttggctcaccgtagcctccacctcctgggctcaagtgatccttctacctcagcctcccgagtagctgggactgcaggtgcacgccaccactcctggttaatttttgtgtttttagtggaaacagggttttgccatgttgtccaggctagctttactttaaaagatttttttttgttttaaaatcaagaatcaaattaggttttaccaaataattttggcatatttggacataaatacatagtttttctatgttaatttgttaatacagtgaatgacattaataaaattactaattttgaatcgatattttcttgagattagctgtacttgtacttggttgtggtgtttaacaatagttcatctagtttatttgattgctagtcttttcaaaaactagttttttggctttattgatcatctctagtgtttgatattttattctctttttaatttttctgtattcaacatcttgagttgaaagctctgttgatgtattttcaatctgctttttggtaaagcgttttttaaattttatttttattttatttatttatttttgagacagagtctcgctctgtcacccaggctggggtgcagtggtgcaatctcggctcactgcaacctccgcctccccggttcaagcgattcttctgcctcagcctcctaagtagctgggattacaggtgtacgccaccacgcctggctaattttgtgtatttttagttgagacaggacttcaacatattggccaggctggtctcaaactcctgacctcaggtgatccacccgcctcagcctcccaaagtgctgggattataggcgtgacccactgtgcctggcctgaaattttattttttaaattaacatgaagtaaaattgactctcttggtatacacatgtttatattcttccagccaccataatcaggatacagagccctttgatcactccctaacctcctttgtgttactaccccctttgtagtcatgccttccctctactcccgagcaaccactgatctgctctctgtcactgtggtttttgcctttgccagaatgtcatataaatggaattatgcagtatgtaatattttgagactggtatcttttgcttaccataatgccttttttttttttttttttgagatggagcctcgcactgtcgcctgggctggagggcaatggcgtgatcttggctcactgcaacctctgccttccggattcacgtgaatctcctgcctcagcctcctgagtagctgggattaaaggcgcacaccaccacacctagctaattttttgtatttttagtagagacggggtttcactatgttggccagactggtctcgatctcctgacctcgtgatccgcccgcctcagcctcccaaagtgctgggattacaggcataagccactgcacccggcccaccataatggctttaatattcattcatgttgttgcatatcaaaagcttgttcttttttattgctgagtaatattccattgtatggattatacccattgaaggtcatttcagttgtttccactttggggtgattacaaatagagctgctgtgaacattcaggtataggttcttgtgtgaatatgagttttcatttttctagggtaaatacctaggaatgggattcctgggcggtatgggcagtgggtgttttaactttacaggaaaccactggctgggtgtggtggctcgtgcctgtaatcccagcactttgggaggccaaggcgggcacatcacgaggtcaggagttcgagaccagcctggccaatatggtcaaaccctgtctctactaaaaatacaaaaaatttagccaggtgtggtggcatgtgcctgtagtcccagctactcaggaggctgaggcagaagaattgcttcaacctgggaggtggaggttgcagtgaaccgagattgcatcactgcactccagcctggggggacagagtgagactccatctcaaaaaaaaaaaaaaaaaggccgggcgcagtggctgacgcctgtaatcccagcactttgggaggccgaggtgggtggatcacgaggtcaggagattgagaccatcctggctaacacggtgaaaccccgtctctactaaaaatacaaaaaattagccgggcgtggtgtcgggcgcctgtagtcccagctactcaggaggctgaggcaggagaatggcgtgaacccaggagtcggagcttgcagtgagccgagatcgcaccactgcactccagcccgggcaacagagcgagactctgtctcagaaaaaaaaaaaaaagctactgaactgtttcccagaatggttgttttacatttccactagcaatatgtggaattccagttgctctacatactcatcagcacttggttttgtcaatatagttattttaatcatcctaataagtatgtagtgatatctcatttagtgattcatctaatggctaatgataataaacaactttctgtgtgtttgccattcatatatcctcttttttgaagtgtcattaaacagacattttgaatgcattgttaagatttcttgttaaggatttaactatgaatttttctttttgttttcttttctttgtttttttgagccagtcttgctctgtcacccaggctggagtgcagtggcacgatctcggctcactgcaacctctgcctcctgggttcaagtgattctcatgcctcagcctcctgagtagctgagactataggtgcgtgccaccattccccagctaattttttttttctagtagagatgaggtttcaccatgttggccaggctggtcttgaactcctgaccttaagtaatccacccaccttggcctcccaaagtgctgggattattggcatgagccaccacacccagcctggatttattttctttagtagatatagaattttcaggttatctgtttgattttaggtgagttatttatttattttttatttatttattttttaagactagccaagggcagtagtgaaaagaggggaaagagtttgggtgagtttttatagtttgtatctttcaaggaattggtccatttcatataacttacagaatttatgggcatagagttgtttgtagaattcccctattattctttaaatgtctatggggtctttagtgatatcccccttttcccttctcattcttgatattggtaaattgtttcttctcttttttttttcctttgccattcttgctggcactttgtcttttttttttttttaacttaaaaagtgtttttagggctacaggtgcatgccactggctgtttttttatttttatggagatgggggtctcactgtgttgcatagccttgtgtcaaactcctgacctcaagtgatcatctcttctggacctcccaaagtgctgagattacaagtgtgagccaggccttattgtgtcaatttaatggatcttttcaatatttttggtttcattttctatgttttgtcagttacattccactcttaatgtagttaagattgctgtagttttattttattctttttctaatttcagagatgatcgtttagattatttatttgagacctttttcgtttctttttttgctatttttattctattttattttattttatttttttgagacagagtcttggtctgtcacccaggctggagtgctgtggcgcagtctccgctcgctccaacctccacctcccaggttcaagtggttctcctgcctcagcctcccgagtagctgggattacagtcaggcgccaccatgtccagctaatttttgcatttttaatagaggtgggatttcaccaggctggtctcgagctcctgacctcaagtgatcgccctccttggcctcccgaagtactgggactaaaggtgtgagccaccatgcccagccttttttttttattttggtattttataaagttgatatattaacagcatattgtgtatattttggggttacatgtgatattttgatacatatatgcaatgtgtaatgatgaagttaggcttagtgatatatctatcatcaaacctttatttttgtgtcagaaacattataattctcttctagctgttttgaaatatgcagtaaattattaactgtaatttcttgactgtactattgaatgctagaatttattccttctatctaactgtatttttgtacccattaaccaactatttttcatcccccgcttcctttcccagcctctggtaaccaccattctactctccacctctgtgagatccacttttttagctctcacatatgagtgagaacatgcgatatttgtctgcgtattcctggcttatttcacttaatataatgacctccattttccttcattttactgcaagtgacaggatttcatttgttttaatggctaaataatattccattgtttatatataccacatttcttaattttactcatttgtccattgatggacacttaggttgattccatatcttggctattgtgaatagtattgcagtgaacatgggaatgcagatatctctttgatatactgatgtctttccttttggatatgcccagcagtcaaattgctggatcatatggtagttctatttttactttttcgagacacctccatactgttttctatgatagttgtactaccttatattcccaccaacagtagtatgaatgttcctctttctccaaatgctgaagagtaacaaatcctctccagcttttgttactttttgtcttttggataatagccattctaacttgaggtgagatgatttctcattgcagttttgatttctatttccctgatgatgagtgatattggacattttccccatatacctgttggacattttttttccaacttttaagttctggggtacatgtgcaggatgtgcaggtttgttacataggtaaacgtgtgccatggtggtttactgcacagaccaacctatcacctaggtattaagcccagcatccattagctgttcttccttgtactctccttccccaccactgacaggccctagtatatgttgttccccgcctcccatgtgtccatgtgttctcgtcattcagctcccacttacaagtgagaacatggggtatttagttttctgttcttgtgttagtttgctgagaataacagcttccagctccatccatgtccctgcagtggacgtgatgtcgttcctttttatgactgcatagtattccatgctgtatatgtaccagcttttctttatccagtctatcattgatgggcattttggttgattccatgtccttgctattgggaatactgctgcagtgaacatacgtgtgcacgtatctttataatagaattatttatattcctttgggtatatatccagtaataggattactgggtcaaatggtagttctgcctctagatctttgaggaatcaccatgctgtcttccacaatgcttgaactaatttacactctcaccaacagtgtaaaagcgttcctttttctctgcaacctcaccagcatctgttgttttttgagtttttaattgccatcctgctggtgtgagatagtgtctcattgtggttttgatttgcatttctctaatgaacagtgatgttgagctttttttcatatgatggccgcatgaatgtcttcttctttttttttttgagacggagtctcgctctgtcgcccaggctggagtgcagtggcacaatctcgactcactgcaagctccgcctcccgggttcatgccattcttctgcctcagcctcccgagtagctgggactgggactacaggcgcctgccaccacgcccagctaatttttttgtatttttagtagagactgggtttcaccatgttagccaggatggtctccatctcctgacctcgtgatccgcccgcctcagccccccaaagtgctgagattacaggtgtgagccaccgcgcccggctgaatgtcttctttttagtggggttgttttcttataaatttgtttaagttcctcttagactctggatattatacctttgccagatggatatattgcaaaaattttctcccattctgtaggttgtctgttcactctgattatagtttcttttgatgtgcagaagctctttaatttaattagatcccatttgtcaatttttacttttgttgcaattgcttttggcatttttgtcataaaatctttgcctgtgcctatgtcctgaatggtattgcctagattttcttctagggtttttatagtttggggttttacatttaggtccttcattcatcttgcgttaattcttgtatatggtataaggaagggatccagttttaattttctgcatatggctacctggttctccccagcaccacttattaaatagagaatcctttctctattgcttgtttttgtcaggtttgtcgaagattagatgtgtgtaggtgtgtggtctaacttctgggttctctattctgttcattggtctatgtgtctgtctttgtaccagttgcatgctgttttggttactgtagccttgtggtatgaagtcgggtagcgtgatgcctccagctttaattctttttgcttcggattgtcctggctatttgggctcttttttcattcaatgtgaattttcaagtagtttcttctaattctgtgaagaatgtcaatagtggtttaatgggaatagcattgaatctgtaaattactttgggcagcatggccattttcacgatattgattctttctgtccaggagcatggaatatttttccacttgttggtgtcctctctcatttccttgagcagtggtttgtagttctcctcgaagaggtccttcgtttcccttgttatgtgtattcataggtattacattctttctgtagcaattgtgaatgggagttcattcatgatatggctctctgcttgtctgttgttggtgtaaagaaatgcttgtgatttttgcacattgattttgtatcctgagactttgctgaagttgcttatcagctgaagaagcttttgggctgaggtgatggggttttctatatataggatcatgtcatctgaaaacaaagataatgttacttcctctctccctgtttgaataccctttatttctttctcttgcctggttgccatggccagaacttccaatgctatgttgaataggagtggcgagagagggcattcttgtcttgtgccagttttcaaggggaatgcttccatcttttgcccatttagtatgatactggctgtgggtttttcatatatggctcttattattttgaggtatgttccttcagtacctagataattgagagtttttaacatgaagggatgttgaattttatcaaaggtattttctgcatctattgagataatcatgtttttgactttagttctgtttatgtgatgaattacgtttattgatttgcatatgttgaaccaactttgcatcccagggatgaagccaacctgatggtggcggataagcttttagatgtgctgctggattcagtttgctcatattttattgaggatttttgcatcagtgttcatcagggatgttggcttgaagttttctttttctttttttttttttttttttttttgagacagcgtcttgccctgtcaccaggctgaagtgcagtgacgtgatctctgctcactgcaacctctgcctcctgggttcaagtgattctcctgcctcagcctctcgagtagctggaactacagatgcgtaccactatgcccagctaatttttctatttttagtagagacggggtttcaccatgttggccaggatggtcttgatctcttgacctcgtggtctgcctgcctcggcctcccaaagtgctgggattacaggcgtgagccaccgcagccggccgaagttttctttttttgttgtatctctgccaggttttggtatcaggatgatgctggcctcataaaatgagttagggaggagtcccttcttttcaattttttggaatagtttcagtagaaatggtaccagctcttctttgtacctgtagtggaattcagctataaatctctctggtcctgggctttttttggttggtaggctatttattactgcctcaatttctgaactcattattggtctattcagggattcagttccttcctagttcattcttcggagggtgtatgtgtccaagaattcatccatttcttccagattttctagtttatgtgcatagaggtatttatagtattctctgatggttgtttgtatttctgtggagtcagtggtgatatctcccttatcatttctggttgtgtctgtttgattttctctcttttgttcttcattagtctagctaatggtctatctattttattaattttttcaaaaaagaagctcctgaatttgttgattttttgtttttttgaagggtttttcgtgtctctgtctccttccgttcagctctgatcttggttatttcttgtcttctgctagctttgggatttgtttgctcttggttctctagttcttttagttgtgaattttgagatctttctagcttcttgatgtgggcatttagtgctataaatttccttcttaacactggtttagctgcatcccagagattctcatacattgtctctttgttctcattagtttcaaagaacttcttgatttctgccttaatttcattatttacccaggagtcattcaggagcaggttgttcagtttccatgtagttgtgtggttttgagtgaatttcttagttttgagttctaattttattgtgctgtggtctgagagactgttatgatttcagttcttttgcatttgctgaggagtgttttacctccgattatgtgatcaattttaaagtgccatgtggtgatgagaagaatgtatattttgttttttgggtggagggttctgtagatatctatcaggtccacttgatccagagctgagttcaggttctgaatatctttgttaattttctgtctagatggtctgtctaatatcgtcagtggggtattaaagtctcccactatttttgtgtgggagtctacgtttctttgtaggtctctacgaacttgctttacgaatctgggtgctcctatattgggtacatatatatttaggatagttaggtcttcttgtggaattgaaccctttatcattatgtaatgcccttctttgtcatttttgatctttgttgatttaaagtctgttttgtcagaaactaggattgtgacccctgctgttttctgtttttcatttgcttggtaaatttccctccatcccttcgttttgagcttatgtgtgtctgcacttaagatgggtctcctgaagacagcatactgatgggtcttgactctatccagcttgccattctatgtcttttaattggggcatatttagcccatttacatttaaggttaatattgttacgtgtgaatttaatcctgtcatcatgatggtagctggttattttgtagacttgtttatatggttgcttcatagtgtcactggtctgtatacttcagtgtgtttttactaaagtacttcctttaggagctcctgttggccatttctatgtctttttttgagaaatgtctgttctggtattttgcccatttttaaattggattatttgttttttgctattgagttccttatatattttagttattaatcctaatcccttgtcagatggatagtttgcagatattttctcccattctgtgggttgtctctgcactttgttgattgtttcctttgctgtacagaagctttttggcttaatgtaattatatttgtgtattcttgcatttgttgcctgtgcttttgagttcttactccaaaacaatctttgcccagaccaatgtcctatagcatttccccagtattttcttgtagtagtttcatagtttcaggtcttacatttaagtcttttaatccattttcaattgatttttttgtatatggcaagagataaaggtctagtttcattcttttgcatatgggtattcggttttcctgacaccatttattaaagagactgttctttccccagtgaatgttcttggtgccttcgtggaaagtgagtgggctataagtgggtggatttatttctggattctctatgctgttctgttggcccatgtatctgttttaatgccagtaccatgctgttttggttactgtagctttgtaatataatttgaaatcaggtagtatgaggcttccagctttgttcttactgctcagtattgctttagttatttggcatcttttgcagttttatgtgaattttaggattgctttttctatttctgtgaagaatgtcattggtattttgttagggattgcatggaatctatagatcgtttttgggtagtatagacattttagcaatattagttcttccaatacatgtgcatatgctatctttccattttttgtgtgtccccttcaatttttttcatcagtgttttgtagttttccttgtagagatcttgcaattatttggttaaatttattcccaggtattttaagttttttgtagctattgtaaaggggattgctttttttagttttttttttagatcattcactgttagcacatgtaaatgctactgatttttgtatgttgattttgtatcctgcaactttactgaggtgttttttttgttgttgttgtttttgagacagagtctcgttctgtcacccaggctggagttcagtggcatgatctcagctcactgcaacctttgtcccccggattcaagtggtcctttcacctcagccacccaagtagctgggactacaggtgcccaccaccacacccagctaatttttgcatttttagtagagatgagggtttaccatgttgcccaggttggtctcaaactcctgagctcaagctatctgcccgtctcagcctcccaaagtgctgggattacaggcatgagccactgcacccagccatctttactaaatttgtttatcagttcttttatttttattttttgagatggagtcttgctctgtcacctaggctggagtgcagtggcgcaatcttggctcactgcaacctccgcctcctgggttcaagcgattctcctgcctcagcctccaagtaaccgggattacagatgcccgccatcacgcccagctaattttttgtatttttagtagagatggggtttcaccatattggccagactgatctcgaactcctgacctcaggtgatctgcccaccttggccttccaaagtgctgggattacaggcgtgagccaccgtgcccggcgaggcctgtagttttaattgttgtatttttttctggttttggtatcaggataatgctggcctcatagaatgagttttgtggaagtattccctcctcttcagttttttgagttaaggtagaattgttgttttaatgtttggtagaattcagcagtgaatccatcaggttctgggcatttatttgatgggagacttcttattactgcttcagtctcattacttcttgtctgttcaggttttctgtttcttcatggttcaagcatggtaggttatatgtgtccaagaatttatccatttcttcccagtttccaatttgttggtgtatagttgttcatagtagtctctacctttgtatttctgtgatatcagttgtaatgattcctttctcatgagatatttttaatttctaatgtaaacatttagtactttaaattttcctctaagcagagctttctttgcgtcccccaagttttatgttgcaatttcactttttttttttttttaatttttatttttattgatcattcttgggtgtttctcacagagagggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcactgcccttaatccatttaaccctgagtggacacagcacatgtttcagagagcacagggttggggggtaaggtcacagatcaacaggatcccaaggcagaagaatttttcttagtacagaacaaaatgaaaagtctcccatgtctacttctttccacacagacatggcaaccatccgatttctcaatcttttccccacctttccccgctttctattccacaaaaccaccattgtcatcatggcccgttctcaatgagctgttgggcacacctcccagatggggtggtggccgggcagaggggctcctcacttcccagtaggggcggccgggcagaggcgcccctcacctcccggacggggcggctggctgggcggagggctgacccccccacctccctcccggatgaggtggctggccgggcagaggggctcctcacttcccagtaggggcagccgggcagaggcgcccctcacctcccggacggggcggctggccgggcggggggctgaccccccacctccctcccggacggggcggctggccgggcggggggctgacccccccacctccctcccggacggggcggctggccgggcagggggctgacccccccacctccctcccggacggggcggctggccgggcagaggggctcctcacttcccagtaggggcggccgggcagaggcgcccctcacctcccggacggggcggctggccgggcggggggctgaccccccacctccctcccggatggggcagctgccaggcagagacgctcctcacttcccagacggggtggctgccgggcggaggggctcctcacttctcagacggggcagctgccgggcggagggtctcctcacttctcagatggggcggttgccaggcggagggtctcctcccttcccagatggggcggctgggcagagacgctcctcacctcccagacggggtcgcgaccgggcagaggcgctcctcacatcccagacggggcggcggggcaaaggcactccccacatctcagacgatgggcggccgggcagagacgctcctcacttcctagatgggatggcggccgggaagaggcgctcctcacttcctagatgggatggcagccgggcagagacgctcctcactttccagactgggcagccaggcagaggggctcctcacatcccagacgatgggtggccaggcagagacgctcctcacttcctagacggagtggcggccgggcagtggctgcactctgggcactttgggaggccaaggcaggcggctgggaggtggaggttgtagcgagccgagatcacgccactgcactccagcctgggcaccattgagcactgagtgaaccagacaccgtctgcaatcctggcacctccggaggccgaggctggcggatcactcgcggttaggagctggaggccagcccggccaacacagcgaaacccagtctccaccaaaaaaatacgaaaaccagtcaggcgtggcggcacgcgcctgcagtcgcaggcactcggcaggctgaggcaggagaatcaggcagggaggttgcagtgagccgagatggcagcagtacagtccagcttcagctcggcatcagagggagaccgtggaaagagagggagagggagaccgtggggagagggagaggagggagagggagagggagagggacaatttcacttttattaatggaaatattttctgttttcctgtgggatctcctctttgacccatgtttatttaaaagtatgtttaatttttatgtgttagaggtattccagttatctttctattgctgctttttgttctttttgttaagacatcattcttctggtttccttttgttctttgtcagtggtttccttttgctctttcagcctagttgatttagtctttgtatggtaaatacaatgtcagagcttccttagggacagtttttgtcagtttctctttttttttcccccgtaaatgggccatacttcccttttcgttgcatgcctcatggttttttttgttggaaactggaaattttgaatattataatgtggtttactctggaagtcaaattttccttcctcagtttgcttttgttgcttgttatgaactgcagtcatctattatttagtgacttttcccaactactttttacaaagattgtattccttattgtgcagttactgagtctccattccttagcctcattagtaagctgagactttctgatagagatttcctgacaactttgtttgtttggaaggcaggagtacagtggcacaatcttggctcactgcagcctccacctcccgggttcaagcaagtctcgtgcctcagcctcccgagtagctaggattacaggcatgtgctaccacgcgtggctaatttttgtatttttagtagagacagggttttgccatgttggcgaggctggtcttgaactcctgacctcaagtgatccgcctgcatctggagtttcttaaagacatgatttagcagcctttttctttgttaatcaccccttgttgttgtgagatttttattggactccagagttccataaaagttgttctgacagtttttgccaggttgatggttgtttcagtggagggacagatcattttagctccctattactccattatcagtggtgtcactcctccttccctgcaccctcttcgtgtgtgtgtgcgtgcgtgtgtgtgtgtgcacacgtgcacgtgcatgttctttttttttggtaaaaaacacataccattaaatttatcatcttttttccattatttacctttaagctccgttagacttgacaaatttaccatcttaatcattttaaagtgtatagttcagtactattaagtatattcacattgttgtgcaacagatctctataactttttcatcttgcaacacttaaactgtatacccctaaacactaattcctccctctagccattggtcatcaccttctactttctttcttttcttttttttttttttttttttgaggcagagtttttgctcttgttgcccaggctggagtgcagtggcacgatcttggctcactgcaacctccgcctccaaggttcaagtgattctcctgcgtcagcctcctgagtagctgggattacaggtgcgcgccaccacgcccagctacttttttgtatttttaatagagacagagtttcgttatgttggccaggctggtctcgaactcatgacctcaggtgatccacctgcctcagcctcccagagtgcagggattacaggcatgagccactgcgcccgacctctactttctatttctatgattttgacacctttaggtactttgtaagagtggaattgtatagcatttgttctggcctttttttcttagcataatatcttccatgttcatccatgttgtagtatgtgatagctttcctttttttaaggctgcataataactgctgtgtgtacctaccatactttcttttatttttcctttttttaaattatacgtttctgggatacatgtgcagaacgtgcaggtttgttacataggtatacatgtgccatagtggtttgctgcacccatcaacccgtcatctacattaggtatttctcctaaagctatccctcccctagcccccttccccctcacaggccccagtgtgtgatgtttccctccctgttttcatgtgttctcattgttcaactctcacttatgaatgagaatatgcggtgtttggttttctgtcctgtgttagtttgctgagaatgatggtttccaacttcatccatgtccctgcaaaggacacgaactcatcctttttatggctgcaaagtattccatggtatatgtgtgccacattttctctatccagtctatcagtgatgggcatttgggttggttccaagtctttgctattgtgtacagtgctgcaataaacatacgtgtgcatgtgtctttctagtagaatgatttataatcctctgggtatatacccagtaatgggattgctgggtcaaatggtatttctcgttctagatccctgaggaatcgccacactgtcttccacagtggttgaactaatttacactcccaccaacagtgtaaaagcattcctatttctccacatcctctccagcatctgttgtttcctgactttttaatgatcaccattctaactggcttgagatggtatctcattgtggtttcgatttgcatttctctaatgaccagtgatgatgagtattttttcatatgtttgttggctggataaatgtcttcttttgagaagtgtctgttcatatccttcacccactttttgatgggattgtttgtttttttcagcccaggtgatctttttgttccctttgtgtgcattaagtatgtactgtttatttcttcattcacttagtaaacagttactgagaacttgtgcttcagtgtgctagtaggctcccttaatttgaaataaataatacatattcctgcccttatggtaaattggaggcaacagatttgctaatcagctcttaaataccatataacagcttcagtagagggatgcacaggaagctatggagagccaagtaggaggcatctcaatcatgattaggagagggagggaagagttcttgtggaaagtaaatctaaagctgaattttgaagggtgagtaagtaaagtaactcatgaagttattcactaaatggatgttgggtgaatgaatcagaattaggtgaatctaggagaaggacatttgctgcaaggatgcaaagtagaagggcatgaaatgtatgtggtacattcagagactcttggagttgagtatggattaagtaaaaggtacatttgtaggggaagggcaggagctggagtaggtgtcattctatcttcaccctttggatgaaatctcattttaccctgttttcccttctccctgcagtctatccttcactggagtctgatgatgatgaccctgctttgaaatctcgacccaagaaaaagaagaattcagatgatgctccatggagtcctaaaggtaatctagtattttgtcccttaaactctgtaggggtggtcaggaggaaatagacaaggtaggtgggatatttaatatcagaagacctgattcagtcactcatttgtttattcagcaaacatttgttgagtgtctgctgtgtgtcaggcactgtgttaggttctggagctaaaatgactaataagacacagagtttatgtaattagtccaataaaatcagaggtaatggagcatattgcatttgatattatatggtttgaggtgaaaggaagaccttgaacagattttagcaagcagtctgaggcttctgagaacgttctgataccatcatcccagtactctggtagttttgttgtcaaggagggaaattctgctgactgttgagctctataaggcccaagattatcacctatactgagaggccatctctgaggagggaagaatgaccactgagttgaacatggagtttagaggataatggaagaattttcttcgtctccttggctggatagtattcacactgaggatgcatccttcagttagtttttgctgcttaacagtctgcccaaaacttagtggcttaaaataacagttaataatttttcataattctgtaggttggctgagctgttcttctagtctaggccagattccctggggctgaatggtctcaaaagttctccttcaggtgtctcagacctactatctaagtcctactaagacctactatctaagatggccaaggcttctctctacatggtctttagtctaccaagcttttccacaaggtggcagaaaggtttctagcagcaagagaggacaagccccaatgtgcaagcacttttcaagcctttgcttaagtcatatttactgttgtcccattgactaaaacaagttacgtggccaagccttgatcccatggttgggaaatagattgcaccttttgagaggagaactgcaaagtcacatcgcaaagtatcatgcatacgaggatacatgagcacactgaaggccattactgcaacagtctgccatagaggtcattgggatttcagtacctgtggttccccagcagataaagggcttgctcttctcaccctgccttatttagactttttggtgtttgcttgaggtcgagggggtgacataggggtagcagggcattcctcagaagtgttatgttagtgagttaatcagtaaatgtttctttttaaaaaaaaattggggccgggcctggtggctcacacctgtaatcccagcactttgggaggccaaggcgggcagaacacctgaggtcaggaccagcctgaccgacatggtgaaacgtcgtttctactaaaaatagaaaatcagccgggaatggtggcgggcgcctataatcccagctagttgggaggctgaggtaggaaaattgcttgaacccaggaggccaaggttgcagtgagctgagattgcaccattgcactccagcctgggcaacaagtgggaaactccgtctcggggaaaaaaaaaaaaatttggctaggtgcagtgtggctcatgcctttaatcccaacattttgggaggctgaggcgggtggatcacttgaggtcaggagtttgagaccagcctggccaacatggtaaaaccccatctctactaaaaatacaaaaatcagctgcatgtggtggcatgtgcgtttagtcccagctactcgagaggctgaggcacgagaattgcttgaacctcggaaagcggaggttgcactgagccgagaccatgccactgcactccagcctgggcaacagagcgagactccatctcaaaaaaaaaaagaaaacttaggcctatttttaaattttattttcttctatcatttccaggtttatttttcctgtcaaagtaaatttttctggttagcacagtagaaaatttagaaaatattgaaaataaagggaattatgaagaaggaaccacccacgagtccgccacccagaagcaaccaatgttaacattttgacatgtttctttatagtcttttccctatacattttttaatttttattgtttaaatcacatgtgtgtacaattttttaaatttttttttaaattttttttaaatggagtctagctctgtcccaggctagagtgcagtggcgggatcttggctcactgcaatctccgcctcccgggttcaagctattctcttgcctcagcctcccaagtagctgggattacaggcaggtgccaccatgcctgactaattttttgtatttttagtagagatggggtttcaccatgttggccaggctggtcttgaactcctgacctcatgatctgcccgcttcagcctcccaaagtgctggaattacaggtatgagccaccacgcctggccacatgtatacaattatgcactgtactttaaaattttgtttgagcttttgatcaaagtagtgggtgtagcatatcaaaaagtatagagaaattaggccaggtgcggtggctcacgcctgtaatcccagcactttgggaggccgaggcgggtggatcacaaggtcaggagatcgagaccatcctggctaacacggtgaaaccccgtctctactaaagatacaaaaacttagccgggcgtggtggcaggcgcctgtagtcccagctactcgggaggctgaggcaggagaatggcatgaacctgagaggtggagcttgcagtgagccgagatcgcgccactacactccagcctgggtgacagagcgagactctgtctctcacacacacacaaaaaagtatagaaaaatttaggaggaaaagcaatgttcttctgcccctactttccccacctgcaatcccgttcccaagagacaacctcatagttttcgtttcctggtagatgcctccaaaactcaagagaagtatgccaccctttcttggtttatgaagtctatttctcctttaatcaacttacatcattcccttttttttttttttttttttttttgaggcagaaactcgctctgtggcccaggctggagtgcagtggtgcaatcttggctcactgcaacctccgcctcctggattcaaacgattctcatacctcagcctccaaagtagctgggactataggcgcgcatcactgcacccagctaatttttttgtatttttagtagagatggggttttgccatgttagctaggctggtctcgaactcctgacctcaagtgatccatctgcctcggcctcccagagtgctgtgattacaggccgtcaatctctcttgattacctactttgtaagatacagttgttggtgaccctacatccatagggtccttttgtaaccttctgtgaaccattttttcccttgtgggaagtaaatctaaagctgaattttgaagggtgagttagtaaagtaactcatgaagttattcaccacactaaatggatgttgtgtgaatgaatcagaattaggtgaatctagaaggacatttgccgcaaggatgcaaagtagaagggcatgaaattgtatgtggtacattcagagactcttggagttgagtatggattaagtaaaaggtacatttataggggaggggtacattcccttttgtaaccttctgtgaaccataattttttgtttatgctgtcaagtttattaacatatacattgttgttactactctacattgactagaaattaactgtaaatatcgaaaaccaatagagacatctggtcttttaagttaatattatatcataagcatgttcctatgccattgtttataaataatatttttaatggctacaagatatcagttccatggatatacctaatatatatgtaatttctaacatataggctattttcaagtttttacaattagtacatttggagtcaatatctttatatgtaaatgtttatatctctgattatttactcaggatggatcaccatgaaaccttagaggggccaaagtatgtgaggttatacaatgaaaagtttccttcccagccctgttagtagccttctacttacccacctggagtcaactagtgttatcagcttttttttttttttttttttttttttgagagggagtcttgctctgtcgcccaggctggagtgcagtggcgcgatctctgctcactgcaagctccgcctcctgggttcacgccattctcctgcctcagcctcccgagtagctgggactacaggcacccgccaccatgctaattttttgtacttttagtagagatggggtttcaccgtgttagccaggatggtctcgatctcctgacctcgtgatccgcccgcctcggcctcccaaagtgctgggattacaggcatgagccactacgcccggccatcagttttttcatttatcttctcagagacagtttgcacatatacaagcaaatgcatgtatatgttttcctacctccccctccttttttttttaactcagttggaaacgtattttatacgctgttatgtgctttgcttttctctcttaagaatacatctgggccaggcacggtggctcacgcctgtaatcccaacactttgggaggccagggtgagcggatcacgaggtcaggagatccagaccatcctggccaacatgatgaaaccccgtctctactaaaaatacaaaaattagctgggcatggtggcgcacgcctgtagtcccatctactcaggaggctgaggcaggagaatcgcttgaacccgggaggtggcggttgcagtgagccgagattttgccactgcactccagcctgggcgacagagcaagacttcatctcaaaaaaaaaaaaaaaatagttcttgatacttattgcagaagtgttttccagaaaagttgtaccaatttacacttccatccgcagtgcttgtttatgaaatgtatgcaggcattgaacacaccagttaggagtagtatttgattatgagtaatgtctcaagcatccttagtgagtgcttgttctctcagagtcacaagatggctacttcacctccagcattggggtctgggctgcagtcaggaagaaggagaaaagcaaaaggaaaaagggacaggcatgctgagtgctgagcattccctctccccaaggagttttaagttccacgttttttacacatctatttggctgaaattgtgtcagatggccaagactatcagccagagatgctaggagatacagtttttatctaggcatattgctgtcccacaaaatcagtgtttttgttagtaagcaggaaagagaatgacatttggttgagaatgagtagtctctaccatgagggtttttttgtttgtttgtttgtttgttttttatttattttgaaacagtctcggtctgtcgcccaggctggagtgcaatggcatgatcttggctcactgcaacctctgcctcccgggttcaagcaattctcctgcctcagcctcccaagtagctgggattacaggcacctgccaccacactcagctaattttttttgttgtttgttttttgagacagagtcgttctgtcaccagactggagtgcagtggcgagatcccggcccactgcaacctccgcctcctgggttaaagcaattctgcttcagcctcctgagtagctgggactacaggcacgcaccaccgcacccagctaattttttttttttttttgtatttttagtagagacggcatttcaccatgttggccaagatggtctcgatcccttgtccttgtgatccgcccatgtcagcctcccaaagtgctgggattacaggcatgagccaccgcgcctggccagttttttgtatttttagtagagacagggtttcgccatgttggccaggttggtctcgaactcctgacctcaggtgatccacctcggcctcccaaaatgttgggattacaggtgtgagccaccacatccggcttctaccatgaatttttgatccttggtaattcataagcaaacaacagtatctcattgatttaatttacatttttttgattaagcatagcctctatgttttattagcatcagagtttcttccattgtaaattttgtttacatcctttgcccacttatccatgtggttcttcaaggttttcgagttgcccattttatatagtaagggaatagtcatcctttgtttcatacacacacacacacacacacacacacacacacgcacatattttatacttataatgtgcttgtacttcttcctcattctacaggaaaatttgaatatttcagtatcaagtgttgatcatttgtttgcatattcagagagtagataattaacacccttgtattttttaagcataatttttaaatatctaatgtgttgatctacaaagaattgcttaatatatggtactgagcagaagatataaattggtattccccccaaaaagatgactgttggtgctagaatcacattcccactaagctgaaaatgctttctttgccatgtgtactgactcatacgtatcatgggttgtttgaggcacatccattttgtaccatcaaagttctgtctgctcttgtgctggtatttcacttattcactacctatttatgacttagaaaaaccacagacttttttattttgaggcagagtctcactctgttgcccaggctggagtgtagtagcatgatctctgctcactacaacctccgcctcccaggttcaagcgattctgctgcctcagcctcccaagaagctgggattaaaagcacccgccaccaccatgcctggctaatttttgtatttttagtagagatgggattttaccatgttggctaggctggtctcaaactcctgacctcaagtgattagcccgcctcagcctcccaaagtgctgagaattacaggtgtgagctaccacgcccagccaaaaaactgcaaacttttaaaaagtggcttttagttaactaaaaagatagttctttaaaatgaagaagaacaccaagtttaacccaataggatgaaactgtagagcacagatgcatcaactggtgttcatggacctttgaatctcctattaatattctattgaaattttatgtaaatgcatgcatctatgtatgtatatttctttagtaatttttatcacattttcaaagtgagttcttaactcaaaagatgcattctactaaggcattctactaaggggattcccattaagatcaggaataagactaatgtgcccactaacactgctattatttagtattgttctagaagttcatgccagtgtaattagaagtaaagcagaaattaaaaaaaaaaaaaaaaaaaagaaaagaagagaccaaatcatgatgtgagccagtagggtgagaatcctgttcacttttggccatcattgtatctgtagcactttgcctagtgcctggcctgtaggagatgtttaacaaatatttgatgagtgaaagataagatataattgtataatcgatatagaaaacacaggtatggggctgagcatggtggttaatgcctgtaatcctagcactttggaaaggtaagatgggaggattgtttgagcctaggagttcaagaccagcctgggccacatagtaagaccctgtctctacaaaaaatagaaataaaaatagagatatgatataattatgtaatatcagaaaatgaaagagaatcaactaaaaactgctaatactgataagagaattcagtaaattgggtaaatcattggatatataccagctatccaaaaatcaagaagtactatattagtaataaccataatgtactgagaaaaagaaatgctattgacaatagcaacaaacatataaaatatgcaagaataattgtaagaagatagtgtggaaccgacatgaagaaatagagatttcccatatgcctggttataaagactgagtgttgtaaagagtcatttccttccaaattaatgtatacatttaacactagcctaaatcaaaatcctaatggaattttgtggggaattcattctaaaagtaatttaaaaagtaaacaggtataattagcttaaagaatattgggatagagaaagtaaatgaaatatactatagtgctacagtaatcataagcaccagaacagtcggtaaatacttttccttttaaaaaatttttgttatgaaagttttcaaacataagataaaattcaagaggttattaccatgaacacctatatatatatatatatatatatctgtcacccagatttaatgaacattttgctgtatttgctttattctttttttcaaggcattttaagcaaaatcttacgtgttacgacatctctagttttttgctgattttttcttttctttttttttttttttttttttttttgagacagagtcttgctctgtcacccaggctggagtgcagtggcatgatcttggctcactgcaagctccgcctcctgggttcacgtcattctcctgcctcagcctccccagtagctgggactacaggcacctgccaccacacccagctaattttttgtattttttagtagagatggggtttcaccatgttagccaggattgtctcgatctcctgaccttgtgatccgcctaccttggcctcccaaagtgctgggattacaggcgtgagccaccacacctgtccgttttttgctgattttctaattgctctatccattattgaaaatgtggtattgaagtctccagctattattattgaatttatctattttctcccatcagtttggtcagttttcacttcatctattttgagcctctgttgtaaggtacacatatgtttgtaattgttataccttgttgatggattgacctttttatcattataaaatgctcttctttgtctttagtaatgatttttgtctcaaagtctgatgttagtatagccattgtagttttcatttgagtaccacttttattgttatctcttttttcatccatttattttcgacctgtgtcttcaaatctaaactgtgtgtcttgtatagatagcatatagtagggtcatttttaattcattctgccaacatctgcctatcagttggagggttctaatagctgccaaagttcgactcaatatccattttgctatttgttttctatgtgtcttattttttgttcctcaattcctccattagttactgccttcttttatgtttaatagctattttctaggaccccccccgcttttttttttttttgagacagagtgtcactctgtcacccaggctgaaatgcagcaacgcgatcttggctcactgcaatctctgcctcctgggttcaagcaattcttttcctgcctcagcctcctgagtagctgggattacaggtgcctgccatcacgcctagctaatttttatatttttagtagagttggggtttcaccgtgttggccaggctggtctcgaactcctgtcctcaggtgatccacccatcttggcctcccaaagtgctggaattacaggcatgagccaccgtgcccagccctaggatcccattttaattccttttttttttatctctctatatgtgaggggtttttttttgttgttgttttgtttttttttttttgagatggagtcttactctgttgcctaggctggagtgcagtggcacaatcgcgactcactgcaacctccacctcccgggttcaagcaatactcccgcctcagcctcctaagtagctgggaatacaggcacacaccaccaagcctgggtgatttttgtgtgtttagtggagacggggtttcaccatgttggccaaactggtctcaaactcctgacctcaggtgatcggccgcctcagcctcccaaagtgctgagattacaggcgcgagccaccgcacctggccaagttattttcttagtggttgtcctggggattaacaacttaatttataccattctaattcacattattatcacttaatttctttctttcttttttttttttttttgaggcagagtctcgctgtgtcgcccagattggagtgcagtggcaccatctcggctcggctcactgcaagctctgcctcccgggttcacgccattctcctgtctcagcctcccgagtagttgggactacaggcgcctgccaccacacccggctaattttctgtatttttagtagagacgaggtttcaccgtgttagccaggatggtgtccatctcctgacctcatgatccgcccgcctcagcctcccaaagtgctgggattacaggcgtgagccaccgcgcccagcctattatcacttaatttcagtactacacagaaactttgctgctatatagctccattacccttctcttttatgctattactgtcacaaattacatctttatacattgtgttcatgaacacagggttatagtaattgctttatgtaattgtctgttaatccagttagaaaaagttacaaaaatatgttgataatgtcttttaaatatacctatctagttacctttaccagtgctctttatttcttcatgtagactcaattgtctagtgtcctttcatttcagcctgaaggtttccctttaacatgccttttttttttttttgagacagagtctcgcactgtcgcctgggctggagtgcaatggcatgatttcagctcattataacctctgcctcccgggttcaagcaattctcctgcctcagcctaccaagtagctgggattacaggtgcctgccaccacgcctggctaattttttgtatttttagtagagacgggtttcactatgttggccaggctggtctcgaactcttgacctcgtaatctgcccgcttcggcctcccaaagtgctgggattacaggcatgagccaccacacctggccctttagcatttcttataggtaaggtctactagtgtcaaactatttgtttttatttatctaggaatatcttgatttcttcatttttgaaggatagttttgctggatctggaattcctgattgatagtttttcttttagcacttagaatatgtcttcgcactgtcttctaacctccatgggttctgatgataaagaaatcactttatgttgtgagtcacttctgccttgctgctttcaaaattctgttgtcgttggccgggcacagtggctcaagcctataatcccagcactttgggaggccgaggcgggcggatcacgaggtcaggagatcaagaccatcctggctaacacgatgaaaccctgtctctactaaaaatagaaaaaaaattagccgggcgtggtggcgggcacctgtagtcccagctactcaggaggctgaggcaggagaatggcgttaaccctggcggcagagcttgcaatgagccgagattgcaccactgcactccagcctgggtaatggagcaagactccgtctaaaaaaaaaaaaatttctgttgtctttggtttgagttatgatgtgtagccttttaaatttgttcagcttggagttcgttgagctcttgaatgtataaattgtttttcatcaaatttggaaagtttttagttgttatttcttcgaataggtgtccttcagatccctttggctctgttcacttttcttcattctctttttatgtgtgctcatcagactggataatctcaattgacttatcttcaaagtcagtaattcttccttctacctgctcaaatgtgctattgaaaccctctagggaagtttgcatttcagttaaagtttgcatttcagttattttacttttcaacttcaaaataactgtttggtttctttttataatttctgtctctattggtattctctgtttggtgagacatcatactcatactttcctgtagttccttagacatggtctcctttagcctttgaaagcatttaaaatagctgatttaaagtccttgtctagtaactccaactatgtctaggaagtcagggacagtttccactgattgattttttttcttgtgaatggctatactttatttctttgtatgtcttgtaattttttgttgaaaactgtacattttaaatgccgtggcaactctgaaaatcagattttctccactctgctcctcagagaacactctttgttgtagttgtgttttgtttagtggcttttctgaactaattctgtaaagtctgtaaacttttttgtgtgtgcacactgatgtctctactcatttagcttagtagatgtctcatgattggacacagatttcctgaaatgcctggaaccagtgagtgctcccagtgcttgctgaggggctctctatgtgcatgttggagcatgccttcactcagccaggcagtttacaactctgcggtagccttcacttctatttgtgtagcacctcaaagtcagacagaggtgcatgcttagggccttctcaagtcttacagcgccaacacaggcatgtggtcttataatttgcagaaatgcgtgagaacttgtcaaattctttatggatatctcattctttagcttttttttaaccatttgggttaatctattgtttgtcacaactgttatccatcaccttaaacagctatgacattaagcacatgcctttaaaattcttttttaaacacccatcagggagggagaggcttttagtactaggctttgaaagaaagctctagctcctttctgctcactacattgctgggaacttggactgctgtttttcaaggtgttcactaagctggggtaaggtagatgtgtctagggcaagttaaaatgcacaaagctcattgttcttactgagattcagctgtttttcttgaatcaagtgctttccaggttgctgcaagccttttgttaatttccagagttctgaaaaaatttatcctgacaatttttgctagtttttttgttgtttttattggggagtgaattcttggaggtcctttgccatgtttactgatgtcgcccatcataacatctcatccttaatacttaaatatgcattgaatgatattttcttccataaccacggtgccattatatgacacctaagcaaagtaacatttatttcttttttttttttttttttttttttgagacggagtcttgctctgtcacccaggctggagtgcagtggtgcgatctccgctcactgcaagctccgccttccgggttcacaccattctcctgcctcagcctcctgagtagctgggactacaggcgcctgtcaccacgcccggctaattttttgtatttttagtagagacggggtttcactgtgttagccaggatggtcttgatctcctgacctcctgatccacccaccttggcctcccaaagtgctgggattacaggcatgagccacagcgcccggccaacatttatttcttaatatcatctagtaccatgtacttattcaaatttcccccagttgcaccaaaaatatcttttgtaattggcttacttaaaccagaatccattcaaggattacacaatgcatttggttattataagctcttagtcttgttcattatttaaaatttgttaatatgacaattttattttattttttgagacagagtctcactctgtcgcccaggctgaagtgcagtagcgcgatctcagctcactgcaatctctgccctcggggttcaagtgattctcctgcctaagcttcccaagtagctgggattacaggcacgtgccaccacacctggctaatttttttgtatttttagtagagacagggtttcaccatgttggccagcctggtctcaaactcctgacctcaggtgatccgctcacctcggcctcccaaagtgtattatgacaattttattttttattttattttattttatttttattttatttattttttgagacggagtttcgctcttgttgtccaggcgggagtgcaatggcacgatcttggctcaccacagcctctgcctcctgggttcaagcgattctcctccctcagcctcctgagtagctgggattacaggcatgcacctccatgcccggctaattttttgtaattttagtagagacagggtttctccatgttggtcagactggtctcgaactcctgacctcaggtgatccacccacctcggcctctcaaagtgctgagattacaggcgtgagccaccgtgcccggccgacaatttttaaacatatgtaaaagtagaagggatagcacctgaatacccatagtcttaatactcagattctatagttgtaacattttgctatagttgcttgattcctctatctgtatctatctggctatctatagtttttgctgagccacttcaaagtcatcataacatattttacccgatggttcacgcctgtaatcccagcactttgggacaccgaggcaggtggatcatttgaggtcaggagtttaagaccagcctggccaacatggtgaaaccccatctctactaaaaatacaaaaattagccgggcggggtggtgggtgcctgttatcccagctacttgggaggctgagaaagaagaatcacttgaacccaggaggtggaggttgcagtgagtagaggtcacgccactgcgtgactgtgagactccatctcaaaaaaattaaataaggacatccgccattccccggtgtaaccacactacttttttttatacttaccaaagttagtaataattccctaagatcttcagatacccagttcataaccaaatttccccaactgtttacacaaaatatcttttataggtttttttccctcccaaaacccaggtctaatcaaggagggttcttttttccccagcttaaaacaaccaccattttcttatgttcatgtattctgtgggtcaggaatttggaaatggcacaatggcgacaacttgtctctactgcatgaagtctggggtctcagctggaaaaactttgaaggctgggggtgacttgttggccaagagtttgagtcatctgaagtctttcacttacatgtttgatgcctggcctgggaggacacaaaagactgaaagtgccaacatgtggcctctccatgtgactagcttcctcactgctcagcagcctcaaggcaatcaaactttttacatggcggttcagattgctaaaagcatgagtgttccaacaagcagtgtggaaactgaaattgcctttactgaccttgcctcaaaagtcatatagtgtcatttataccatattctatagcttgcaaataagcctgcttagattcaagagtggggcacagatctcacctatcagtaggaaaggtgtgatgggatttggggtcatgttttaaaaccaccacacatacaaaactatagagaacaatataaaagagatccaagtatccatgactgaaaattatgcgtcaacttttggtaaatttgcttcagatcatgttttaaacaaatgttacctttaaagaaagaatttcagccttccgaattgcttgttctagaatctgcatactgcttatccagaaattctcctttataatagcaatagctaaccaaggagtttaaatctaggtcagcagtaccaccacatcttttttctgtgacattagtttttttctttaaaaatataataaggctgggcatggtggctcatgcctatggttttggaggccgaggtgggtggatcacttgaggttaggagttcaagaccatcctggccaacatggtgaaaccccgtctctactaaaaatacaaaaattagccgggcatggtgttgcatgcctgtgatcccagctactcaggaggctgaggcaggagaatagcttgaacccgggaggtggaggttgcagtgagccgagatgaccccactgcactctagccttgggcgacaaagcaagactccatctcaaaaaataaataaaaatagaatagttcattgagctcctatatatccaccagtgagaatgaacagttattaatatattgccgtattggcttcatttatcactatcttgttttttaaatttttttctttgcttgaaagcaaaccccagttattatgctgtttcccccaagtatttcagtatgtatttctaaaaagtggatattttctcaccaaaccttacaacctgttattatacataacaaaactaacaataatttgataattctttatataattccaagtccataatcaaatttcctaaattgtcaaaccatgaaaaggtgtttttatattagatttgtttaaatcagggtctaaacagggtccatgtggcatttgaatgccttttaaccctctcaatctagagcactctccccttttttgttctgtgctattgatttgttgttgacactggtgtaattgccctgtagcatgtcctaccttctagatttgtctgtttgcttacttgtgacattgtctttttaaagagactaagccagtttatcttgtagaatgtctgcttgttttcttctggtgtcatttgtttttctgtacctgtttcctaaacactgaaagtaatatgaatggcttgctatattttagctcttcaacaaaactacttctcaggtgatgtgaatttcctattgcttctcatcaagaggcgtgtgaagttgtgttgtgctttctcactattagtgacagtaaagttcatacttaaagtggtaatctcttgatctcatcattataagttttttcttcttgaggtgaatgggtaatattttggtgctgtgtgaatatccaattccctagaatcaattgtttcattaggacttgccagcttgtggttttctaattctgtcattccttctacatttagtagctggctttcttctgtaaagaagagctgtctctcatcatttagggctgtttggttatcctgaaatacacttccttttgaaatggtgggatgagtatttttttatttcaggttggtaaggcattataaaagagtcatgcaagagggtggtcttcttcaggaactcatagcctggctggtagacagaataacacatcagcattagagaatgagacaaggtggtatgtgctatgtatcaagtaatttatacagatcataagttcaaaggaaaaagagatcagtggaaccaaagaggttttgtgtaggagattgatttcagcttaccttaaagaatgggtaggttttgaataggcagacaaaaaggaagatagtactctaggtggtgtggattttgaggatgaaagcatagggagagaggatgagctgtacacactctggagatgtaataaggaagccatccgtctggagaagctgagaatatggatgtggaaataaggttggagaggtaagtgggccagaagcagaatatgggacaaacttaaatgccagttcagggagattaactttttatttttattattattttattattattattattttttgagacagagtttcactgtgtcgccgaggctggtgtgcagtgatgcaatctctgctcactgcaacctctgcctcccaggttcaagcaattctcatgcctcagcctcctgagcagctgggactacaggcgtgcaccaccatggccggataattttttttttttttttgagatggagtcttgctgtgtcgcccaggctggagtgcaatggcgcaatctcagcttactgcaagctccgcctcccaggttcatgccattctcctgcctcagccttctgaatagctgggactacaggcacccgccaccatgcctggccaattttttgtatttttaatagagacggggtttcaccatgttagccaggatggtcttgatctcctgacctcgtgatccacccgcctcggcctcccaaagtgctgggattacaggtgtgagccaccgtgccggccaatttttattattattttattactattattattattattttttgagacagagtttcactgtgtcgctgaggctggagtgcagtgatgcaatctctgctcactgcaacctctgcctctcaggctcaagcaattctcatgcctcagcctcctgagcagctgggactgcaggcgtgcaccaccatgccgggataatttttgtatttttagtagagacgaagttttcgccatgttggcgaggctggtctcgaactcctggccacaagtgatccatctgcctcagcctcccaaagtgctggaattacaggtgtgagccactgcacctggcctggcttattgttctatttttagagacagggtctcactctgttgcccaggctggagtgcagtggtacaatcgtagctcactgtaacctcaaactcctgggctcaagcaatcctcccacttcagcctcccaagtagctaggactacaggcacatgccaccacacctggctaactttttaattttttgtagtgacagggtcccacctcaccctcccagagcaatgggattacaggcatgaaccatcatgcccagccaaaggaggttcacattttttttctttttccctctgggaggtttacctttatcctttaatcagtgtgtgctttgagcattggtgaattaggttcttatgtgatggcaagcaaaatctggcttcataaaaagctagaagcaggaagaccaatgagagtacctttggagagcttggaggtagggaatatggctagccttcggataaatgtcttagtgacaccttctcatcctgtttcccttgcagcccgcgtgaccccaactctgccgaagcaggaccgtcctgtgcgtgaggggacccgggtagcctctattgagacaggtttggctgcagcagctgcaaagctggcccagcaggtaggtgctgacaccccaggtcaccctgcaactaatagcagtttgacttagagcctcaacacttagacctgcaggctgataggatcccacctttgtctcaatggggattgagtaacctttgatctttatccttggcagtatcccagccccctcttaaatccctcttatcccaactcaatgataagctacttccacaggttacacagttgacatgattcaggatgaaagaaaatattaggccagagaaaaacccacttaccttttttggtgtgtaaaaacctctcagatgagaaggaccagatccttcctttgctctcatatgaagccctgagggggtgactcagctgagtacgctcaagttctcagccacccaccagtattggaatttggttgattagaaatttttcttgtcctctttatgaaataatattatcttaatcttcacccacaaattttttttttgtcctaaagagtgatcttcactagaatcaaattcatctcctagcattacatctaaaagttctttaatgtgcgtaatgtgcttaggagcctttggaggtgaattctctggttatcttgcaatcaatatcccgttagctcctaatcccatatcctatagcttagagcactgttaagcatctgctttgttagttgcttccatatataatgtgtaatgtaatctatctgcccaatagccctgttcaacaggtgatattttcatcattttataggtgaagaaaatgaagctctcattaactgactcaggataatacagccagtaaatggaggagacaactcaaactcatatcctctaacttcaaatttcatattactttctatttaaataaatgcttatgtagttcagtcattacatcctatttaaatagtgtttaaatctttggcaatcttctttgaccagaacttctgtctcttatgtatatcccaatacagtgtaagctgtaatttgaaaaagggggttctactgttttatataaatataaattaagtaaagctgtgaaaattactcttagtgccttttaaggagctaaattctgtttgggatgatcagagataacctcaaagaagaggttttgaaattggggaggggctttgcaagctaagcttctggtaggggccagggaggcattctaaaagaagggacttccttcgtatagcacacaaagccctcttaaagtcctcttgatttggtctctagtcatctccctgacctccttccagcccctcatgcacaccttttatacagccatagtgcactgcaatactcatagtcccctcagtgagtatatcagattgtctcatgcttttgtgcctttacacaagatgttccttttacccattgagaatcataccctatcagatcccttacctaacagcccttcatactacctaccaccactttatttcagaggcctttttctatatgcttctacaacattcgtggtacttacaatcataaatgtatgttttggtgtttcttattaaactatgaatacttcaagagtgggaatatatttaatttaacttggtatccccactatggtcagaaaatgtgtttagtcagtattggggtgggtgggtgagtgaatgaatgaatgaacgaaagaaagaaacagatctttctgtattggagatttcatgttggggaattagttaaaataagtaatgattataagaatggattctagagtcagcctgcttggatttaaattatgtaatagttctaccatttgggcaagttaatttctctttgcctcatttcctcatagacttcattttaggattaaatgaggtaatgtacgtacaagctcttttagaatggcagttgttatggagtaagtactataggcctgttagcttttttcatcattatcattatgggttggctaagtgtaaacagccagactgtggaagatcatgaatgtcaggccagggagtttgaacttgggcggggatctgctaacagctttttgagcaacgggattggcaaggtgaaagtggttctgtcataagatggtctagttgtctgtgggagtatctggataaattatatgtgaaagagattggcagcaaaggtagcaaaatttaggctagtgatctagatatgaagaggtaattctggatttaagtgagagaaaaagggacagaaatgcagttcctggtatggttagaatagcagtttggctgagggaagagattctgaagccaaatggcttggatgtgaatcccagtttgaccacttactggtcctgtaaccttagggaaatgacttagcctctctgtgccacagtttcttcatccttcaaatgggattataattcttacttcttgggtatttacaagtattaaatgagtaattatagaagagtggttgacatgtattactaatattgttattattgtaccccagaaatgcccgtggtagccacagcctgtgagatcttccgaaggcaggattaggcttgtgttgccaagagaaggcaaaaaaatgtgatcactgagttggtttgtgtggctgtgtagcatttcagaaggtgaagtgatttacatgctctcagcaccacctttccaggttctcagggctccagatgcccactatacaagtgtccaccatgcagtggatagtagatccatagggcagtggatggttgaaatacaaggtattgggagaagtgacacaactccttatttgtcattcccatccccaaagtgaggtttttagacccagtgacctggaggattgtcaagcccactgttaaaagaaaaagaccagcaagaggaagtgaagccattataagagatgaagatagaataataattaaccacttgtcgaatatctactatgtgctgtgtatttttatgtcatcacttaatcttttcaaaaatcctaaaaagcagatattattttacctgttttatagatgaggtagctgagattcagaaaggttagtcagtttgaccatagtcatccaatttagggacacaagcctggatttgaaccagatttatctcattccaaaactaataatctttctaatctttctacgctcagattttccactttgagaagtttgcaaggtgtctcttcagatagacctggttagatagtggtcccaactacttttcagctgtgaggctttgggctcaagttacttaatatccctgcacttccattttctcatatgtaaaattaggattttttcttcttagagctgttatgaggattaaatgagataaagtatataaagtgtctcagctgctgatgtaaatttagttattatcattagacgtgtccaaggtctacctcattagtggcaacactaggaccaaaatcctagtctccaaattcatttacagctttcttggcactgtactaataagtgacagtggtgacttaaggatggatggtaacaaagagatgatctcaggtattggaaggcctgttatgtgctgtgtgtacatccaggctagacttggtgcaggtaagggagagggtggcaggttgcacaaccatattggacattgtctagttagttcctttcctgggaacttgtcttcttcactccttaatctctcctcctacttggcttgtgtttcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggtacaacggccatatggttgtagaaccgaaggatcttagagccacctgccctaaatcctaagtgctctagtagatgacaataccagggagggacactgaaggccaacctaaggtgcttggatttgatcttatgggccatggagagatgttgactgatttgaagtacagacaagatcaggttttagttttgaaagatccttctggtggccagaaggaggtagagggtgggctagagatgggaactctagggaggaggcacatatacaagttcaggcaggcaggaagagtacctggggctctgccagagggaatggagaggaaggagatgaactgatcaaatatggaggcagtcaaataggacatgggaggggatttaatgtggggagacagagacaacaaagagttagaggactgaagccttcctttccctcactttggtcctcaaagcccagtccctagagtacgcagctcaagggcatggaggttggtgtgatgttgaaggctgatgaagatgagagtttctaatgaagcaaggccctagggatggcaacttcagggacactgagctctaatcactaaccaggcacttgtccagtcctggtgggtaggataagagggtatggaagtacatttacctccctgcaggatcttggaaggaaaatgattgggaccagagtaatcagtggagaaaaagaactagacaaactgtaatcagggagtcttgctgctacaggaggtcataggaggaagagtcaaagcatgtggtgttggttggaagtagttaaggagggcttcctgcccaatatggtctaaggatggagaaactttgtgggtagagaaacaggaaggggaggtggcctgagggcagttggtgccagatttgatgttgaagcccttgccaaagcccttgcttacttttcccttcccccacaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttgg

SEQ ID NO: 4622 - DNA, 107492 bp, human; identical to SEQ ID NO: 4621

SEQ ID NO: 4623 - DNA, 165180 bp, human; identical to SEQ ID NO: 3420

SEQ ID NO: 4624 - DNA, 165182 bp, human; identical to SEQ ID NO: 3421

SEQ ID NO: 4625 - DNA, 135349 bp, human; identical to SEQ ID NO: 3419

SEQ ID NO: 4626 - DNA, 165180 bp, human; identical to SEQ ID NO: 3420

SEQ ID NO: 4627 - DNA, 165182 bp, human; identical to SEQ ID NO: 3421

SEQ ID NO: 4628 - DNA, 50712 bp, human; identical to SEQ ID NO: 3422

SEQ ID NO: 4629 - DNA, 47079 bp, human; identical to SEQ ID NO: 3423

SEQ ID NO: 4630 - DNA, 49341 bp, human
gaacaacagatccaggccagaggtggcatcatgtctgggtggaggtacctcatctgtgtcagctttttgctgaccattcttcttgaactgacataccagggaccccctgtccccgcttcatcaagcacaaaggtcagttctgggatgagggaaaaaagcttggggatttgtgataaaattagcttcttgggggaaatttgggaaggttattcagtgtgtttcttcagtcctatgactgagaaactagagccagagaaaagaggtactatttgctgagcacatgtcaggtgctgcaccaggggtcccagaattattatttcatttagtcctcacagcatctctgtgagctgggctatattattatccccattatagagaagagaaaacagaggttccaaggttaagacacagttaggaagtggcagaaccgtctgatctcaaatcatcctcatttcccactgccccacactgggaaggaactagctctgcatcacgtgtgggtagatagagggaccattgcctcaagaaaggagaggaagaagatagatattgtacttgctgtgtgccctcatcatggatgccagatacttaccatgcttgcagtgcatgattgtgcttataagtgcaactctttacacctgagatcctaaagaagaaaaaaatcagtatttatcacagtgccttggacagagtaggattcaatgaatggcggatgctctgctatattctaaagccttgctactcaaagtgaaatctgtggactagcagcagcatcattccatgggagctttttagaaagataaaatctcagccttcaccctagtcttgctgaatcagaatcttcattttaacaagctttccaggagattcatgtgcacatcaaagttagagaagtgcttgtccagagaggtcccttgatctctaatcttctgtgagtcttgggttctgagacttgataaagcttgctgaagtaatcaggcagatccaccaaatggatgacagaggttgttttccctctctaggccttagtttatccacctgtatactttgaggcctgtgtaggaatcttgggttcccaaagactagcccatctaggctgaggacatagtctacctaaaacacctcctcctgtcttctctctcagttgttaatgacaagctattctatgcgctccacggtggtgtctcgctatgcccacaccttggtcacctctgtcctgtttaatccacatgctgaagcccatgaagccatctttgacctggatctgcctcatcttgcctttatctccaatttcactatgtaagtctgcttccaaagtcaccacttcattcatttgtgcatatatttgttcgttcttgtgcttattctgtcagcagagcatagtgattaagacaatgcactctgagatcagacttcttgagtctgaatcctggctctgccagtttgggacccagggcaagttacttcatttctgggagtctcattttacatatctacaaaatggggataaaattagaacccactttctttttttctttctttcttttttttttttttgacatggagtctcgctctgttgcccaggctggagtgcagtggcacaatctcagctcactgcaacatccacctcccaggttcaagcgattctcctacttcagcctcccaagtagctgggactacaggcgcatgccaccacacccggctaattttttgtacttttagtagagacggggtttcaccgtgttagccaggatggtctcaatctctgacctcgtgatctgcccacctcggcctcccaaagtgctgggattacaggcatgagccaccacacccggccagaactcactttcaaggattaaatgaactaatatacatggaaacatatgctaaaattagctccaggcacatattaagtagttgataatattagctttattgctttttaaacaaacatttcctggtgctgagtgtgtgacttacactgtgctgagtccaacagaaagaggaaggtgaactgcatatagtccctagcctcagagagttcacaatttaaggggggatataaaaaaggaaactggcccagcacagtgactcacacctgtaatcccagagcttcatgaggctgaagtgggaggattgcttgaggccaggagatcaagactagcctgggcaatatagggagaacccatctttagaaaaaaaataaaaattagcagggtgtggtggtgcatgcctatagtctcagctactcagaaggctgaggcaggaggattgcttgaacatgggaagttgaggctgcactgtgctatgatctctgcactccagcctgggtgacagagtgagactgtctctaaaaaagagcattgggttggggagcagtgagcagattactttaataaagtatgctggggaaaactgaagtctgaatgtggaatggttggaatggtgaggtggaccagaagacaatggtgggtttcctattcccaggctggtggagaaaacctcagagagataacacctaaactgaggcttgaaataggacatcttcaccaggcaaccagggtgagggcaggactggaggaatccaggaaaaaggaataaaggcacaaatgttcccttaattaggggaactgcaagtacttctgtgtcactgtactgtcagggacagacaagaggtagaagagtggtagaagagtgagatgtgagaggcagagaaagactaggctgtggaggactttcaatgttagagcacctccttgggtctcacttaatggtctccaaaccatcttatgtgtttgcacacctatcaggaaaaacttgatcctatactctcaaaacatatatacttattcatttatgcattatataaatatactgctgagcaaatatattaggtacattatgaagcatataaatattaatccctaaaggataaggaaaaagccctaaaatagagtatgaatattatttttccactccctttcgatttgtctccagcatcccctgggacatgtgcacccctctttagaaataagtgtgggccataataaggagacatggcaaggtgttaagcaaggagaggtgattgtgaagtggtagcagactggaggggccggctaggtggccaggagctgagtaggcaaacaggggcagaatccacgtaggagttgctgaaggtgggagcaggacagtggtggtggatctgagagactatcgaaagagaaacaacctgactgtagtggagagtaagtaaatatagatggtgtttaccttttttcggcttgttagacctggtagatgacagtaccctgttgaggtgataaacaagggagctggagcagataaagggaaagcttagtggggcctcagtagccagtatcacactttagtgtgaattacaaaaaggcccctggatttgggtagagggactatcagatttaccagataagtgagcccagcacaagcagaatatccacccttgttcagccccgcttgtccctgttagttgggaggaggttcttgtgccatcaataatctgtacaacctcaaacagcagccctggggtgggcctaggctgtgccatcaagaacctcctggcacttcccctggagaaggattgggttagaggaggggattggtatggagtcagagccagggaatttgggggagaagtgctgaggcagtcaaggagggctccctgaaagcaggatttccatatgggtaagatttgaagggaccaagatcattgcatgttgggacccaggggaatcaaggaccaaaaagagcaggcgtgggtttggactatggggggctaaccagagaagctggcagtcaaatgatgtaagggccaagtagtcaggcagaatttggatttttgcttcagttgaaaaaaacaccaacagatttttttaaaaaaaattaagcaaagcaggctggaggaaatgttcttgggcagactctgtggaaagtatgctggctggaggcagcacacacacagaggccccagtgtcctgctgccagaccagctccaccctacccccctcaccccccaggagaccttggggaggtgccaactcggcccacccccacactagcccagccacagcaatactctgtttcaactgcctagaaacacttcttccctgagtggtctcttctgccaccagcctatcttcccccagtgctcctggaagctgctgccttggtcaagcaacttcctgatacctgtgcctcagttactccacttgtaaaatggaaactgttgtacttgcgtcctacagagttgcactaactttctctaggacacccaactatcactcctcaaaggccagctctgatccatccttccccttttcaagatttgtccaagactctccattctccacggcaaaaagtctttgctgctgtatgagctcattgagtcttgtgttcaaagccccctattctctaggcccactcaaccaccccaactttctctccatacctcccttccctgcccctccactccagtcaaatttaactacttgctgtcccctgaaacacattctgtgttttcctgctgtctgtccaggatgtccactccacaaataattgttgagcacctcctctgtgccaagccatattccagacaccaggggtacagcagcaaataaagtggtaagaagtcagtcagattgtggatgtcttctaaagatggagctgaaaatccctgatggattggatgtggattgtgaaacaaagaggagaatccaacatgactctaagatttttagctgagcaactatgtcctgaaacaaagataccagaggaggagcagatttgggaggggagagttgtcaggagctcagttttggatctgttcagcttgaggtgtctatggaacatcctagtggagatgtcaagtaagaaattggttttttgttcctgtgacagtttactgagaatgatgatttccaatttcatccatgtccctacaaaggacatgaactcatcatttttatggctgcatagtattccatgatgtatatgtgccaccatatgtaactaacctgcacattgtgcacatgtaccctaaaacttaaagtataataataataaaatttaaaaaaaaagaaattggatgggtctgaagttcagggcacaagtccacactggagatacatatttgggaggcatctgtatataaatggtatttaaggccatggtgctaaatgacatcacctagagagccaatgtagaaagaatagaggacagaaggggagagggagggaggggagaggataaaaggttgacaacagagccttggagtgttccaaagatttagaggttaggaagagaaagagccaacagaggaaactgagaaggcatggccagtgaggattatttatccatatcctccctgtctttcaggcttagcttcaagactaccttctctaggaccctttcctgaagacttgggcaaaagtgttctctcccttctttgagcttcttttcactttattaccttccttagagaaatggggagaatgggggtaagcaagtctgcttgtaactcatcagtctctgagctccctgaggacaaggcctcctccctagtcaggcccagaagactttgcaacaatttgcacacttctttcacaatttttaccacttttaccacccacagtatttacttaatatatttttatattaatatggccatattatttacccaatatattttttcaatagatatactttctgagatgatctgagttagttttattctgagcaacaatatctatgagatcatgggtttaatgtgctagttgtaatttaagaaacattactgtaaatacataacaattataataaaaatattcggttatatcgtacctaaaattatgctgtgtgccaaaaggtagaattcattcaacactttgggaaacacaagactctaacaaccagatccaccatatgctgtgtggcctctatttccccatctgacaaatggagataatgataactacttcactctgttatctccctctcctttcctcttcttctcttcttgccgctcacactggggctttatggcactgtgttgttctttctctttccctatctctaccctcctctttctacctcatgtgtctctttctctgtctctgaccaactctttattttctctgtctctactgtccctcctctttcctgccccattaggaccatcaacaataaagtctacattgcagaagtcaaagagaagcaccaggcaaagaaaatctatgaagaagcccatcagcagggaaagacagctgctcatgtaggcatcaggtaaggccccatccagtccaaaacatgacttaatcatcttagctgtgtgatcaggggagatgcacgttctctctggtcctcagtctccatctctgcagagtggggacatgacctctacttcacaggatcatgtgaagatgatgtgagttaatgaatatcaaagcctgtaacagggtgggtgttcaataaatggaaatttacttccccatttctacttttctactgtcagcagattgtggcttatttaagaattggcaccttccaggaaggttatatgcaagtgagatttttctaaattgaattttgtttcctgagttccattcagcgggcagaaatgtattgtcttccttcagtgtttcctcccagcttccaagagagtttcatggagcaaacactttagctttggctccagcaaactgagttactgccatataaacaagctccttcaaaagcataggggagaggatagtaggagggtctatttgaaggggctgaggcattgtatgtaaattgaaaactcttttgtaaaatgaatcattagaccctagttggtctgttatatattcagattttgatggactaagttcccttaagggtggaccacctgtgagataatttctcaagcagaatatttaggaggctgaatgagggagggagggagagagagactgataagtggatgcatggatgacggaccatgagccagtgactcagttgaaccagaagcctagtcaggtcggctgggaccagggttggggggagcaaaactaggtcatctaacagcccctgtactcctctgaaggtccctttctcttcccaccatcctccctttcctgcccagggaccgggaatcagagaagttccgcatctccaccagcctggcagcaggcacagaggtgactttttccctggcctatgaggaactgcttcagcggcaccagggccagtaccagctggtggtgagcctgaggcctggccaattggtgaagaggctgagcatagaggttacagtgtcagaaaggacaggcatctcctatgtgcacataccacccctgaggaccggccgtctgcgcaccaatgcccatgcaagtatgtgggcagcactatgggtcacccatcagactggccttcactgaatgaaaaccttatcgattccactgggtttccctctagtgccacttctgctctgtactcactgccaagttccttcctgattcagtgagaagagggcatgtttgaaggtgaaaatatttggattttaaccttggcctggtccttacaggctatatgacctggcacattagaaacttcccagactcttgatttccctaaaaaaaaaaaaatcagtgataagggagggtttgttgggtgggctaatgaaattaaatcatatgttaaccatgttgaaggctgtagaagccacactggccaaatcacgcttttccctggatccccactgagaatggcaggagagtgagtgcacagcaagtgcaggctccctggaggacaccatctcaggccctggagggaagagaagcatcctgcctcagaagtttgcttcaaatgtcacctagaggttttggaagcccagactggctacatcagaatcacaacatgggctcctagaaatgcagattcctggagcccagccttcagggtctggttcagtagcatgggggtggggcccaggaagctgtgtcatcaaccagtctcaggggacattgacatccagccaggttggagaatcacggagctggcctgctcacctcatctgagagatgagaggacaggtgcagagaaatccctggctcatgtggcagcccctccaaagctgtttagcattggaggtcccaactcattcgactctgttgacccagagaggcactggggtggacagtggatgtaacagacacagacagacacacagactggatccaaatcccagtgctgacactcccctaatgtgggacgatcaaagccagtcactccattgctcgacttcacttttcccatctgtaaaatggacgagatgccatctacagctcaggaccactgtgagactttgagagaattcctccctcccaactacgtggtgcagagaagattgcacgatcattctactcattagcattaggtggcactcactgagatgcaggtatggctccaaacgctttacatgaatggcctcatttatttcccacaagcactgcctatgaagtaggagctgtggtcatgcctgtgctgtagatgaggagccagaggcttagagagaatgagtcgcttgtccagggacacacagcagcagctggaacctggacccacaggccatttgagtccgggcaggccgcactcttcagccctaagctataaatggcagatccctcccccattctccttaaaggttaaaacagagggtaggaccaatcctgtgggggagaaaacagaacaaagagctctgagaggaaggaagccaagggaatgtatgtgagcaggcgcctcagagagtatggggctcagtgtgcccctgagcttcctgacagctgtggcaggaaggagggggagcagaattcccaagtttccattttctggaaaaaaaggaggcacagtgacatttctaaatggacatttgtcttggattccagaggagttgatcttgtggccagctcagcaaacatccgggactagagagtcatctgtgatttcatgagactctaaaaggcttgttcacacacatgatgcccagagtcagaaggcagagagggaagaagaaatatgaaatccgacccagaggacaaccttgctaggctgctgtttcccacagcagtgggggaatgagaggagacctagaccttgtctgtgtgtctgtctgtctgtctcctggacacacactgactgcactgcctctctgggaggaggcgagggctgctggcgtacctccggacatgccacgcctccaaagacttggccccaggttgcacggaaaatgaagcagggtgaggttgccagtgagggccacattgccagggcctgggagctgatggccaggttgggtctgtccggctaggctcaatggaggatgcagagaggagctggctgtgggactgggagaggagcatggggcaggtggaaagatgtaggcaggaggcaccagaggtttggggaagagttagacttctcaccctccccagatagcaccctttgtgctgccctttccctggttcttctgtcttgcgagtcctctgtaccaccccgccccgatcctccccacccatacaggtgaggtggattcacccccatccaccaggatcgagaggggagagacctgtgtccgaatcacctactgcccgacattgcaagaccagtcgtccatctctgggtcaggcatcatggctgacttcctggttcagtacgatgtggtcatggaggacatcattggagacgtgcaggtgagggggcctggggaagaggagagaggatgggctctggagtcagacaggcctgagcattaggcctctccagctgttcacaccagtttccctagagataagcaagggctagggaacaaggataggctgacgtgaaaagacacacggcttcaactttgggaggcacatcaaatcccccaaagggttggagacctggaactgtctccagtgaatcaagtgcccaaaggacccatccctaactgaatcaagtcatagcctactcgaaaacagtccttctgcaaagtaaacccttggccactaattgggcacctaagcttatggattctcacgcgttctgcagctcctatactctcctgtgttctcttgggcttccttgctctctctcggcttttaacaatccttattgcttcagtggagccatctgcctaaacagagagtccttcagttctgagtttccacattcatgaagaaagagcagaggtcccacactctcccagatgggaaagcacagagcaccgatcccagggccctggcttgagcacaaggatggcggggtagcctgagacatctggttccactctgcctctcccaccacaggactctcaaccccagcacacaaaccaccctccagctgccccacaccatatcacacctttctccaaaacacccaagcctgcctctcctctgtgtgaggatttgttcatagtggccgctgccctgagaatgacttcttcctccttgctccactgctcagcatcctcgtgttcctgaaacactgccgaaacacctcctccttgatgactccagtccaccaacaattcgtttgtctgccctggactaaaaatgacctatggttgaacgttttctcatgcaacattcattcattcatatgttgaatgaatatgtgaactaggccagtcctgtactcattgactctgacaactcagaagtgagtcggacacagccactcatctccctctgccatcaccccatcctgaagcacccagatacacagagccttgtcggtcatcaaatgttctaggtgctgtgtttgagtgtgtcatggattctgcagaggtgccagtggaggagggtttcagggccgtcatcctaaaggagttggaatttaagtaagcatgggaaaaatgaattggatatatctgcaagtcagtcagtcaggtgaagggaaagacatgcagagagaaggaacagcatgtgcagaggcacagaggtgtggctcagtctgttgtgcaggaggaataaaagttattctcctgccaggataggagccaagggtaccttgccagcaggtggcagcaggggctttaacctggtgttctgtcatgtgggtgtgtttagctcatggaggtatgcctctgcaggtttattctttaccattaacacagctgcctgcagttgaaatacagatggaaggcattgactagtacaaccaggaactcccatgcaccgtgagcccttacccctcctgacaccccgccaggaacactcagttcatcccccacttcctacttgagtgtgcccttcgttcaaagcccagcacatcatcagatcatccaccccgctggggctcactgggcacctaatctgtgtcataccttgagttggccaacgttgggaacccggaagggtatcacacacacagcctacttatcgtctctgagtgagatgcagaaacccaatactgacactaaggtagaagtgccctttccatgacacacaaggtaagatggaagccataatgaagaggaaagccagttccagaaggctccctgaaggcaaccaaggctgacctgtgtgttacggaatgaataaaagtgggccatgggagggggcctgtgggagggaaaggcattccggcaaagtgggggccgcacgagaaaagaaacaggctaaaactcaccaaacgtgtgtatggaattgcaaatagcttggcgttctggagcagagatttgagatgaaaaacccaaagagccacatagaaggctggagagtcctgcagggcaacgaaaggaacatgggatttgtcctgtaggtgaccagggagccatgagataaaatgacattgtgaggtcgtgtttacagggtcccagccactgcctccaagcagcatggatgggagaggtcgcagtagaagaaggaaacctgagacgaatgaggcctgagcttgggctttgtcagttagggatgaagaggagggtggcctggagaagtatccagcagagaaaagcaacaggaggctgattggctgtggggaatgggggccacccgaggattgaaggcaacactcagatttgtctccagagtgaccatgtggatgatggtgcccctgaccaggaaggcataaaagggccacgtgggggcagtacaacgaattcactgcttgggcaggatgcatcagaggcttcttgaaacatcctggggcacatgtccaacagtgagtgtgcacccactggtgaggggcaactgtgggagccctagacgggagaagagatgcagagtgattgataggggttctgtggtggaagccaagtgacaaagggaggtcacccagggagcatgtgtggagccagaagggaaaatccctgaaggcaaagctaaggtgaagcagcccaatccagcagctatggataccctcagctgccccatcaactgcacacagctgcccagagccccagtccccagcagttcactccactgagctgcaccagcataatcattttcttttcatgctttgacctgacaaataatgggaagcactgcgaagggagtgggcagacagaggcggtaggagaataaggagagttcactgtcgcagatcgcaggggaaacgacttttgaagacagcagaagtcatccatgttcaactgtgacattcatgggccgggaaggcagtcccaagagactcaaaatacagacattgggtttgttttttagtaaagttgttacttttaatttttgagggtacacagtaggtgtatatatttatgggttaagtgagatgttttggtacaggcatgcaatctgtaataatcacatcacacggtaccgattccctcaagcatgtatccctgtgttacaaacaatccacttaatactcttttacttatttttaaatgtacaattaaagtattattgactatagtcaccctgtcttgctatcaaatactaagtcttatccattatttctcacttttctttgtacccattaaccatccctgccttccccaccccccatctccccgctaccccactccccgcagcctctggtaaccactcttctactctctatctccatgagttcaacggctttcattttttagatcccactgatgagtgatctaaaaaatgcgagatttgtctttctgtgcctggcttatttcaagtcacataatgatctccagttccattcatgttgttgcaaacgacaggacctcattcttttttgtggctgaatagtactccattgtgtatatgcaccacgttttctttatacattcgtctgttgatgaacacttaggttgtctccaagtcttggctattgtgaacagcactgtaagaaaaagaagggtacagacatctcttggatacactgattttctttatttggggtatatacccagaagtggaatggccggattgtatgatgaagccctaatttttagtttattgaggagcctccaaactgttctccatatggttctactaatttacattcccaccaactgtgtatgggggtcccttttctccacatcctcgccggcatttcttattgcctgtctctgggatagaagccattttagctgaggtgagatgatatctcattgtagtttttgactttcacttctctgatgatcagtgatgttgagcaccttttcatatgtctgtttgccatttgtatgtcttcttttgagaaatatctattcaaatcttttgcccttttttgattggatttttagatttttttcctatggagttgtttgagctccttatatattctggttattaatcccttgtgaaatgggtagtttgcaaatattttgtcccattctgtgggttgtctcttcactttgtttatcatttcccttgcagtgtagaagctttttaacttgatgtgatcccatttgtccacttttactacggttgcttgtgcttattgggcattattcaagaaatttttgcccaaaccaatgccctggcgattttcccaaggttttcttgtagtattaatagtatcatagtttgaggtctgagattgaagtctttaatcaattttgatttgatttttgtatatggtgagagagaggtctagtttcattattctgcatatggatatccagttttcccagcaccatttattgaggcgactgttctttccccaatgtatgttcttggcacctgtgttgaaaatcatttcactatagattagtgtatttgtttctgggttctctattcctttccatcggtctatgtgtctgtttctatcccagtaccaatctgtttttgttgctatagctctgccgtataatttgaagtcagataatgtgattcctccagttttgttcttctggtttaggatagctttggttattctgggtcttttctggttccatttagattttaggattgttttttcaatgtctgtgaagaatgtcattgcgattttgatagggattgctttgaatctgtagattgctttgggtagtatggacactttaacaatattgagtcttccaatccatgaacatggaatatctttccattttttagtgtcctctttgatttcctttaacagtgttttatacttttcattatagagatgtttcacttctttggttaagttaattcctagtgtttaattttgtttgtggctattataaatagggtttctttttaattttctttttcagattgttcactgttggcatatagaaatgctactgattttattttgttgattttgtatcctgcaactttcctgcatttgtttatcagttctaatatattttgtgggatctttagggttttccaagtataagatcatatcatctgcaaacaaggataatttgacttattcctttccaattcagatgccctttatttctttctcttgtctgattgctctaggtaggccttccagtactttgtggaataacagtggtgaaagtgagcatccgtgtcgtgctccagtccttaggggaaaggctttcagtttttccccattcagtatgatactagctgtgggtctgtcatatatggcttttattatattgaggtatgttccttctatccccagtgttttgaaggtttttgtcatgaagaaatgttgagttttattaaatgctttttcagcatcaattgaaatgatcatatggtttctgtccttcattcagttgatataatgtatcacattgattgctttgcatatattgacccatccttgcatcccagggataaatcccacttggtcataatgatcttttgagtgtgttattgagttaagtttgttagtattttgttgaggacatgcacatccatattcatcagagtcgttggcctatagttttcattttttgatgtgtctttgtctggttttggtatcagggcaatactgaccatgtagaatgagtttggaagtattccatcatcctctattttttgtaataatttgagtaggatttgtattagttattctttaactgtttggtagaattcagtggtgaagtcatcaggtcctgggcctttctttactgggagatttttttatcatggctttgttcttgttgcatgttattgttctgttcatgtttgaatttcttcatgctgcagtgatggttaggttgtatgtgtctaggaatttgtccatttcttctagattttctttttgttaatttaacttttaagttcaagggtacacataaaggtttgttatataggtaaatgtgggtcatgggggtttgttttacagacaccccatgttgtcaccccagtattaagcctagtacccattagttatttttatttaattattattattattattttgagacagagtttcgctcttgttgcccaggctggagtgcaatggcacaatctcggctcaccacaacctcggtctcctgcgttcaagcgattctcctgcctcagcctcttgagtagctgggattacaggcatgcaccaccacgccctgctaattttgtatttttagtagagatggggtttctccatgttggtcaggctgatctcgaactccttacctcaggtgatctgcctgcctcagtttctgaaagtgctgagattacaggcatgagccactgtgtccaaccccattagttatttttcctgattctcactctcctaccaccctccagagggtgctctgacaggccccagtgtgtgttattcccctctatgtgtccatgtattctcattatttagctcccactcataattgaggacatgcagtatttggttttctgttcgtgtgttagtttgctaaggataatggcctccagcttcttctctgttcctgttaaaaacataatctcattgttttgaatggttgcatactatttcatggtgtatatgtaccatattttcttatccagtctatcactgatggacatttaggttgattccaagtctttgctattgtatatagtgctgcaatggacatacatgtgcatgtgtctttataatagaaaaacttacaatcctttgattatatacccagtaatgggattgctgggtcaaatgctatttctgattttaggtttttgaggaattgcaacactgtcttccatagtggttgaaccaacttatgctctcaccaacagtgtttaagcattcccttttctctgcaatcttgccttcatctgttgtttttggactttttaacagtagccattctgactggttgtgagatggtgtctcattgtggttttgatttgtgtttctctaatgatcaacgatgttgagctttttttcatatggttgttagccgcatgtatgtcttcttttgagaagtgtctgttcatgcctttccttactttttaatgtggctgcttgttttttttcttgtaaatttgtttaagttccttatagatgctgcatattagacctttgccagatgcatagtttgcaaacattttcttatgtctgttcactctgttgatggttttctttgctatgtagaagctgtttagtttaattggatcccacttgtctctttttgcttttgttgcaactgcttttggcgtcttcatcatgaaatctttgccctttcctatgtccagaatgctattgcctagattgtcttccagggtttttatagttttgggttttacgtttaagtttttaaaccatcttgagttaatttttgtatatggtatgaggaaggggtccagtttcatttttctgcaaatggcttgcctgttatcccaccaccatttactgaataggaaactctttcctcattgcttgtttttgtcaggtttgttgaaaatcagatagttgcaggtgtgtggccttatttctgggttctctagcctcttctagattttctaacttattggcatataattgctcatagtaggcattaatgatcctttgaatttctgcagtatcattttgtaatgtctactttctcatctgattttatttatttggatcttctctttttttaactagtcggggtaaaggtttgtcaattttgttaaacttaaaaaaaaaactctttttgtttccttgatctttttattgttttcgtcacttcaatttctttatttgtgctctaatctttattagttgtttccttctactaatttagggtttggtttgctcttgcttttctagttccttaagatgcatcattatgttgtttacatttttcttcttatttgatgtaggcacttacagctataaagttccctctgagaactgcttttgctgtatctcataggttttggcatgttgtctttacattgtcatctgttttgagaaattttttaatttctttctgaatttcttcattgacccactgttcattcaggagcatgttgtttaatttccatgtatttctatatcttccaaagttccttttgttattgatttttagtgttattccattgtggtcagagaagatgcttgatggtatttcaattgttttgaattttgagtcttgctttgtgacctgatatatcgtctgtctttgagaatgaaccatgtgctgaagaaaagaatgcatattctgcagccattggatgaaatgttctataaatatctattaggtttctgatctatagtgcagattaagtctgatgtttccttgttgattttctgcctggaagatgtccagtgccaaatgtggggtcttgaggactctagcgattatcatgttggagtctatctctccctttagctctaataatatttaccttatatatcttggttctccagtgttgggtacatatattttcacaattgttacatcctcttgctaaatcgacccctttatcattatattgctaccttctttgtctcttcttatagattttttctctgtatggctcctcctcatcttttttgtttgtttccactggcatggaatatcatcttccatctctttatttgtagtctatgtgtgtcttatagatgaaatgtttttcttataggcaacagatcagtgggtcttattttttttaatccattcagtcactctatgtcttttgattggagagttaagcccatttacattcgatgtgattattgacaagtaaggacttactcctgccattttgttattggttttcctactttttgtggtctgctcatccttttttttccttcctgtcttccttttagcaagattattttctttggtaatatgatttagtttcttacttttttattttctgtgtatctgttgtatgttttttgttttgaggttaccatgaggcctgtaaatactatcttattaatcattattttaagctgataacaacttaacactgtttgcactaacaaacaaacaaaaagaaaactaataaaaactctatgccttaacttcatcctcttgctttttatttctttgttgtttctatttgtaacttcttgtactatgtcttgaaaagttgtttagttagtacttttgattaggtcatcattcagtatttctacttaagcatgagagtggtttatacaccactgttacagtgttataatattttgtgtttttctgtgtacttactattgccagtaagttttgtaccttcagatgattatttattgctcagtaacatcctttactgtctgattcaagtactccctttagcatttcttgtaggacaggtctagcaatgatgaaatccctcagctcttttttgtctgggaaactctttatttctctttcacgtttgagggatattttctccagatatactattctagggtaaaagtagttttttccttcagcattttaaatacatcatgacactctctcagccttaaaggtttccactgaaaagtctgctgacagaaatattggagatgtctgttatttgtttctcttctcttgctgcttttaggatcctttctttatccttgtcctttgggagtttgattataaaattcctcaaagtagtcttttttgggtaaaatctgcttggtgttctggtagcttcttgtatctggatattgatatctttctctcagtttggaaagttctctgttattatccctctgaataaactttctacccctatctctttctctatctcctcattagggccactaactcttagatttgcctatctgtggctattttctagatcatgtaggcatgcttcattgcttcttattctttttacttttgtctcttcttactgtttattttcaaatagcctatcttgtaattcactaattgttttttctggttgaacaattctgcttttaaaaaactcaggtgcaggccgggtgcagtggctcatgcctttaaacccagcactttgggatgctgagacgggtggaccacttgaagtcaggactttgagaccagcctggacaacatagtgaaaccttgtctctactaaaaatacaaaaattagccgggcatggtggtgcatgcctgtaatcccagctactcgggaggctgaggcgggagaatcgcttgaacccaggaggcagaggttgtagtgagccaacatcgtgccactgcactccagcctgggtgacggagggagactctgtcaaaaaaaaaaaaaaaaaaagactctggtgcattcttcagtatgtcaattgcattttccagaatttctgcttgattcttttaaattattgcaatctcattgcaatctctttgttactttcatctgatagaattctgaatgccttctctgtgttatctcaaatttctttgagtttcctcaacacagctattttgaattctgtgtctgaaaggtcacatatctctatttcttcagaattggtccctggtgacttatttagtttatttggtaatgtcatatattttcctggattgtcatgatacttttagatgttcttctgtgtctggacattgaagagttaagtatttattatagtcttcacagtctgagcttgcttgtacctgtccttcttggaaagactttccagatattcaaatgtacatacatgttgtgatctaagctgcatctgctttaggggtcaccccaagcctcgtaatgctgtggttcttgcagactcatagaagtattgtcttgatggtcttggacaatatctgggagaattctttccattaccaggcagactaattcgctttccttacttactcccaaacagagtctctctctctctctctctgttgtgagccacctgaagcagggggtgtattgacacaagcactcctgtggccaccacctatgactgcgttgggtcagacttgaagccagcacagtactgggtctcacccaaagcctgctgtaaccacatcctggcttccgcctatgttcactcaagaccctggggctgtacaatcagaaagtgtcaaaaacaaccaggcctgtgtccttcactttgggatagtgagttccttcaggccctaggtggatccagaggtgccatccaggagccagagactagagtcaaactccttagaattctacctggtgttctattgtcctgctggtaaactggcagtcaaaccacaagatacacttcctctcactctgcctttcccttttcaaaggcagaagagcctcacctcatggccattgccaccacaggctcacaaggagtactgacagacaaccaccgattttcccttaaggcccaaaggttcttcagtcagcttgtggtatacgctgcctatccttagcctcacctttcagggcagtaggctcttctctggcctagggcaggcccggaagttggattctaggccatccaagagcccatgcctagaatctaggacctcaagagcctgcttggtgctctatacccttgtggccaagctggtacttaagcttcaagacagtgtccaatttactttctcctctacttttgtaaaacataagcactctcccaatagccaccgcagcttggaatgtgcatcacctaaagccagcaagtctcagagtctcacccaaggccctcaatgtagtacctgggcattattgctggttattcagggcccaagggctcttcatttagcaggtgaagaatgcagcaagaactgggtccttcccttcaaggcagcaggtttccttctggcccagggtgtgtctagaaatgtggtttgggagttagggcctggaaagggggcctcgcgactcttactggtgccctatcctgctgcagctgagctggtatacaagatgcaagacaacgtcttttccactcttccctctccagtcttcaagcagaatgaaggggtctcttttggagccacaagctgtggagcctggggttagaggaggggtgatgctagcactcacttagctgccctagctgctatctcggtaggttgtgtgccccctaagtccactgtctctgggcccagttcagcactaggcccctactaggagttgcagtccttgtgtctaggctgtctttcaagtttatttagagccctagagcactttagtccatggcggtgaggcttgcaggaactcaagtgccaacagctgacatgctgacatgggtaattcacgtgtagctagggctgttttgaatgctccctccgtatgcaggcatcagccgagtttggttcagttttttttttttactcctctaagagggcaacactgaggtcaatgcctcacaatagctgcactctccctcccccaacacacagaaatgctcttgcccaccgtgcctcagctgctgggggcagagttggagggtggggtaggcgtggtgttggcaattcaagactgttctttctaccacttcagtgcctctttcattgatatgaagttaaaaccaggtactgagcttttggttcttttgaaggtgcttatttgtgtgtagatggttgttaaattggtgtccttcctagggggatgacgatcagtggagcttttattccaccatcttgcttcacccatcttccagccattgagtttggaggcaagttagtcacagttgcctttagcaagggaagtgtctatgcggggtgggcacagtagccagtctgtggtggtccccaggagtgatctgcacttgagcccattgagggtgcccactttctcagcctgtgatgcttcagggaaaaaagaggctagagagaagtttgggagtggactggggacaagagctagtcttagtgcatggaaaagacaataaaattctatatttcaagaagacccagtggggtacatgttaaatggagttagagagaggggacctgaggagtactggaggggctgggcacttggagtgcatggggtccaaggcaggacctcctttccttaggctgagggaggaggtttatggtgatgtggaccctctagaagggtggggtgggcaatcaaagtgtccctggctccatgctcttaattctcttcctgagtcaggtgggtaggatggaatgactgctaaagtgactgggagaggttggtgagcaaggtcctgcccttgagttatgtgataggaagtgggggccctggtgggcatgggatcggggaaagataagcatgattttcccagaagcactcaccggcccaggtatgggaggtgtgcagaggccactgggttctgctgttggcttgggcagttgtaatgtgggtgacacaggcctttttgaactgtaccagagtgccaggattagcagagacagaggctgcaattgcacatgtgaattaattcaaaggctggggtggagggggaagagcagatgtcttcccatctcctctttcctcttcagagggaagaggtagtgtacagcctaatggtcagagagtgactgaagggcagagaggagcaaaagcctgtggccctgggcagagcctgcttcagcttcagggtagcacagaccctcagccagcacagacatccctgagctgagctgagactggtcctgaggggccctcccagcccccctcccctccccttccctcagctgtcccagccccgaggctctgcagagggaggaatggagtgggggaggggagtcagcagccaatcacatccaggacagcccaaggcatctgtacctggtgtaaccaatcccctctgaataaacagctcactcagcttaggttccctcctcctctccctgctctgcccagcaacagcagaaaggaggttttaggaggagagggaggccctgcaactcccagcccctggcagcaaagagctgggccccaggctcactctatacagggaggttaaaacaatacttggagttcctgcagcccaggcaaaatatccctagggaccttcaaggctgtgcaagcccaactctctcacagacaggaactcacatattacagagatcctgatccttggagtcctgggctacaagccagtctcattccctccacagctctggggcaggccccgggatgaaggtctgaagagctgagacacggttctagtgaaggagatggacagtgagcaaacagtcacacacatgcctgtttagaaacagtgagaagtcctggggaacaaagcacagtgttatgcaggaaaataagaggggacctgatttagattggctttcactgttcttcttggttctacttttttttttttttttttggtccagatttacgatgactatttcattcactactttgcccccagaggccttccacctatggagaagaatgtggtttttgttattgacgtaagcagctccatgtttggtaccaagatggaacaggtaacaaggatcctggaaacctttcttagtcctagtatcagaagacccagaaagcagagagcgtggtaacaatggggccctgggagaagagattccaccatcccatgacccttgagtcttacaggcttgggcctaccctagggtcctggtatcttacctaacaggagcctgtggacctggagccacagagtcctaagaacattgacacattggtcactgtgaaaccattgagaccctcaaccacgaaagcccagggtcatataggaccctcaagctagagcaccctgggatcctagaatccaaaagcaagaaaaccttaggtgagaaagactctgagtcttcctgaggccacaaggttttgggtctttgtaattttttttttttttactttaaaggcctaatagtatagagtactagcattatagaattagaaaccatagagtcaggagtcatatcgattttaatcttgttgcacttctaccactgtgcccatgggtcagagttctgaggccgtagaccaagcaggctttgactttagtccctgaatccataaagttctgcaggcagcatttcataccataataccctggagctttttgtaccggtgtcttgcagttgtatagctttgctccttaatctttcaatcacagagcctttgggacctaaggctgagtttgttttaccagagttgagcaacctggggaaaaatgggtaataccccaagccagctccccagccccagtgtagggggagggatctccccaaatccagccctttctagccttcttgtctcactgaggaggggtaaaaatctcagaagtccttgtgaagtttctatctcagggacaccaattcactaaaagattgagacctcctcataagagtatagaatgcttcctctcactccacacattatcaccacatcaactgggctcctcggcaataacggaaagttacagctgatagaactacaagcccaaaccctattgaagaaaatgttcctagggaaaaccaaagacaacagaagcaacaaaaatacagacactagaaggggagctgaggtaggtggatcacttgagcccaggagtttgagaccagcctgggcaacatggcaaaaccctgtctctactaaaaatacaaaaattagccaggtgtggtggtgcgcacctgtagtcccagctactcaggaggctgcatttggaaaatggcttgagcccagcgagtggagcttgcagtgaaccaagatcacaccactgctctcaagctggggcaacacagcaagaccctgtcaaaaaaatagtagttttagcctctgacaactaaaactgccccaaacaagaaacattacctaactcatagccagataaacttaaaaccccacactaaatgccttttagtttatttccttttacctgatacatcacgtctggctttcaacctaaaatgagaaggcatgctaaaaggagaaaaacactgtctgaagagagtaaacaaacatcacagccagacttcaatatgtcagatatgtcgaaattatcaaacaattttatttttgattgaaattttttttccaacttttattttaggttcagtggatacatgagcaggtttgttacatgggtaaatttagtattgcaggtttttggtgtacagattattttgtcacccaggtaataagcacagtatgtaatacatcatttttcaatcttcactcttctccgaacttccaccctcaagtaggccccagtgtctcttgtccccttctttgtgtacatgtgtgttcaatgtttagctcccactgataagtgagaatatgtagcattggttttctgctcttgcattaattcacttaggatgattgcctccagttcccatccctgttcctgcaaaggacaggatttcattcttttttatggctgcatagtatttcatggtgtatatgtaccacattttctttatccagtccactattgatgagcatttaggttgattccatgtctttgctattgtgaattgtgctgcaatgaacatacatgtgcatgagtctttatggtagaacgacttacattcctttgggtatatacccagtaatgagtttgctgggtcaaacggtatttctgtttttagatctttgaggaattgccacactgtcttccacaatggttgtactaatttacactcccaccaacagtgtataagcgttcccttttctccacaaccttgccagcatctgttgttgttgtttttttttaactatttaataatagccattctgactggtgtaagatggtatctcattgtggttttgatttccatttctctaatgatcagtgatgttaagcatttttttcgtatgcttgttgtctacatgtatgtcttcttttcagaagtatctgttcatgtcctttgccaattttttaatgggtcaaaccaagaatttaaaaacccatgattaatatgctgtgggcactaatggatagagtgcaccacatataaggacaacacatggtaatgtaagcagagacatgaaaaccctaggaaaataaaaaggaaatgctggatatcagaaatactgcaacaggaatgaagaatccctttgattcactcatcagtagactggacatggttgggtaaagaaccaatgagcttgaagatacgttcatagaaattcctgaagctaaaaaacaaaaataaaaagaattttaagaaacaccctagaatatccaagaattgtggaacaattttaaaagtgttacatatgcatcatggaaataatagaaggagaagaaagagagaaaggaacagaagaaatacttgaagtaataatagatacaaattttccaaaataaattatgcacaccaaacctcaggtctaagaagcttaggagaacacaaagcaggataaatactaaacaatctacacctaggcatatcatattcagacagcagaaaaatcttttaaaaagccagaggaaaatgtaccttacctatagaggagcaaggatataaactatatcagacttttcttcagaaaccatgggagcaagaagaaagtggagtgaaatattacaagtgttaaaggaaaaaacccaccagcctagaattctgtatacatcaaaattattcttccaaagtgaaaaaaaaataaagactttctcaaacaaacaaaaattttgggaattgtcaccaataaacctgctttgcaagaaatgttaaaagaagttctacatagaggaagaaaatggtatatctcagatacttggatctacataaagaaaggaaaagtgttggagaaggaataaatgaaggtaaaataaaatagttttcttattaactgacctaacagataatattttttcaaaataacaatgtatttagtgaatgtagcttaggaataagtgaaattaatgagagtaatattgtataggatgggagggaataattgggaatactctgttacaaggtacttgcactatgcataaagctgtatagtgttatttgaaagtggatttggattggttgtaaatgtatactgcaaactctaagggaactgctaaaattttttaagtctaatgcgtatgctaagagataagataaaacgggatcatgtaaaatgcccagttaaaactagagaagccaaaaaataagtggaagacataagagtaaagaattttaaggggaggagccaagatggccgaataggaacagctccggtctacagctcccagcgtgagcgacgcataagacgggtgatttctgcatttccatctgaggtaccgggttcatctcactagggagtgccagacagtgggcgcaggccagtgggtgcgcgcaccatgcgcgagccgaagcagggcgaggcattgcctcacctgggaagcgcaaggggacagggagttccctttccgagtcaaagaaaggggtgagggacgcacctgaaaaatcgggtcactcccacccgaatattgcgcttttcagaccggcttaaaaaacggcgcaccatgagactatatcccacacctggctcggagggtcctacgcccacggaatctcgctgattgctagcacagcagtctgagatcaaactgcaaggcggcagcaaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggcattccaacagacctgcagctgagggtcctgtctgttagaaggaaaactaacaaacagaaaggacatccacactgaaaacccatctgtacatcaccatcatcaaagaccaaaagtagataaaaccacaaagatggggaaaaaacagaacagaaaaactggaaattctaaaacgcagagtgcctctcctcctccaaaggaacgcagttcctcaccagcaacggaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagacaaaagaataaaaagaaatgagcaaagcctccaagaaatatgggactatgtgaaaagaccaaatctacgtctgattggtgtacctgaaagtggtggggagaatggaatcaagttggaaaacactctgcaggatattatccaggagaacttccccaatctagcaaggcaggacaacgttcagattcaggaaatacagagaacaccacaaagatactcctcgagaagagcaactccaagacacataattgtcagactcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcatataaaatactttacagacaagcaaatgctgaccgattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgcaaatggactaaattctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcatgtcctgagtgacctacaaagagacttagactcccacacattaataatgggagattttaacaccccactgtcaacattagacagatcaatgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctatcagaccacagtgcaatcaaactagaactcaggattaagaatctcactcaaagccgctcaactacatggaaactgaacaacctgctcctgaatgactactgggtgcataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaatggacaccctaacatcacaattaaaagaactagaaaagcaagagcaaacacattcaaaagctagcagaaggcaagaaataactaaaatcagagcagaactgaaggaaatagagacacaaaaaaacccttcaaaaaatcaatgaatccaggagctggttttttgaaaggatcaacaaaactgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacgcatacactctcccaagactaaaccaggaagaagttgaatctctgaatagaccaataacaggagctgaaattgtggcaataaccaatagtttaccaaccaaaaagagtccaggaccagatggattcatagccgaattctaccagaggtacaaggaggaactggtaccattccttctgaaactattccaatcaatagaaaaagagggaatcctccctaactcatttcatgaggccagcatcattctgataccaaagccaggcagagacacaaccaaaaaagagaattttagaccaatatccttgatgaacattgatgcaaaaatcctcaataaaatactggcaaaccaaatccagcagcacatcaaaaagcttatacaccatgatcaagtgggcttcatccctgggatgcaaggctggttcaatatacgcaaatcaataaatgtaatccagcatataaacagaaccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcactgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcatctcagcccaaaatctccttaagctgataagcaacttcagcaaagtctcaggatacaaaatcaatgtacaaaaatcacaagcattcctatacaccaacaacagacagagagccaaatcatgagtgaactcccattcacaattgcttcaaagagaatgaaatacctaggaatccaacttacaagggatgtgaaggacctcttcaaggagaactacaaaccactgctcaaggatataaaagaggatacaaacaaatggaagaacattccatgctcatgggtaggaagaatcaatatcgtgaaaatggccatactgcctaaggtaatttacagattcaatgccatccccatcaatctaccaatgactttcttcacagaattggaataaactactttcaagttcatatggaaccaaaaaagagcccgcattgccaagtcaatcctaagccaaaagaacaaagctggaggcatcacactacctgacttcaaactatactacaaggctacagtaaccaaaacagcatggtactgttaccaaaacagagatatagatcaatggaacagaacagagccctcagaaataacgccgcttcgtgaacccaggaagcggagcttgcagtgagccgagattgcaccactgcagtccgcagtctggcctgggcaacagagcgagactccgtctcaaaaaaaaaaaaaaaaaaaagaaaagaaataatgccgcttacctacaactatctgatctttgacaaacctgagaaaaataagcaatggggaaatgattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagactgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaatagggacacttttacactgttggtgggactggaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaatcaaacactgcatattctcactcataggtgggaattgaacaatgagatcgcatggacacaggaagcggaatatcacactctggggactgtggtggggagggggaaggggggagggatagcattgggagatatacctaatactagatgacgagttagtgggtgcagcccaccagcatggcacatgtatacatatgtaactaacctgcacaatgtgcacatgtaccctaaaacttaaagtataattaaaaaaaaaaagaattttaaaagaatagaaaatatttacaactatggcaaatattaatccaactatgtcagtaatgactgcaatcataaatggtttaaatataccaattaaaagacagatactctcagtgtggataataaaataagacccaattgtaggttgtttataagaaaaccactttaaatataaagatgcagataaatcaaaagcaaagggatagagaaagatataccatgctaacacaaattaaagaaagctggctggggtagctgtattagttttggacaaaatagacttcaaagcaaggaaattttcagcaataaatagttgcattatatgatataacaataaaacaaatataatggtaaaggggaaattctccaagaagacaaacaatccttaatgtgcatgcaacgaacaacataccaaaatatatgaagtaaaaactgacgaaactggaaggtaaaaatacatgaatccactattataattagagacttcatcatcgctttatcagtaattgacagattcagcaggcagaaaatcagtaaggacatagttgaactgaacagcaccatcaattaactggatcgaattgacatttctagaatactttattcaacaacattacacattctgctcaagcagattacacattcttctcaagctcacgtggaacatttaccaagatggaccatatccttggccttaaaacataccttaacaaatttaaaataatataaattgtaccaagtatgctctcaaatcaaatggaattaaactagaattcaattacagaaagatagctgggaaatctcaaagtaattggagattaaacagcacacttctacagtctattcccggtcaacaagaggttctgacttctaggacctcataggctctcacttttctacagctcttctcaggaaaggcaatcctattaagtctcttccctctcaatggaaacaagagtatggtgcttagctccctgtcccagaatatacgacctatccccagagctctccctatggcaggaaagactctaatccacttagaagcattcaagatatttcctatccgtttaagttatagagaaaggtgggtctcaagtgtccttcctgtggtctctgaaatccatatctatataaaggattgaaagcataatattgtgcttagggtcactggatttaaaacctcccaaatgtgtatttgaatcccttgtccatcaatgactagctgtatgaccttaagcaagcacccacctctctgagtctcagtgtcatcacctgtaaaatgaggatagtattaataccttcttcattgtgttgctgtgataattaagtgagctgatgcatcaaaagggttaagcacagtgcctggaacatagcaagtgtcctgtaaatgatacctaatagtagatcctacacactctattccctgaacctcctatgggcctagccctatgctagtattgccatggagaagggagacaagaagcagcaacattataagcccttctctcaaagggttcaatatttggatagaaagtaaaaatatttcatgtaaaacagtcagttaacagactgggacagggaatatctaagtgagaagggcaggggtcagggttggcaacttaaggaagaactttccagagaaggagcaactgaaagaacagtaaagatgtgaataaataaagggaagttggaaagtatgctatctaaagagcataaaatagcaaggtttatggagttaaactggaacctgagttttctaggggctggtgagaccagcctggaagaaatggagggtgaggcagaagagcagattacagcagaaccaaagcatgcaaagtcattgaaaggcagctataaagacctgggatcctgtttgcagatgacatgattgtatatctagaaaaccccattgtcttagcccaaaatctccttaagctgataagcaacttcagcaaagtctcaggatacaaaatcaatgtgcaaaaatcacaagcattcttatacaccaataacagacaaacagagagccaaatcatgagtgaactcccagtcacaattgcttcaaagagaataaaatacctaggaatccaacttacaagggatgtgaaggacttcttcaaggagaactacaaaccactgttcaatgaaataaaacaggacacaaataaatggaagaacattccatgctcatggataggaagaatcaatgtcgtgaaaatggccatactgcccaaggtaatttacagattcaatgccatccccatcaagctaccaaggactttcttcacaggattggaaaaaactactttaaagttcatatggaaccaaaaaagagcccacattgccaagtcagtcttaagccaaaagaacaaagctgaaggcatcacactacctgacttcaaactatactacaaggctacagtaaccaaaacagcatggtactggtaccaaaacagagacatagaccaatggaacagaacagagccctcagaaataataccacacatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagacggattaaagacttaaatgttagacctaaaaccataaaaaccctagaagaaaacctaggcaataccattcaggacgtaggcatgggcaaggacttcatgtctaaaacatcaaaagcaatggcagcaaaagccaaaattgacaaatgggatctaattaaactaaagagcttctgcacagcaaaagaaactaccatcagactgaacaggcaacctacaaaatgggagaaaatttttgcaatctattcatctgacaaagggctaatatccagaatctacaaagaactcaaacaaatttacaagaaaaaaagaacaaccccatcaaaaagtgggtgaaggatatgaacagacacttctcaaaagaagacatttatgcagccaacagacatatgaaaaaatgctcatcatcactggccatcagagaaatgcaaatcaaaatcacaatgagataccatctcacaccagttaaaatggcaatcattaaaaagtcaggaaacaacaggtgctggagaggatgtggagaaataggaacacttttacactgttggtgggactagaaactagttcaaccattgtggaagacagtgtggcgattcctcagggatctagaactagaaataccatttgacccagccatcccatttctgggtatatacccaaaggattataaatcatgctgctataaagacacatgcacacgtatgtttattgtggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaagctggaaaccatcattctcagctaactatctcaaggacaaaaagccaaacaccacatgttctcactcataggtgggaattgaacaatgagaacacatggacacaggaaggggaacatcacacactggggcctgttgtagcatggggcggggggaaggatagcattaggagatatacctaatgtaaatgacgagttaatgggtgcagcacaccaacatggcacatgtatacatatgtaacaaacctgcatgttgtgtacatgtaccctagagcttaaagtataataataaaaaagagacctgggatcataaaggtcctaaacatcattgaatcccgggtcatggagcccaggaaccatatagcaaatgaattctagagctctaaaaacagggagcttgaaccttttagatgaccagtgtccaatatgactttcgtgatgatggaaatgatctaaaattctgtgctatctaatatagtagccactggcaacatgtggctattgaacacttgaaatgtggctactgcaaataaagaattaaatgtttgaatttttctttaattttagctagtttatattcaaatataagtagctacatgtgactattagttcccatattaaacagtgcagttctatgccttggaacccatagagtcttttcacctgagaatcctagattcacagagtcctgcagtcagagagtcttaaaaccatataacacttagatgttaatgccttgtgtagaaaaagcctttcaatctcatagacctcaagtcttgtcccattctcttcatttcatccatatcccacagactaaaacggccatgaatgtgatcctcagtgaccttcaagccaatgactacttcaacatcatctccttttctgacacagttaatgtttggaaagctggaggctcaatccaggccaccatccagaatgtccacagtgccaaggactacctgcattgcatggaagccgatggctgtaagtgttagatctacccacccaaatgggcaggctgtggtgatatgggaaattcctgaaaccctctcttcattcccccatcctcctcaactctcacagttcctgaaatatcaagaccacatttcacacaaatatggtcctttgtcctctgtgttctcccatcaccctttccttgtagaaagagcacagccgattctccatgtatcttagggcacatttctttttggcctcagtttcctcttctttaaagcaaacacttgaaagaatttgctaaactttctttaaatcaataatctagatatttatttccaagcatttgaggaagctgctgccctgattctagcttttaagcaatcgtctctgacaactactgaagtctcctctacccactgcctcctgtcaactctgtcctttcttcccctgtagcaagaaggttggaggggggggtgctagccttgggagcctgccagtctggctcgggaatgagacatctcccccctcgaccctgcaccaccaaggaaacagacaaagaacagtgtgagacagagagtgataaaagccaaggacatgtgggccccaatgtcagatctcagcaagtctgggtgggagtggagaagttgggaaggagaaacagtggatacagcctgagcaaagataaggagctgtgagcctgggaagttgatgaggtgcccagtgtgtctgcaatgggggtagaagtgaccagagaagatggtctcacaatctattccccaattagggacagacgtcaactcagctctgctggcagctgcttcagtgctgaaccatagcaaccaggagcctgggaggggccccagtgtggggaggatccctcttatcatcttcctgacggatggggagcccacggccggcgtgacgacccccagtgtgatcctctccaatgtccgtcaggcgctaggccacagggtatcccttttcagcttggcctttggggatgatgctgactttacactgctgcgccgcctgtccctggaaaaccggggaatagcccggcgcatatatgaggacactgatgcggccctacagctgaagggcctctatgaggagatctccatgcctctgctggcagatgtgcgtctgaactacctgggtggcttggttggggcctccccttgggccgttttccccaactactttggtggctctgagctggtggtggcaggacaggtgcagccaggcaaacaggaactgggcatccacctggcagcccgtggccccaaggatcagcttcttgtggcccaccacagtgaaggggccaccaacaacagccagaaggcctttggttgcccaggggagccagcccccaatgtggcccacttcatccgccgcctctgggcctatgtcaccattggagaactgctggatgcacacttccaagctcgtgacaccaccactcgccacctgctggctgccaaagtcctcaacctgtcccttgaatacaactttgtcacacctctgacttcactggtcatggtgcaacccaaacaggccagtgaggagaccaggagacagacttccacctctgctgggccagacaccatcatgccctcatccagcagcaggcatggcctaggggtaagcacagctcagccagccttggtgcccaaggtcatctcccccaaatcaaggcctgtgaaaccaaagttctacttatcctcaactactactgcctctaccaagaagatgctaagttccaaagagctggagccattgggagagagccctcataccctgtcaatgcccacatacccaaaggccaaaattccagcacaacaggattctggcaccttggcccagccaactctcaggacaaaacctaccattcttgtgccctcaaattctggtactctgttgcctctgaagcccggctctctatcacaccagaatcctgatatattacccacgaactccaggacacaagtcccacctgtgaaacctggcatcccagcctcgcccaaagctgacactgtgaaatgtgttactccactgcattccaaacctggtgctccatcgcacccccaacttggggcactcacatcacaggcacctaaaggcctgccacagtcaagacctggagtctctacacttcaggttcccaagtacccactacacaccagacctagggttcctgctcccaagacccgaaacaacatgccacacctggggcctggaatcctcttgtccaagacccctaaaatcttattatctcttaaaccgagtgccccaccacaccaaatttccacaagcatatcactttccaagcctgagaccccaaacccccatatgcctcaaaccccactacctcctagacctgacagaccaaggcccccacttcctgagagcctaagcacattcccaaatacaatctcaagttccacaggtcccagcagtaccacaaccacctctgtccttggagaacccctccccatgccctttactcccactctgccccctggaaggttctggcatcagtatgacctcctcccgggtccccagaggaccaggcaagttctgggaccatctaggccaggagttccaacaatgagcctactcaacagctccaggcctacaccagaaggcagccctccaaacctgccaatcttgctgccttctagcatcctccctgaggccatcagtctgctccttctccctgaggagctagagctgctgtctgaatcaatggtggaatccaagttcgtggagtccttgaacccaccagctttctataccttcctcactcctgatgaagatggtgagtgccatgggtaagaggtcgagccatgagggtgaggtatgaatggacagtaccaggagctgggaatctacaaggcttatgcagactccagtgatgggacagctgcttccttgcttgcttgcttgcttgcttgcttgcttgcttgcttgctttgggactttggacaagttacttaacttctctgggcctcagtatacatgcatggaattagaggccttgggagaggaggagtgttgagactgggaaggctgaacagaaacaaattggccaagggttagctttgacatttgttttgttggacaaaagaattgctgatgcttcctaagcaggggaggaatgcatcattggatgaggcgggtcttattggtttttctgtgctctgtgaatagtcctgcttaatgacaggggtagaagaattggggaagataattaaaattatctttaatttccaaaaaaagtatgaaataataagttaacatttgtgagctcttcctatgcacaagtactgctctacatactgtacttgtccctcatttaatcctcacaagaaacatctttctttcttgacatcgtcattttacacgtgaggagaatgaagcacagagaggtaaaataagtttctcaatgtcacacagctagtcagagagttgaactcatacaatctggtcacagaatgaatgtgattcaccactccagtatcctgccttcctaagagaaggagtgacatttcctaggtgaccttatagggcaggattagaacccactgagagtgcctaagtcacagggatgcaaatttgggtatgacatcctctacatgcctctctcctcagacacccctccaatatcctatccatcctcagttattgacaatgctacctctaatatatttaccaaatccatccacttcccaccaccccaagtgtcactgtgctacagcagaccaccattgtgtctcacctagaaaactgttccaggctcctcactggtttccctgcttcctctcctgtcctgttacaggccagtctctcccagcagccaaagggatcctttaaagacacaaatcacttcatgccccttccctacttaaaatccctcaagggtttcccatcgtacttagaatgaagttaaaagtcctcttcatggccagcaggctctgcatgatctgctccctacccccattcctctatgacctcactctctcccacccattctctgaactccagccccactggtctctattttgcccctccaatgaacaccctaccccatctccactcagggacttttttcaagctactgtctctgcttcataatcatctgacctgctttgtcctaccccttcctgctgcccttatcccttccattgcccttcgaactccagctcatgccttagatctcagctcagatctccttacccaccctcccccaagcaggctacttcaggtctctgtttaactcccacagtcacctcattatttttttccaatagcatttatcaccatttgtgataaattatgatttcattcatgtctgccaccccctactaaactatgagcttcaccaggtcagaaactatgtctttatttttcaccaccatatacctaatacctaagcaatgcctgaatgaatgaatgaatgaatgaatggacaaatgaatgtataaatgctataaggaagaactttgaacatatctgagcttgagagattaagaggctgtggagagcataaggtcccagtcctggagatgggcaggtcaacctgcagagccagtgagggctctccttgtcagaaagattttgagactttgcccctggaatttgaagggttttcttatttcttttgtgcttggcaggaagtccaaactgggatggcaattctgaggagatcctgggaggagctggaggcagcatggaatctcaaggaagttctgtggggttagcaaaaggtgagcaaggagctctcctgacaaagatcccctgggccttcatttccattccattagaattcttattgacattgtgggagaccagagggaagtaatgtattagttttctattgttgtgtaacatttatcacaaatttagtagcttaaaacaacaccaattaataatctcacagttctgttagtcagtagtctagaaatagcttagttagattctctgctcaggatctcacaagattgaaatcaaggtgtctgtcacactgagctctcatcctcttccacactcattcacgttgttagcagaatttagttatttgtgttgctgggactgaggttcccattttcttgctggctgttggctggaggatcgctctcagctgcaagaggttacctggggccactctcagtacctagaaatctcctgcattccttgccatgtggtccccctccatcttcaaaggcagctatggagcattcccctaatgccaaacccttctcacactttaaatttctctgactcctctgtctctgacctctagatacaaatattaagggcttacgtgattaggtcaggccccacctggataatatacccttcataagttcaatagggtcacatgaaataacctatttctgggaggatatttcatcatattcacagctctggagattttacagagtgtgtacaccaagagatcctgtgggccatcttagaattctacctaccacaggcagagagcaagagaaaagagcatttgggctggccttgaaggataactagaaattcatccttggtagttaagggaaaggaaaacattccaggtggcaggaaaaacaggagtaaagggtcactaggaagagaaggtaggacactcataacaatagtttggttgggctagagcacaaagactggagagctaggcagggactagatttcagaaaagccttaaatgctgaacacaggaatttggcccttatctgggagtatgtcccagaattcctaggaatgtgatacattagtcccttcccaacacagtctctctctcctttgcaggcacattgcctagcatcttcaccttctcctcctcaggtaagccagtcacccccatggctcccctgtttgagtacagggcagcttgtgcactgggactggggctggggaaatagacataacctcttccctttccctcctctctctttccctctcccttccatttattcctttaactttagagttgtatcttctgccttgcagtggacggggacccccactttgtgatccaaatcccacactcagaagagaagatctgcttcacactgaatgggcaccctggggacttgctgcagctcatagaggacccaaaggcaggtaagagccccaagaactccatcaccatacaccaaagctggatatatccatgtcaatacccctagacatttgtgggttaataccccagacacatagcaatgcacctcactaacacacggtaacacacaagaacacaccaagacacacaaaaaaacacacatgaatacactcaaacaccaagatactcacagatacacgcacaaaagggcatagagtaaactcacacaaatatgatggaacttcaaaaagtttgtggtaaaatggaattaaacgataaaaaattaaaaacataaacattgtttctcaacataagctccatcaagtacaagataagcaatgatagcagccatttagtccatccctaaagaactgagggtcctgggaatttaaccatgttaatgcagtattttatacattatttaaaaatgaagaaaactgggtgccatttaaagattttttaagattaggaaacaaaaataagtcagaaggagccaaatcaggaccgtaaggtcaatgcctaatgatttctcatcaaaactcttgaaaaattgcccttgtttgatgagagaaatgagcagaagcattgtcatggtggagaattctccggtgaggctttcccaggcatttttctactaaagttttggctaactttctcaaaacattctcataataagcagatattatcatgctttggccctccagaacgtcaactagtaaaatgtcttgagcatctcccaaaaccagttgccatgacctttgctcttgacaagtctgcttttgctttgaatgaaccacttctacctcttggtagccattgctttgattgtgcttttgtctccaggatcatactgataaagccatgtttcattttctgttatacttctttgagggaatgctttaggatcttgatcccacttgtttaaagttttcattgaaagctctgctcttgtctgcaggtgatctgggtgcaatggttttggcacctgtcaagttgaaagtttactcaactttaatttttccatcagaattgtgtaagctgaaccaattgagatgtctatggtgttggctattgtttctgttgttaattgccagttctcttcaattagagcatgaacaagatgaatttttcctcgaaaattgatgtagatggtctgcactgcagccttcttcatcttcaacattgtctcatcccttcttaaaacgagttatccatttgtaaacttctgctttctttaggacattgtccttataaacttttcataaaatgccaataattttaccattcttgcacccaagcttcaccataaattgttcttccttcaattttagcagagttcatgctgctctgataggggctcttttcaaactgatgtcttgtccttcttaatgcttcaaactagatctggttcatccgtgttgtaacaaattagtatgagtttattttggtgcaaaaaattttgaaatccatccatagtttttcataaaatgcattttccatgaactttttgaagactcctcatacacaccatggtgtacatattttgacactcctttcacccacaaatatgcaaatatgcacctagacacatggtgacacacaacacatgcccagatatacacaatggcatggacatcaacacactcgggcatacaagtactgaataccccaaggttaatcccaatttccaggtattcaacacatacaggcagcaaacatactctgctacactagttatatgaaatacactgatgcatggaaatacctgccaagccaaacaatgacactaatccagatgcacacactgacactccatatacacatcagcacagaccaacacataaccaggtacacacaacatacactattgcaccaagacatataacaccaacatatccagaggcgcatacataaatatacaagcaaaaatacgcactctaacataccaccttctccaaacatgcagatgtactgatatgcccagacttactcatatgaacataaccaaacacacatattacacactcagaggcaaacacacatatatatgcaaacaaccacactggggtaagcgtgtgcacacatactacatgcccccactccacacactgctcaggaaggagcagccaggtggaccatggtagaagtagttctctcaggagtcggccctctagccacaaatctgcactacttcatctgcccatgctgtgggtgaccatgtaaatgaccatgcaaaagcccccgctccaggcccacactcccctccctccagggctgcatgtgagtgggaagctgcttggcgcaccaccaaggccgggccacaaggaccagactcgcacctacttccagatcatcacagtcactacagacaaaccccgggcctatactatcaccatcagccgcagttctatatctttgcgaggcgagggtaccttgcgcctgtcctgggaccaacctgccctgctgaagaggccccagctggagctctatgtggctgctgcagcccgccttaccctccgccttgggccctaccttgagttcctagtcctccgacaccgctacaggcatcccagtaccctgcaactaccccacctggggttctacgtggccaatggctcaggcctcagcccctcagcccgtggcctgataggtaagtgcagctgaggctgagaggggccagggagcaccagccaccaaaaagaccctgccagggtgaaaggcatgtatatccccaacaaggaagaggaatcagcaacagactcttcccttggggagctcctcatcttgggagaggacagacccagatatggatagtgaacacaggaggggatcattgctggacagaaagctgcccagggagctagagaaaaccagagtgggggaatttgcccagcctcagagctcaagaaggacttcctggaggaggtagacacacccacgctgagtctgaaaggctaaacaagagtgtggaggaaaggaatggaagttggaggaaatagagttgagtggtcagagttgaatgccaggatgaggaattgggctttatcctgaaagcaatgaggagccatgaagggttgtaagccgaggagagacacagtcatatctgggtgttacaaagatccctctggagactgctatgaagggaggttgtaggaagccaggctgtaggtcaggagacactggcagaacctgaggcagaggctcacatcaaagagtgacagtgggttaaacagatatttttacctcctctgggcctcctccctcctcttgtctccttctttctaatcttccctgtcttctccaaacctggctgtccccctttctctgccatctcatgtactttggctccctacttccatattacactccagccccatctggctcctgtacagttcccacaatgccaagcctcttccctctggtcttttgctgcccctccttcttcctcctttaaatccctctggatttcctgctgggcctccttgcagatctctgagcagggactcaggccacctccctgactagcactgcatctctctccctcagggcagttccagcacgcagacatccgactggtgacaggacctatggggccatgcttacgaaggcaccatggcccagatgtgcctgtgattctaggcaagaggctgctgaaggactcaccaaggctgctgccccgctgggcttcctgctggctggtgaagcgctctcatgtagagctgcttctgggccacccctacctctcctatgtcctgtgatggcttctgaattccagagccaggagacctgaatttgggagatccagaaaccagggcatggggtgagccagggacagagacccaaggacatggaagcacacacagggacacacagactcacgcatgttctaaggaacacatatacaagggtatacaaacacatagacatgcagagacatagagtcagggactcctgcatcttcatggtccttcacatctccagtctcaccctctccaaatccatgctcctcaccagccctacaagccacttttgtaaaacgaaaaaatgatcagtagttctgctcacagctttccctaactcctatggcatattcaaggctctcagagtttccctaacaaaccatgctcactcctaccactggaccattgcatgtgcttttccttctgcatgaaacactcttcctttgttcctgtaggtgagtataattcatccttcaaatcctagttgttacctcttctaggaggcctttcctgatgcctgccctagattgagtttggtcctgtcctctgggttcctatagcccacccccaaccctccacgctcacagtatttatactgtgtagtaatcatctgtttacttgtctggatccctgacttagactgtgagatctttgagggcaaggaccttttctgaatcatctatgtatccccagtgcctctcacataataggtgcttagtaaatatttgttaaaagaatgaattaattaattaacaaaaaaggatcccataacatagcaatagacacacatatatacatactcacaaccaaagacacaggatcacacccggaaaaacagtgacaagggcacagatatggatggatagagggacagacatttatggaaacacaggaatcacaaaacaaacatggacataggggtatagagacataaaaagatggggacagggagccagagtggcagaatcagggacataaactcagagaaaaaggaacagatgctctctggctgc

SEQ ID NO: 4631 - DNA, 6364 bp, human
cgggctgggaggtgttccagccctttaagatgttgcgcgtggtgagctggaacatcaatgggattcggagacccctgcaaggggtggcaaatcaggaacccagcaactgtgccgccgtggccgtggggcgcattttggacgagctggatgcggatatcgtctgtctccaggaaaccaaagtgaccagtgagcgctctggattccaggatccctacatactttttctttcccgctaacttttgtcccctgtcccatgtaattttactttcccagtttcctattcttagagtcctgtccttagacccaggtcccttccctcttaaacttccatttcccaccctagctagatcccctaattgcactccatctcctgtcttcagcaaactttagctccttctcgaaaccccatatctagtcagattcccactcattctccggccccaaactcagtcccctgaatttcctccttccatacgctgtccatctccccgccgccaagtcaaacccccgaattcttcatccctgccccaagctcagatcctctaattcccaccccatctttgaccccagctcagtctaatttcctctttttcacatttccacctcagaaccccagtaccccttatctattcccatctctcctcccagcggaaagtccctaattcccacctcatttcccaccccaagcttagatgtcctcttatttcttcaccctcttatctcccctcagaatcccctaattccttttccctccacccccagttcagatcccctaattccctctctcttacctctcacccttagctcagattcccaccatcctctcgtatgtccatccccatccccagcttcctcctatcgttcagacccccaggcttagctctgattctttccccttcccacctaattctccacctccacttcatagtctctaaccgccccccaccaagccttctaattctgatatcaatttcctctctgacatttcccatctttctaggtcctcctctaatcatggatatttcattcccgtcacccccaactctggctctgatgtgtgcaaggaattagcctacaactgtaattccaggcctttgtgtttctcggatgctagttttacctctgacttaatcttacattttttttttccaggggatgcactgacagagcccctggctatcgttgagggttataactcctatttcagcttcagccgcaaccgtagcggctattctggtaaatggggctttctgtggactttaaattagtgagggaggcagataggggaaaagggtttccaatatttgatgagagggtaataagaaatcttagacatttagtttacagagctaaagctgcataatagtaaattacatgaaatataatttttatggatagaattatcctactggacctcagaagtacagtagtagtgtggtgcttaattgtgtgaactgtggagccagacagcctgggtttgaatcatggctcatttcctagctgtgcaccctctggcaagttacattacctcttggtgcctcaggttcctcagctagaaaatgaggataatgtttaccttccggggctgttacaaggattaaatgaattaatccatgtgataataataattgctaatacgtcttgagcactcaccatgtatcaatgtaaaacacttagaacattctgtggcttttttagatgtaggaactgagactccagggtttgaataaggttgcccaagaaccacactttatgaagatgacttagatgacttgtgtggggacaattggagtgggacaggctgtgcaacaggctattgactgccaggtctgctcagagtgccctgtctgttcccaggtgtagccaccttctgtaaggacaatgctaccccagtggctgctgaagaaggcctgagtggcctgtttgccacccagaatggggatgttggttgctatggaaacatggatgagtttacccaagaggaactccgggctctggatagtgagggcagggccctcctcacacagcataagatccggtaatagctcatatctccctgctactgagcactgctggtgctactctttgagtgtgaagattctaaggcttgccatgtaaacatacatgcaccgtggagaagttcccaaatttgcctttcctggtttagtcctggctgggctactcagtgtgtgaccctggcaaatttttcccccctctgaagcttgagtttccatctctacaatgtggggctggcctagtgatccagctcttattaccatagacatctcaaaagcaacttagtgctgaactcagtgccccaggttgctgtctttctgggtgttctgtgtgaatagcagcaccattacctggtggtaatccttagatatccctctccctgccttatcagtagtcagtccccaagtcctgtgcatgccagatcatttgtgtctctttaacccctttcttttccatcccagacagtcacaaaatggaagccatgtggtatggggaagggacagaaggggaggtttgaaactgaccccttttgggggtttctcttttctccagcacatgggaaggtaaggagaagaccttgaccctaatcaacgtgtactgcccccatgcggaccctgggaggcctgagcggctagtctttaagatgcgcttctatcgtttgctgcaaatccgagcagaagccctcctggcggcaggcaggtactgcaagcctgggcagtaaggcttccttgagttggtcctgggtgcccagccctgtgtcaagctccattgaaagggatatggaccctttgtctctgagttctttcacagcatagttgcaaacaccaatatgcccacctgaataggctctgctcaaaacaaacatgggttttgtactctgagcacctattcaggctcctgctcttactcattgtgagccctagggctagtcttgcctctgttttctcttttgtcaaatgaatatatgaatctctaccctacacaatagttttaagggtaaaatgagatgagaatggtaaagtgcgtgggagcaaaggaaagtcttgttccagcggaggacaggaaagtgagggtgggttagagcaatcaaggggaggtggtatctgagctcagctttgaaggacaagaaaaatgcccattggctcctgattagtgaggcagtcatgtcaaacatggaacactgtcacctttggagatcagaattgggttggtcagatatgaaaggcagcaagtttgtggtaagattggagaggtaggctgttatgagttgctgttggctaggaagcctcaatatgggagagggcctgtctgagctcttgggcccaggaaaaagtatatgggccaggactgctgcacccctttctaacaatcccacattgtgtttttcagccatgtgatcattctgggtgacctgaatacagcccaccgccccattgaccactgggatgcagtcaacctggtaaggctccctctaggtgcctggccccactcctgactgattctgtttgtccagccaaccaaccctgagtttttggcccagggacagcttcctttatgggaaagcggagcttggcttgcaatactattcttatagtactgaggattggtcattcattcaatagacaatactgactctgcccatggcctggccctgagccacatactgaggactcaggagtcagatccagcccttggctcctaggagctctccagcatggtggtgggctacagacacatggctagccaattataggatggtattctcagggcagaggcacagatggcatcccagaaagctacaggagctcagagatgggattcctaggtgagctcggacatcaggacaggcagctgaaaatggctgaatcttaacagatgagtagaacagagctttgaagtagaaagcattctagcatgggcaaaggtttcaaggtgagaatttgcattgtgtgcatggggaaccacaagtccctttcttcttagtgacacaggaagggaggtgagtggcagaaggtggggctggagagttgttgggggtcagatttcaaggactgtgaattccacattgccttggtcatttccttaatacactgtatttcttgtttatgaactttcagtacctccctgttacctctgtgatgcagagaaaacatggagacctagcattcaaggctctccttggtctgtgacctgtctcttatttccaccttcagtgtccctacacattttgtcctctctagacaggttgtctcctgtcggcccgttgtaaaagttattctcattctggcttttctcactgtgccctgaattggtggacatgaccccctccctgtctttttgttatatgaacctcttatctctaagttcccctaggcccatggttttcagcccctaactgcatattagaacaaaaatatcaatatcttagcactactccagatcaatgaactcagaactctcgagtgtggggccagggtagtggcacgttctaaaagcccccagtgtgactttattgtgcagccaggcttgagaaccactgccctagaatccacaagccagctctcatcttttcttgccttatgtctcacgatgggggatcagtgatttatgctggtacagtcctactcagcactgggcttggcttagagaagggaccgtgggaatattccttgattaattcacagaagagctacataaatgtagatatggctcccagctgggaaaatgagcagaagtgagagaatgagagaatggtggtggtggtgtggtggggagcggagataatgctacaaagtgtgagccttcagtccctccctgcctcattcctcttatgcattcattcagtgtgttctttcagattcctgtgatagcatcatacatctttgtgccttttctacttagttcagaggtatcctagatctcttatgtatacctctttcattttctcctccaggaaaagagaactaatagtgccagctcagatgacttacacagtctttccaaaatagcagaacatacccactttctaccaggcttgctcttttagtcttgtcatttctgtaaatggcaccatcatccccttgattgcttcaacttaaagcctgggaattgtgctagtattgtctttctttcttactccacttcccacattcagttagtcagcaagtactgttgattctagctacaaatcatctcataatttcatgtttctgtctcctctggcacccaccctagtccaagtgaccatcatcttgcttgtgtgactatggcagccatttcctgctggtattctggtctccagtctggtctttcctcaagtcttttgggtacgcagcacactccctccacaggcccagcacagagactgttcttaaagttaggagcaccctccacctaggttactcttactcagcccccacacctcagctccagatcacttctcgaaaggaagcctccttggtccccaggagtagatcaggttcctactttgtccctggcatcatgcatggcacataataggtattccatgaacatttcttgcattgaatgagtgggtgggtaggtggattgaatggatggactgatggatgatggattggggatcagagcctaaggaagtattcagacctggatccttgcaggtcctcagctcaggaggtaggaatggtcattgagggctttgacacactagataaaccaaatagtgccagagggtttaaaggaagaagctgacagtcttcctaactcttaaccccagccctgcttcctagaggcaaacacttttaacttcctgttttccatccttttgaaaagcagttccaggaattgctttgagtaagcaaactttcagatttgccattgacggaccaatgcaagacaaatgcaagctcgtgcagagggaaaaacaagcatggtcttttaaatcagtaaggatgaaaatcagaatcccagctctgccaattccggactgtgtgaccttgagcagtagtcctcttgggacaaccaaattttcttatttgcaaaatgcagcagttagtctaagtcccttccagttctaggtatctagttctgtctctctctcttccaaccccctttcctcctcacctaggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtcactggcgcccgccatctcaactatggctcccggcttgactatgtgctgggggacaggaccctggtcatagacacctttcaggcctct

SEQ ID NO: 4632 - DNA, 8700 bp, human
tgaacaggaagcagttcgctcgcgcctaggttggcgcgggctgggaggtgttccagccctttaagatgttgcgcgtggtgagctggaacatcaatgggattcggagacccctgcaaggggtggcaaatcaggaacccagcaactgtgccgccgtggccgtggggcgcattttggacgagctggatgcggatatcgtctgtctccaggaaaccaaagtgaccagtgagcgctctggattccaggatccctacatactttttctttcccgctaacttttgtcccctgtcccatgtaattttactttcccagtttcctattcttagagtcctgtccttagacccaggtcccttccctcttaaacttccatttcccaccctagctagatcccctaattgcactccatctcctgtcttcagcaaactttagctccttctcgaaaccccatatctagtcagattcccactcattctccggccccaaactcagtcccctgaatttcctccttccatacgctgtccatctccccgccgccaagtcaaacccccgaattcttcatccctgccccaagctcagatcctctaattcccaccccatctttgaccccagctcagtctaatttcctctttttcacatttccacctcagaaccccagtaccccttatctattcccatctctcctcccagcggaaagtccctaattcccacctcatttcccaccccaagcttagatgtcctcttatttcttcaccctcttatctcccctcagaatcccctaattccttttccctccacccccagttcagatcccctaattccctctctcttacctctcacccttagctcagattcccaccatcctctcgtatgtccatccccatccccagcttcctcctatcgttcagacccccaggcttagctctgattctttccccttcccacctaattctccacctccacttcatagtctctaaccgccccccaccaagccttctaattctgatatcaatttcctctctgacatttcccatctttctaggtcctcctctaatcatggatatttcattcccgtcacccccaactctggctctgatgtgtgcaaggaattagcctacaactgtaattccaggcctttgtgtttctcggatgctagttttacctctgacttaatcttacattttttttttccaggggatgcactgacagagcccctggctatcgttgagggttataactcctatttcagcttcagccgcaaccgtagcggctattctggtaaatggggctttctgtggactttaaattagtgagggaggcagataggggaaaagggtttccaatatttgatgagagggtaataagaaatcttagacatttagtttacagagctaaagctgcataatagtaaattacatgaaatataatttttatggatagaattatcctactggacctcagaagtacagtagtagtgtggtgcttaattgtgtgaactgtggagccagacagcctgggtttgaatcatggctcatttcctagctgtgcaccctctggcaagttacattacctcttggtgcctcaggttcctcagctagaaaatgaggataatgtttaccttccggggctgttacaaggattaaatgaattaatccatgtgataataataattgctaatacgtcttgagcactcaccatgtatcaatgtaaaacacttagaacattctgtggcttttttagatgtaggaactgagactccagggtttgaataaggttgcccaagaaccacactttatgaagatgacttagatgacttgtgtggggacaattggagtgggacaggctgtgcaacaggctattgactgccaggtctgctcagagtgccctgtctgttcccaggtgtagccaccttctgtaaggacaatgctaccccagtggctgctgaagaaggcctgagtggcctgtttgccacccagaatggggatgttggttgctatggaaacatggatgagtttacccaagaggaactccgggctctggatagtgagggcagggccctcctcacacagcataagatccggtaatagctcatatctccctgctactgagcactgctggtgctactctttgagtgtgaagattctaaggcttgccatgtaaacatacatgcaccgtggagaagttcccaaatttgcctttcctggtttagtcctggctgggctactcagtgtgtgaccctggcaaatttttcccccctctgaagcttgagtttccatctctacaatgtggggctggcctagtgatccagctcttattaccatagacatctcaaaagcaacttagtgctgaactcagtgccccaggttgctgtctttctgggtgttctgtgtgaatagcagcaccattacctggtggtaatccttagatatccctctccctgccttatcagtagtcagtccccaagtcctgtgcatgccagatcatttgtgtctctttaacccctttcttttccatcccagacagtcacaaaatggaagccatgtggtatggggaagggacagaaggggaggtttgaaactgaccccttttgggggtttctcttttctccagcacatgggaaggtaaggagaagaccttgaccctaatcaacgtgtactgcccccatgcggaccctgggaggcctgagcggctagtctttaagatgcgcttctatcgtttgctgcaaatccgagcagaagccctcctggcggcaggcaggtactgcaagcctgggcagtaaggcttccttgagttggtcctgggtgcccagccctgtgtcaagctccattgaaagggatatggaccctttgtctctgagttctttcacagcatagttgcaaacaccaatatgcccacctgaataggctctgctcaaaacaaacatgggttttgtactctgagcacctattcaggctcctgctcttactcattgtgagccctagggctagtcttgcctctgttttctcttttgtcaaatgaatatatgaatctctaccctacacaatagttttaagggtaaaatgagatgagaatggtaaagtgcgtgggagcaaaggaaagtcttgttccagcggaggacaggaaagtgagggtgggttagagcaatcaaggggaggtggtatctgagctcagctttgaaggacaagaaaaatgcccattggctcctgattagtgaggcagtcatgtcaaacatggaacactgtcacctttggagatcagaattgggttggtcagatatgaaaggcagcaagtttgtggtaagattggagaggtaggctgttatgagttgctgttggctaggaagcctcaatatgggagagggcctgtctgagctcttgggcccaggaaaaagtatatgggccaggactgctgcacccctttctaacaatcccacattgtgtttttcagccatgtgatcattctgggtgacctgaatacagcccaccgccccattgaccactgggatgcagtcaacctggtaaggctccctctaggtgcctggccccactcctgactgattctgtttgtccagccaaccaaccctgagtttttggcccagggacagcttcctttatgggaaagcggagcttggcttgcaatactattcttatagtactgaggattggtcattcattcaatagacaatactgactctgcccatggcctggccctgagccacatactgaggactcaggagtcagatccagcccttggctcctaggagctctccagcatggtggtgggctacagacacatggctagccaattataggatggtattctcagggcagaggcacagatggcatcccagaaagctacaggagctcagagatgggattcctaggtgagctcggacatcaggacaggcagctgaaaatggctgaatcttaacagatgagtagaacagagctttgaagtagaaagcattctagcatgggcaaaggtttcaaggtgagaatttgcattgtgtgcatggggaaccacaagtccctttcttcttagtgacacaggaagggaggtgagtggcagaaggtggggctggagagttgttgggggtcagatttcaaggactgtgaattccacattgccttggtcatttccttaatacactgtatttcttgtttatgaactttcagtacctccctgttacctctgtgatgcagagaaaacatggagacctagcattcaaggctctccttggtctgtgacctgtctcttatttccaccttcagtgtccctacacattttgtcctctctagacaggttgtctcctgtcggcccgttgtaaaagttattctcattctggcttttctcactgtgccctgaattggtggacatgaccccctccctgtctttttgttatatgaacctcttatctctaagttcccctaggcccatggttttcagcccctaactgcatattagaacaaaaatatcaatatcttagcactactccagatcaatgaactcagaactctcgagtgtggggccagggtagtggcacgttctaaaagcccccagtgtgactttattgtgcagccaggcttgagaaccactgccctagaatccacaagccagctctcatcttttcttgccttatgtctcacgatgggggatcagtgatttatgctggtacagtcctactcagcactgggcttggcttagagaagggaccgtgggaatattccttgattaattcacagaagagctacataaatgtagatatggctcccagctgggaaaatgagcagaagtgagagaatgagagaatggtggtggtggtgtggtggggagcggagataatgctacaaagtgtgagccttcagtccctccctgcctcattcctcttatgcattcattcagtgtgttctttcagattcctgtgatagcatcatacatctttgtgccttttctacttagttcagaggtatcctagatctcttatgtatacctctttcattttctcctccaggaaaagagaactaatagtgccagctcagatgacttacacagtctttccaaaatagcagaacatacccactttctaccaggcttgctcttttagtcttgtcatttctgtaaatggcaccatcatccccttgattgcttcaacttaaagcctgggaattgtgctagtattgtctttctttcttactccacttcccacattcagttagtcagcaagtactgttgattctagctacaaatcatctcataatttcatgtttctgtctcctctggcacccaccctagtccaagtgaccatcatcttgcttgtgtgactatggcagccatttcctgctggtattctggtctccagtctggtctttcctcaagtcttttgggtacgcagcacactccctccacaggcccagcacagagactgttcttaaagttaggagcaccctccacctaggttactcttactcagcccccacacctcagctccagatcacttctcgaaaggaagcctccttggtccccaggagtagatcaggttcctactttgtccctggcatcatgcatggcacataataggtattccatgaacatttcttgcattgaatgagtgggtgggtaggtggattgaatggatggactgatggatgatggattggggatcagagcctaaggaagtattcagacctggatccttgcaggtcctcagctcaggaggtaggaatggtcattgagggctttgacacactagataaaccaaatagtgccagagggtttaaaggaagaagctgacagtcttcctaactcttaaccccagccctgcttcctagaggcaaacacttttaacttcctgttttccatccttttgaaaagcagttccaggaattgctttgagtaagcaaactttcagatttgccattgacggaccaatgcaagacaaatgcaagctcgtgcagagggaaaaacaagcatggtcttttaaatcagtaaggatgaaaatcagaatcccagctctgccaattccggactgtgtgaccttgagcagtagtcctcttgggacaaccaaattttcttatttgcaaaatgcagcagttagtctaagtcccttccagttctaggtatctagttctgtctctctctcttccaaccccctttcctcctcacctaggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtcactggcgcccgccatctcaactatggctcccggcttgactatgtgctgggggacaggaccctggtcatagacacctttcaggcctctttcctgctgcctgaggtgatgggctctgaccactgccctgtgggtgcagtcttgagtgtgtcctctgtgcctgcaaaacagtgcccacctctgtgcacccgcttcctccctgagtttgcaggcacccagctcaagatccttcgcttcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatgaccccgaagactccagaagagaaggcagtggccaaagtggtgaaggggcaggccaagacttcagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttcagggttgcactttggacattgtggaggtactccataaagttgagtcagagaagctatctcaatacttggtttgccggctggctgtagcccaatgatgtaattcccagagaaaggggaggagggaggggggaggagggaatagtgaggcgtgagcagcagtgctcaccataaagggttctctgctcagttgtaggaatttcctgtacggctaaggtgaaatcagcaaggaaggtgggctgtgtagccttaaaccagagctttccagctagtgcgtcccacagctgccacagtgggttacagggttgaaagaaacggtcctcagccctcagagttgccaggcagggcctgggaccacacaagtttcagggacgattgcctccttagcaagtagtatcattagtacccctaagtgtgccatggaaatgtttcctgtatactgtgacctggaaagtgggagcattgctttgaacacagtgcttgctctagccaagcctcttctcacctttgaaaatgggactggtagaccaggcacagtggtgcacgcctgtaatcccagcactttgggaggctgagatgggtggatcacctgaggtcaggagttcgcaaccagcctaacatggtgagaccccgtctctactaaatacaaaaaaattaactgggcgtggtggcgcgtgcctgtaatccaagctacttaggaggctgagacaggagaatagcttgtacctgggaggcggaggttgcagtgggctgagatcatgcattgcactccagcctgggcaacaagagtgaaattcagtctccaaaaaaaaaaaaagaaaagaaaaagaatgggactggtaaatcctgttctgtgggatgccgtgggagggagagaggataatggattgaggaagacatccatatccccttatggaaaatacctctttggttttggggaaccactcctttctagggaatttggttagggctgactcatttcctggcttcaggggctaccctgggcccagatttccagggcccggattaccagtgaagcgtcaatccctggatttttattgaaaccattggagaagagccatctcaaataaatctgccaagtatcctagctctttgcaactcactgtgtagtttttgggcatttccttcctctttctcattctgtttccctgttggtaaaatggaatggtgaccaacaagtgacctatggttacctcatagatctgccacttgtctgagggagtcagaatgcacttgtctgttccctgtccaataaaaggcttcacatgc

SEQ ID NO: 4633 - DNA, 107050 bp, human
gttttaccggaaacaaagtaatgaaaagagatgcggtggggtgtggcggggcctgccccctgccggaagaagtttgggtgcagcccagtattcaagctccaggacaaagggggcggggaggccgccactagcaaacaacctcagcttcataaatccagcagaaaggtccggggtattgttgaaaaggtcggaaggaccaagattatgtccgccagcctaagtgggacgaacaaccaagttgtgcgatgcagctttaaaggggctggtgattgacagaatggtgtagtagtagatggggtggagccgctgggtggggtcgagactggcagctgagagataccaaaaggaagaaaaaagaaaaccattgctcttgatattgctaatgccgggggaggtaagctaacgagaaagtagggaaaaggaaggttttagagttcacctccactccttcccctggctaacactctttacactcttctgccttcccttgagataattaaaatagactgtacaccggccctagtcggtgcccattccccctaactcttcactcaactacgtgtgtagtccgagggagtgaggaccccgggtccaagagctcaatcccggccccgccccgtcggcccaggccccggggctgggaggagaggatgccttcggaggcgcagaatccgaaagtaagttccttttattttgccttaccaactgccacctcccactccaccttccttttatcaccctctctgggcggcgaaatagcctctttcaaggaaaacctttcagggtggagcagagtggggttggtaagaaggggaggggaagggaggtggtgctttagagcctaggggagctaccacgggcgggacaggcgcgctcagttcgatggctgtgtggttggatccttgatttctcctccaggtattagagcctcgacttcctccctcctggcattctttctttttatcaccctgcagcaaccctatcaggttgcctgaagcctctagctgtgagctaggagggctccatcttgcctggcttcttaaagggacagtgcactatttaactggaaattcaattatgagaagggtggcagtacctctatgttggaaggaatttgtgtggcgaggacagctttttcttactcagaccagcttccatacttggttctaatatccgtgtggttcttaggaggtgcaccgtgggcaatgttgccaagttacacattagttaactgcagccagttgactgctgttttagctcaaagggaaaatttccatttcctgaaaggcgccatggcagtgcaggtatcttgaacaaattcattctacaaattttattgaatgccaggtgcattgcctgtggctgatcacactgctgggaggtttgtgtaaaatgtcaaggccatgcagagtgttgtcaatgactccctttttaactgattagtagccttcccaggatatggagacaaatgttgaatttgattccaacatttaccaaacatttcttacatgaatggctcaatggttcacttttattgtcttctgttcagtaccaggtgtccatatgctcaaagccaagtgactgggaattccagctagaagaaataggaactcaaatcaaaatggcatgcagagaggaaagagcaggaaacttcagtaggaaagctaatgccactttggcgttatccatgtccagtaagggagattgttttgggaaagagggcttcaccatctcccttccactgttaaagaagagctggtgtggcagaaacttgttagaaagggtctcttatggaccagtgacatctcttacatatttgtctctcttatgtttctgcacagggagggtggcaggactgtggatagagcctaatgatactccacaggtcgaagagatgaaaatatgtttgaggttttagggttcatatttcactctgtaggtttttgtttggtcaatggaatgccacagttcccggtgctctgcaatttcctttgttttgagtcccttcctagttcttactcagcggtccagggtagggaactgtgacagagcaaggtattgacacaaaattacattgtgttattatattcattcattcattcgttcattcatttgacaattacatactgagaatctactctgtatcatcaccacacaagactctggggaaaatatgccttcttggagattatattctaatgaggaggtgttggtggaggggactaacaaaaaacaatgaacatatacgttgagtggggataagataggagaaaagctacagggcatgtggaattggggtgattttaaagaatatatctgaatgaagtgagggagccagccgtgagaatacctgagggaaaggtgttctagacagaggaagtagcaagtgcaaaggcatggtatgttcaaagaatagtaagaaggtcagtatcactggagtggacaagaggaagagtgcgggatataaggtcagtgagatagagggggctagatcatatgggaacttgtaaagactttgacttttattctgaatgagacaggaagtcacttgtaaaaaaagaagtaacaatcattctatttgaaattctattgcattaaagagaatgaatcttgaattatttatcttatacaatcaagatggattgtatttttatgtttggaatctaatgctcctttaagaaaaacttagtaaacttattgctaacttgttcatgtcaattaatacaatttaatttcataccaaccattgttttataaaataaatatctgaagaaggtttcaaatgcacttgaaactactgttgacagcacagaggttagagatgctgaccccacacagttgaaaatccatatataacttctgattccccaaaacttatctactagtagcctacaattgaccagaagccttactgataatataaacagttaattaatatacattttgtaagttatacatattatatactgtggtcttataataaagtaagatagaaaaaagaaaacgtttagaaaatcgtaagcaagagaaaatatatctactattcattaagtgaaagtggattatcataaaggtcttaattcttgccatcttcatgtttagtagattgagaaggaagaagagcagggtgtggtcttgctttttcaggagtgggagaggtggaagaaaatccatgtataagtggacctgcagttcaaacctgtgtttttcaagggtcaactatacttaaatacaaaaagtctcttcaatgtacttcaacaaaatatattacaataaatttattagcactagaaaaagtctcatctgctttaaggaaatattacaagattttgtagcactctttgtcaagaaattgtgaaaattatttgcttggaaacctttttttaaactttccatcctgctggcacacatgattccttttaagttgtgcactgtgcttcccccaagtccttcccagtgggagctttaagtataaaacacctcattagcctcagggaactcagaaggagagaagagtgcgaggaagggaattgagagaaagaagaaaaaagccaaggaagtccaaacaggacagtgcactaagaacaagaacaagtcacacaaatacaaagttttaacccctctgttccatacattgaaagttccattcatttctggccttgaaatttccacttgtccttgtgactcccttttagagataaggtaggtgtgcatgttagatgtgtgtgtaaagggagacttgtggattagtgtaggcttcccctaaaacaattcttaaccttggccacacactggaatcagttgaggatattttaaaaatactgataactttgtccatcctcagagatactgatgtaattggttggggcacagcttggaagatggatttttaaaagagctccctaggtaattctaatgtgcagtaaaggttgagaaccacttgcttagagttgaggttgtcttagtatggtgcttggaccagcagcatcagcatcaccagggaacctcttagaaatgcagattttcaggccctaccccagacatactgattcagaaactcatactgattgtgataaaacaatcagtacttttttcatacaccatctgggtgacctggatacacactgaagtttgaggactaccttagaggttagaggttctcattttttttcattcccaatacacctaaggaatataacacactcctattagtaacagaggctcactgtgccctgtttgtgaaaggtggagaaggaatatgcctgttcccatcccatatcagaatccccattcccattccctactgcagaatttacaatcactgttttagagtatatggctttttaaattatatgcattatttcctttaatttcagcactcaagtttcatgcatcacttcacttcatcctcacaataatcttgtgaggtagacactattatcattgccattttataattgagaaaactgaggcacaggaaagaaagtaccttatccaagatcatacagctagtaagtgtaagagatccatcgtctcctgtactttctaagttgtttcatcagttaggttccttctctcttattttcttaaatttcttcttattcgttgattttcccactcattcagccctatccacctaacattgctaacatatattgaagacctcctttgtatcaggcccctctattgagcatgttacagatatcaatgtatataatgttcacagcagtcctattaagtagatactattattttcctcattgttcagttaaggaacttggggcacagcaaaatcaagcaacttgcctaagcttacacagctagtaagcggcagagctgagatttgaacccaagtgtatgaagtctgtgcctgactattatgccatactacctaatcttaagcttacaagcacattttttcccttctctaaatctttctttgaactcatttaaattaccactcccatttattttgtgcagtttccatttaaaccatcactgaaactgttcttgccaaagttacttaatgatctgtcatgttcagtgctctctctttagatcttcagccttcttgcctctctactacattcaaggctgttatatctgacctagtttattataatagctcctttattgttctctctgcctccaatctgtatgtcctttgctatgggttgaattgtgttccccaatatatgttggagtcttaattcctagtttttcagaatgtgactatttggagacagggtctttatagaggtaaaaatttaaaatgatctcattttatttttttatgagatcattttaactttattaaattaagtgggccccaattcaatatgactggtgtccttataaaacagggaaatttggatacaaagacagactcacacattgggaatatgatgtgaagagacatggagaatacaaccatctgcaacccaaggagaggcctagaacagattcttccttcacagccctcagaaggaaccaaccctgctgacaccttgatttcatacttctagcctccagaactgtgggacaataaatttccatcgtttaaacgaaccagttggtgacacttcgtcatagcagccctcggaaatgaatacagagtagaggggaaaggttattccaggcaggaagaatcttattaccagaggcaagtaatgggcattaacataatgtgggttggagaagaacagggtagggttagagaaagggtgagtttaagagaactttttcttgtggtggtaatacatatggggtaaaagcagtggctggaaaaacagcaaggttaaaattctttctcctagtgtttcagggaaatagctaagtttcaaagaatattatctagctaatgcctcctaatgctaaaatggcctatattttgttccttagaaagctgaacttaggaataactctctgagctgggaacattttactggtcagtgatggcatgatacatatgtaatggacagagaacatggaaaggggttcagagtacatttttacaagaataataactcaaatatgatctgcagctttggtttaattaaatctggtcatatatattaaccatttccacttatgtaaggcagatggcttttgaaatggggaagcagcattcagttattcatcccatttatttgttcaatatatatgccatgagaaccctctatgtagtcagctctgtgctacagcctgggtatacaaaaatctgagacctcagtcttgccctggagctcagctgggagacagacaaaactctagctaacatctaacatttcttgattacttaatatatgccatggaccatactaagaaaattcacaatagttatgctcactttttagataaggacactgagggttagaggaaagttgagtcaacttcaggagaggagttttggcaaacttgccaagtgagaaagttattaatatgagcaagtaaaatgtgggtgatttgtggggttagacggtcagagaagacttgctagaggagatgatatttgagtcttgaaggataaataggagttttcaacatacacaagttgagaaagaaggagcatggcagatggaaggaacattatgtataaatcaatggagacaccagagatatgctatgttcaggaaatagtgtttcattatggctgacacataagttggtggcaggaaaaaagactggaaaagtaggcacaacccaggaatcaaccataaataagagtctcttattttttataagcacgatatgaggaacactatacccgaaagctattctttactattcaaaacattagagattgcataaacagctgctttcagtactgtacacagaaattagagggatttttttcactgagggtcagtcaatgaagaccagaaaaattactgggaccagaaggtagacagaaaccttaggactcaaaaatcattgttgatcagggagaagggatgagactggtactttgtgggagtctggactggtagaaatgattactagtcagagtagtcaaagcaataataataattttaataatacagcaataaatgtaccaagtactactctaagcattgaatttactatatccatttgataaatggggaaactccagtaccccaaacctctgacaatagctgtaaagaaactgggaatactctgctaataatttgtagaatttgaatttgaacgcagatagtttggctatacaatctacatttttaatcattatgaaatattgaactaactagtcagtaagaccaaaaaaggaaatagaatcaaagtgagtcagtaactgtgggtcctgttaagcagtgtaatgcaatgtacaaatgggtacatatgaaaaagataaaaatagatgaaagatctaagaagtaacatgtaagacagattttgctgaccgaggtcacaactcaagggttcacaagtcacattcaggccacagatgtacttgccttgagccatgttcttttcaaaatttgaattaattgccagtgtgtaaaaggcagatgatttcacataaaataagctcacagttttcttgaaaaacttgaaatgtgtggcatcactgggcctatactgcctcatggtgacacttaacacaagctgaagcagcagcttcccctttatacatgttatttattcattaatatcctttggttgcaaagggtgtaaaccagctgaagctagcttaaacacaagagcaatgtgactggatcttaggagtggactgggttttggaaatgggaagttgtcagcaacctaaggtgattttctttctatgtcttatatatgcttcccttggcatatctgcttatttcttctctcttagcaaattatattacctagtgagcaagagatagctccctcatctctcgagtttataagttacagttcagtcacatgaacaggtactggttctgtttgttccaattcccaaatcacaaggaagtggacactcaccgattgaccaggcttgagccagctacttatacctagataaaccagctctgatcaggaagctagggtcatgtaatataagctattggaacacctttgctaatcaaagaggagttataaggtggtcactatgtacagagcagatatttccaaatgtgtcccctgtacgaaatattattttggccctacccactttgtagtaacttcttgtgttctcttggaagtttcactgcccgtagccctggcctacttgatatgcttgccaggctacgtcctgctattttgagaatatgtagggttgactgtgctcccagtggcctagtcctttcctgtagtgaatctattcctactactgtataaagcaatttgaggccaaaattgccataatagccttctccaattttctttttgcactttgaagtccaaagggcttccttcagtggcttaaatttatcttattaatcatcataatgatctaaaggctggtgagtgcattctcaaagggtaacaggcatggatggaaaagagggaagtcatggggagagcagctgataccaatgtgcccaggcctagagaattagcaagagttgcatttataaatgtaatgcctgggctttagaactacacatagtgacagtgattaactaactgtgtttcccgtttgtgggtccccttactcccaggaactttccaaggtttatgcttccctgctaaggctttggatacttcttgtatcaatgattttttttcagtgactttaaagttcccttcctgacactccttactgaagtagcagttgatatttgaagttttgctctcagcaaagtttccttagagctgttgtcagaggttggcttccagagattgctaaccttagacaatgttgagagagaagcttcttctaccctccaaaatgccaaagtaagctgatctggctgaaactatccactttcaagatcttgggatagattttttccaaaggaatccaatctccctgctcaagtcttgctgcctcctctggaatctgctttgctttttataaatagaatagaattgttctgacttcctcaagctaagagttgcttatttccagagtgagagtctacatttttcaaagtgaaatgggaagaacccagagccaaaatgaagcaacttcctaggaagagtaatttcacttggagcatttggaatctaggcaaacattgttttctttccctttcctctttgataaagtcagttcaagttccaataaaatgaatatgggtttcttactttggatcccctgtctcctttatccaattctttagttggcaggtgaaggcagtatttatcacaaatagcaataataattaacatttattgagcaattactaagtgcaagacactattctaaattctcgacaaggcctacatactaaaatggtcatgatggtgtgttaaagttatcccgttttaattcaaaataaagtcaggaaatatcatccttataaactgtgtgggtttaaatagagagtgaccttgggaatcttaaatttgtatttcacaccctgtcatctactcactcttctgctagcaggaaacagtacactcatatagtggaaaaagtactcaagcaaaagagctttttcttgagtattcaagggtcagaagagggctggcttctgagtgcccagaactgtgttagccctgtataaagattattttgttgactcttcagtacaattctatgaaatattattgctccgccaccttttcttttaacaaatgaagaaatatagaattagagaagttaactaaataacttgctttcagtcacacagctagcatttgtcgtctgggatctcaacacaaaattaacaccagagcccttgcctttaagtactagatcatgctgcttttaaacacataaattaggaaggggacagtctcaaatgtcgcaactctcttttataagtattcttgtattatttagtaattcaacttctcactatctttccttgaatggaaataagattagagagataacaggagccccagaaagtaagtagataaaggaagttgtttctacctctgggttcccatagcactagactcagcagtctaaggatatcttaatcatgattgtccccagtgcctagaacatagaaggaacccagtgaatacttgttgagggaataagtcaatcaatgagtttggggaaattatctacctatcttgagactttctggcagattatacatcatttttcatgttcctggtcaactatatgtagatcatgcatataggtacccagacagagatatacatgctcattcagaaattgccatccaatcctgatacatgcaaactcataaagatatatctccacacaaatgaatacttggcatatttgttttctgatgctgtaaaatgtaccacaaaatgggtgccttaaaacagcagaaatttattctctcacagttcttgaggctagaaatctgaaataaaaaataaaagtattggcaaggccatgctccatcgaaaacctctagaaagaatccttcctggtctctttcagcttctggtaagtccagatattccttggcttgtggcagtataactctaatttctgtctctctcttcacatggctatgtctgtgtgtatatgagcgtgtccgtgtgtgtgtgtgtgtgtgtgtcttcacttgtcactttcctcttctttataaggacaccagtcataatgaattagggccaccttaatgatttcatcttgattacatttgcaaagactttattttcaaataatgtcacattcacaagtactgatggctaggacttcaacatatcattttaaaggtcacattaccacccaaaatggtcttcctttggccctccaaaatttatgcccttcccatgggcaaaacacattcactctatcacaacatctccaaaagttctaacccattccggcatcaattctaagtcttaaaaatctcacctaaatttaatcaactcaaagagtcccaaaactcatcttctacttcatctgcgtaaggaaggatgagactcagggtgtggtccatcctggggcaaaatttctctcttctgtggacctgtgaaacctagaaaaaaagttagctgctcccaaaatacaatggagttttcagattaagagggtggatagaaggcatgactagcttgcagctcctggtcagactgatagagcagtgtgtggagactcacttcgtgaacttttgctcccaagaactaccacaggaacacaccaggaaagccaagaaaatccagagatcctttgaaggaactggattaccgctgcaaactcctgagacactgaaaaactgtgagcctgcttgctctctcaacagggaggttcgtggtctggggcgagttctcagccctggtcaccggctgcctcgaaatagactcagtgatgttggcgggggcatgggggaagtgaaacccgcttttaggattgcaggctgtgtgagagctgggtgaggcctgtgactgccaggtgtcccgcacttccctggctacctgtatgactcagcagaagcagccataatcccccgggaatataacaccattagacagggaaccacaccccagcccctacagcagccacagcaagcccggcccaaggataggctgagctcagacatgcctatctctgcccccacctggtggtctttctctacctgctagctgaaggcaaaggtcataatattttgggagctctgtggccctgcctgctgcctgagaaacctgaatacttaaccaggtgtctctagggcaagtttgcctcctccctataggactgcagctattgcactcttgaaagcaccacttcctggctggaggccaaccaacacaaaaccagcccactaaacaaaaacacaaccaaggacctgcaccaagtccacttcacttccctgctacctccaccagagcagatgctggtatccacggctacaagacctgaagatgaatcatatcacaggagtctttgcagaaactccccagtaccagctcagagcatggtagctcccccgggtggctagacctagaagagcaaaaacaattactacagttcctctgtactgtaggaagccccattcctaggggaagggggaaaacaccacatcaagggagcaccccgtgggacaaaataatctgatcaacagcccttgaattccagatcttccctctgacatggtctacccaaatgagaaggatacaaaaaaaacaattctggtaatatgacaaaacaaggatctttaacatacccaaaatatcctgccagctcaccagcaatggatccaaaccatgacgaaatctttgaactgcgagaaaaagaattcagaatgtctgtcattaagctaatcaaggaggcaatagaaaaaggtgaagtccaacttaagtaaatcaaaaacatgatacaggataggaaaggaaaattcttcagtgaaatacatagcataaataaaaaacaatcacagcttctggaaatcaaggacacacttagagaaatgcaaaatgcagtggaaaatctcagcaataaaatcaaacaagcagaaagaacttcagagctcgaagacaagacttttgaattaacccagtccatcaaagacaaagaaaaaagaattttaaaaaatgaacaaagcctccaagaagtttgggactatgttaaatatccaaacctaagaataattggtgttcctgatgatgaagagaaatataaaagtttgaaaaacatatttgagggaataatcaaagaaaacttactcggccatgctagacatctaaacttaaaagtaaaaccccaaactataaaattcctagtagaagagaatcaaggcaataccgttcagaacatagacacaggcaaccatttcatgatgaagccgccaaaagcaattgcaacaaaagcaaaaattgagaaatgggatctaattaaagagcttctgcacagaaaaagtaactataatcagaatgaacagacaacctacagaactggagaaaatactttcaaactatgcatctgacaaaggtctaatattcagcatatacaaggaacttaaatttataagaaaaaatcccattaattcatcttgagtcaatttttgtatcaggtgtaaggaaggggtccagttttaattttctgcatgtggctagccagttttcccagcatcattaatttaatagggaatcctttcccagttgcttgtttttgccaggtttgtcgaagataagatggttgtagatgtgtgaccttatttctgagatctctattatgttccattgatctatgtatctgtttttgtatgggtaccatgctgttttggttactatcggctgtagtattgtttgcagtcaggtagcatgatgcctccagctttgttctaaaacccaaaattataaaaactctagaagaaaatctaggcaataccattcagggcataggcatgggcaaagatttcatgacaaaaacatcaaaagcaatgctacgaaagcaaaaattgacaaatgggatctaattaaactaaagagcttctgtacagcaaaagaaactctcatcagagtgaagagacaacctacagaataggagaaaatttttgcaatctatccttcagacaaggttctaatatccagaatctataaggaatttaaacaaatgtacaagaataaaaaaaccccattataaagtgggtaaaggacatgaatagacacttctcaaaagaagacatttatgtggccaacatacatatcaaaaacaaactcaacatcattcatcattggagaaatacaaatcaaaatcacaatgagataacatctcatgccagtcagaatgatgattattaaaaagtcaagaaacaacagatgctggcaaagctgtggagaaataggaatgcttttacactgttggtgggaatgtaaattagttcaaccattgtggaagacagtgtggcaattcctcaaagacctagcagcagaaataccatttgactcagcaatcccattactgggtatatacccaaagaaatataaatcactgtattgtaaaaatacatgcatacgtatgttcattgcagcactattcacaatagcaaagacatggaatcaaccgaaatatccatcagtgatagactggataaagaaatatgctacattacacaatggaatactatgcagccataaaaaggaatgagatcttgtcctttgtaggacatggatggagctggaagccattatcctcagcaaactaacacaggaacggaaaaccaaacactgcgtgttctcacttataatgggaggtgaacaatgaaaatgcatggatacagggaggggaacaacacacgctgggacctgtcagggggacagcagggggagggagagcatcaagataaatagctaatgcatgtggggcttaatacctatgtgatgggttgataggtgcagcaaaccactatggaacacttttacctatgtaacaaacctgcacgtcctgcacacatatcctggaacttaaaataaaatcgaaagaaagaaaaaatcccattaaaaaatgggcaaaggccatgaatagacacttctcaaaagaggatatacatgtggccaacaaacatatgaaaaaaagctcaatatcactctgatcattagagaaatggaaatcgaaaccacagtgagataccatctcacaccagtcaggatgcctattattaaaaagtccagaaacaacagatgctggtgagattttagagaaaatgaaactcttttgcactgttggtgggagtggaaattagttcaaccattgtggaagacagtgtggcgattcctcaaagatgtagaggcagaaatactatttgacttagcaatcccattactgagtatatacccagagaaatagaaatcattattttataaagatatatgtatgcatatgttcattgcagcactattcacaatagcaaagacatggaatcaacccaaatgcccatcaatgatagactggataaagaaaatgtggtacatatacaccatggaatactatgcagctataaaaagagataagatcacgtcctttgcagggacatggatggagttggaagccattatcctcagcgagttaacacagaaaaagaaaatcaaataccacatgttatcacttataagtgggagctgaatgatgaaaacacctggacacatgggtggggggtggggaataacacacactaagggctgtcagaaggtgaggggtgggaggagggagaccatccagaagaatattgaatgaatcctgggcttaatacctaggtgataggatggtctgtgcagcaagccatcatggcacacatttacctacgtaagaagcctgcatgtcctgcacatgtacctctgaacttaaaataaatgttggaaattaaaaaaaaaactaactaaaggaaacaagaaattattcttcctgcgtttttctcatctctgtctttttcagcccagactggcagtgtttctgttggtataaaattctcataaacctcattcacagttaccgagggttaatacttcaacatatcttttggtgggtcacaatttaacccataacacttaaagatccacgtgtgtgtgtgtgtgtgtgtgtgtgtgtgtgtgtgtgtgtatatctgtatatacacatatatatttgtgtgtatgtatatatatatatctgtacatcatagaacattcatgtatagtgtgcaaatgggtttggattcagcaaatacttatggtctcatctaaaagcccttcttgatgttccttaatcatgctaaacacatgcctgccacaagacttttgccttcacttatactctaacactcttccctttaccccagatattttcatggcttactccctgtcttcattcagatttctattcaaatattgtctcttcagagaagccttccttgacggttctatacaaaataattcagccccacgcacccctaacatttttttttgagacgagtctcgctctgtcgcccaggctggagtgcagtggcgcgatctcagctcactgcaagctccgcctcccaggttcacgccattctcctgcctcagcctcccgagtagctaagactacaggtgcccaccaccacacctggctaatttatttttatttttattttttagtagagaccgggtttcactatgttaggcaggatggtctcgatttcctgacctcctgatctgcccgcctcagcctccaaaagtgctgggattacaggcttgagccactgcgcccggccctgacattcttaattaatctttattgcgtgtttcattttttttcttaaatgtgacagtttatgaccattatgtatttattttgtttattgcctatttccccttattggaatgtaaggttcatgaaggcttggatttttgtttgttattgtttgatgcatttttttcccagagcataaaatagtgcatggcacatgttaggcagtcaatatttcttcatgcaatgaatgaacatagaggaagagggcttttatagagcatctacttaatgccagagactttattattacttcatttgatactcaaatacctggggattttgtaacacaaacaggaagaatcgggtgaaagcacatgtgaaaatcagtgtcagcaaatttcctagtggaacaaagtgactgaagtctctcctattattatgtggaggattggtggtttcgtggtggttttttttttgttttgttttgttttttgcttttttttttttttttttttttttgtgagggagcctcgctctgtctcccaggctggagctcagtggcgccatctctgctcattgcaacctccgcctcccgggttcaattgattctcctgcctcagcctcactagtagctgggattacaggcatctgccaccacgcccagctaattttttttttttttttttagtatagatggggtttccccatgttggccaggctggtctcaaactgctgacctcaggtgatccgcctgcttcagcctcccaaagtgttgggattgcaggcgtgagccaccacacccggcctggtggtttcattttttttttttttttttttttagcaacttttgtactccaagtgttctaccgtaaataaactatggtccctgccatcaaggagctaacagtttagttcggaaaggaggtaacatttcacttgtttttgaaagaagcctatgtattaaccagacaaaagggtaagggggcaatacatgtaagggtgcaaatgcatgaaaggccatggatttctgtcactacacacgcatgcacacacacacacacgcacacacacactacatattatactgtcttaactaggagcagcagcaacaataccatctgttgcatttactacatgccaggcaccatgccaagcactagggtaagggatgaatatggcttgatctgtgctgtaaacatatttatgatccaattcggtgggtgaggcccataaagaaataggtatacaaggcaatgaagaatgcccaacatgaagggaagatacctggtgctccaggaatccagatttaaaaccaattagagtggacaagatggttggaaaagacctcaaggaggtggaaaggcttgagctacatttttgaagatgaaattttatcaagggcagaaaggagagattggcaatttttgtggggataagggatggtccaaagtcagcctgctagactataagttccatgaagacaggaaatatgtctgccttttaaaaacatttttaaattcttgtgggtacatagtaggtgtgtatatttatggggtacatgagatattttggtacagacatgcaatacgtaataatcacatcatggaaaattgggtattcatcctatcaagcattatcctttgtgttataaacagtccaattatactcctttagttattttagcaccatattcttggtgcctagtacatggtctgacacttagtagaaagttgataatatttgtggtcatgatgtgtaacctctgagtagacaagtttggatgaagcacagattctgctgtgtgagtagttagagataaggataagctgtaaaaagtattttgcatacctgtgacactgatgccctttaggatgccccctattcaaatcctatgattctgaggaaactttagaggaaagccgtaggcactagggagctgagccaagattgtccttgtaaatctataacatctccctgtctttccatacatctccctgtctttccatgcttcctatctgtgtatttacagataggaattgggctgcttaattataaagtactctccatgtttctaaaattgcaaaaatgctttatttattcagagtcaatttttagtagacttcctgattacactagtctgtgtatttactcacgcactcaatttcccacttgccattcattctcttacatatttactttcgtatttgttgggaatatgataatttactttgcatatgggggctaacacttgggatcaggccctagggtattttaaaactaaaatatactgtatgatacctttaaaaaatatccttagcctgctgttaatgtagtcaggaagtctactaaaacttgactctgaataaatacagcatttttgcaattttaggaacatggagtgtactttataattaagcagcccaatttttttttgtaactcaagggctaaagagactagatatttaattaatcaaatttgaattatagttcagttgaagcttccaaagccagatcacatgctcagacataccgatagacaaccctaaaaaaaaagtgagttgtaggaagtggaataaaatttcctacagagaaaggaggtctgtagaagtgccagtgcaaaattatgaataaactgaagtacaaagcagacagtaggacaaatagaatgaaagtacaaattatggagtctaaccaacactccctgaatataaaagtgatcagaaagaggttttagaatccagtggaaatattttcttgggttagaaaacaattatacctatactcttatgtgataactgtagatttctcagttttggcattattgatgttttaagcaagataattttttcctctggagggctatcttgtccattgtaagatgtttagcagtatccctggcctctacccactatatgccagtagcaactcctccgttgtgacaatgaaaaatccaaatctctctgtcctctctttctcttctatcatgcatagtgctgcgatgagtgtcttgtatgtgtttctttctccttatgcacatatgtgagagtttttctagggcagaaatctagaagcagacttgagacatggtatatacatattttcaactttaccagggttggctctttagtgtagatgttacaatttggggttcaaccccccattcctcacctcagccatcagcatcgtagttgctgtttccctgtatctactgttatttggaattatcagatgtcagacctattaattttccagtctagggattataaaatggtaatgcatagctttaattcatatttcctttctaaaagattgtggatcatttcaaaggttgattggtcattcagattttcttttctttgaaagatctgttcattcatttgcctttttatagttatttttgttttttatcttattgatttggaatttttaatatattttgtatactatttgttgattatgtgtgttgtaaatattttccccagcctgtggattgtctatactaagaaaagttgcagaggatacaacagagtttctatatatatctttcacccagttttcctaactatgatacatttgtcaaaactaaacagtgaacattgatatgatacaatactgctaactgaactacatattttgagttttctcaatattttcattaatgccttttttactcttttggaatccaatacagaatacagactgtatttagtcttcatgtctccttagtctcctctgctctgtgacagttttgcgatcttttatgacctcgacatttttgaatgttagtgctctgatattttgaagaatgtaaattgactgagtctgattatagttagactgacattatggattttgggtgagaataccacagaggtgaggtgtccttctcatcatgtcatattagggggtacatgatatttacatgactttttactggagatgttaacattgaccatttggttaagattgtctagattgtctgctgagtttccccactttcccttttctttttttttcttttaattatactttaagttctgggatatatgtgcagaacgtgcaggtttgtgacataggtatacatgtgccatagtggtttgctgcacccatcaacccgtcatctacattaggtatttctcctactgctatccctcccctagtgctccaccccctgacaggccctgatgtgtgatgttcccctccctgtgtccatgtgttctcattgttcaactcccacttatgagtgagaacatgtagtatttggtttttggttttctgttcctgttttagtttgctaagaaagatggtttctggcttcatccatgtccctgcaaagaacatgaactcatcctttttcatggcctcatagtattccatggtgtatatgtgccacatttgctttatccagcctatcattgatgggcatttgggttggttccaggacttcactattgtgaacagtgctgcaataaacatatgtgtgcatgtgtctttgtagtagcatgatttgtaatcttttgggtctatacccagtcaaggtgattgctgggtctaatggtatttctggttctagatccttgaggaatcaccacactgtcttccacaatggctgaaataatttacattcccaccaacagtgtaaaagcattcctatttctccacatgctctttagcatctgttgtatcctgagtttttaatgatcgccattctaactggtgtgagatggtatctcattgtggttttgatttgcatttctctaatgaccaatgatgatgagctttttatcatatatttgttggccgcataaatgtcttcttttgagaagtgtctgttcatatccttcgcccactttttcatgggttttgtttttcttgtaaattggtttaagttctgtgtagattctggatattagccgtttgtcagattgagagatggtaaaaattttctcccattctttaggttgcctgttcactctgatgatagtttcttttgctgtgtagaagctctttcattgaattagatcccatttgtcaattttggcttttgttgccattgcttttggtgttttagtcatgaagtctttgcccatgcctatgtcctgaatggtattgcctaggatttcttctagggtttttatggttttacatcttacgtttaagtctttaatccatcttgagttaatttttgtatagggtgtaaggaagtggtccagtttcagttttctgaatatggctatccagttttcccaacaccatttattaaacagggaatcctatccccattgcttgtttttgccaggtttgtcaaagatcagatggttgtagatgtgtggtgttatttctgaggcctctgttctgttccattggtctatatatcagttttggtgccagtgccatggcgttttggttactgtagccatgtagtgtagtttgaagtcaggtagcatgatgcctccagattttttttttttcttttttttttccactgaggattgtcttgactatacgggctcttttttggttccatatgaaatttaaagagttttttttttaattctgtgaagaaagtcattggtagcttgatgctgatggcattgaatctataaattaccttgggcagtatggccattttcacgatattgattcttcctacccatgagcatgaaatattcttccattggtttgtgtcctcttttattttgctgagcagtggtttgtagttctccttcaagaggtccttcatatcccttgtaagttggattcctacgttttttattatctttgtagcaattgtgaataggagtttcactcatgatttggctctctgtttgtctgttattgttgtataggaatgcttgtgatttttgcacattgattttttatcctgagactttgctgaagctgtttatcagcttaaggagtttctgggctgagacgatggggttttctaaatatacagtcatgctatctgcaaacccagacaatttgactttctctcttcctatttgaataccctttatttctttctcttacctgattgccctggccagaacttccaatactatgttgaataggagtggtgagagagcacatccttgtcttgtgccggttttcaaagggaatgctttcagccttcgcccattcagtgagatattggctgtgggtttgtcagaaatagcttgtattattttgagatacgttccatcaatacctagtttattgagagtttttagcatgaagggctgttgcattttatcgaaggctttttctgcatctattgagataatcacgtggtttttgtcattggttctgtttatgtgatggattatgcttactgatttgtgtatgttgaaccagccttgcatcccagggatgaacccagcttgatcgtggtggataagctttttgatgtgctggtggatttcgcttgccagtattttattgcggatttttgcatcaatgttcatcaggcatattggcctgaaatttcctttttacgttgtgtctctgccaggttttggtatcaggatgatgctggcctcataaaatgagttagggaggattctctctttttctatttattggaatagtttcagaaggaatggtaccagcttctctctgtacctcaggtagaatttggctgtgaatccatctggtcctgggttttgttttggttggtaggctattaattactgcctcaatttcagaacttgttgttggtccattcagggattctacttcttccttgtttggtcttggcagagtgtgtgtgtgtttgtgtgtccaggagcttatccatttcttcttgattttttagtttatttgcatagaggtgtttgtagtattctctgatggtagtttgtatttctgtgggatcagtggtgatttctcctttatctttttttgtctatttgattcttctacctagtggtctatctactttgttaatcttttccaaaaaactagctcttgaattcattcatttttttgaagggttttttgtatctctatctctttcagttctgctctgaccttagttatttcttgtcttcttccagcttttgtatttgtttgctcttgcttctctcattgttttaattgtaatgttagggtgttgattttagatctttcctgctttctcctgtgggcatttagtgctataaatttccatctaaacactgctttagctgtgttccagagattctggtatgttgtggctttgttcgtattagtttcagagaatttatttatttttgacttaattttgttatttacccagtagtcattcaggagcaggttgttcagtttccatgtagttgtgcagttttgagtgagtttcttaattctgagttctaatttgattgcaccgtggtctgagagactgttatgatttctgtccttttgcatttgctgaggagtgttttacttccaattatgtgatcaattttggaataagtgcaatgtggtgctgagaagaatgtgtattctgttgatttggagtggagagttctgtagatgtctgttaggtctgttttttccacagctgagttctagtcctgaatagccttggtaattttctgtctcgttggtctgtctaatattgacagtgaggtgttaatatctcccactattattgtgtgggagtctaagtctctttgtaagtctctaagaacttgcgttatgaatctgggcactcctgtattgggtgtatatatatgtaggatagttagctcttcttgttgcattgatccctttaccattatgtaatggccttctttgtcttttttgatctttgttggtttaaggtctgttttatcagagactaggattgcaacccctgcttttttttttctttccatttgtttggtaaatatttctccatccctttattttgagcctatgtgtgtgtttgcatgtgagatgggactcctgaatacagcacaatgttgggtcttgactcttaatccattttgccagtctgtgtctttttattgggacatttagtccatttacatttaagattaatattgttatgtgtaaatttgattctgtcattatgatgatagctggttattttgcccgttagttgatgcattttcttcatagtatcgatggtctttacaatttggtatgtttttgcagtggctggtactgggttttcctttccatatttagtgcttccttcagagctcttgtaatgcaggcctggtggtgacaaaatctctcagcatttgcttgtctgcaaagtattttatttctccttcacttatgaagctcagtttggctggatatgaaattctgggttgaaaattattttctttaagagtgttgaacattggcccccactctcatgtggcttgtagagtttctgcagagagatccgctgttagtctgatgggcttccctttgtgggtaacccgacctttctctctggctgcccttaacatttttttcttcatttcagtcttggtgaatttgatgattatgtgtcttgaggttgctcttctcgaggagtatctttgtggtgtgcactgtatttcaggaaacactttcccttttcattcaagtcactaagtgcaccctacacttgggagaaggggaatgctcccatcttttatgttaatagcacactcttttaaaattctgtttatgtcatttcagtgtttaaatgttttaactattgagatactcaaatggatgtttttttttcttatgctttgtacatttttacatcttaagaaacctttccttgttctgatttgttttatcagagttttcttatgttttcttcaaaatatttgccattttgcttttcatactttaatgtacctatgactcatttgtatatgtaacataaggaagaggtttaattttatcttttcccatatgactatatggttgtccagtcaccatttaaaacacatagtccatttctacccattatactcaaccaagatgttctagtcttctcagaacaaacaatttctgctttaaggtgccttatcagatctacttacgtaagtggtaggcaatgttatgaaagcttctcttgctgaaataaagctctgctttttatggcccaaaacagataatggcaaacaaaaagaatattcctgttatattatttaaaatgatcagttattaaacaaccagtttaaggggatataatatcaccatcatgatccattgaccttatatatttttagaaaatatttcgattttgaggcatttctttcagaaattttggaatttactggaatttctgttgataatttagaattactcagcaatcatttttatacagtacagttttctgtcttcactaatgagtgtgtgcatgcatgtgcaaaagtatgctttcccacaattttttctgtcttatggagtaaagaagaaacagttgttagctgtgacttgactgtgtgcaccttccaaccagggactgtattctcctttctacttaccaagtataacctgtttttaaggttgcatttcaaattatattatattgtttctacccatggagaactcgagtgacatttactatattgccttaatctgaagatgctttgaattccaaattgcagcatggataggtcatagcttttataagtttatgtcaattataagataaatgtttatttcagagttgttaaaaagtaaaaaacaacaaacaacaatgtgtatcctagaattgagggaatatggtactacttaattcatccatttagaaattgtatacagttttcttgtaaagttctttagtattctgtttagccaaatggcttagaacatctacatttgcctttcgtctgtaaattcttttgagggcagaatctattctaaccactgtatttctgttacctatcagagtcatggtgtataaaaggtgctcaagaaatgtttttaatggggtttaattaagattttctatattttcctcttagcacctataatggggctttatatagggcagccaaagacttatcaataataaaagaatcaagcaactggggcatggatagaaaaagttaaagatctcaaggatttacagcattccatcaaacataagcaaagatgcaattgtcagaagcagaatgtccaagtgctgagaagacctgcccctctttcagccatctctttgaatgctagtgtaagtagcaccagactttgaatcagtgaaagttattccattgaatagtagcattcacctttcttcctttctgagcatggtggtatttagttgctctctatttagtcagcatctctccctaatgtctaactcctctatttgagaatattagtcagtaagcttctagctgatatcttcaaccaatttctctctcagaaatcacaatgttattcgtgcaagggatgatgccattaagaaaagtattgtttgaaaattgatcaaattcctcctcaccacactcattgtgtgactcagctgcctgtccacttctcccccttggtggggaatggtgaggctcctgggagttactgggatattcctgagaaaagcatggaaaatagggtaggagaccacagtaacctggttttgttggagttagggttaaatccaactcttctagtggccaaataactttatagttgaaggggagccatatgcatatccatgaaaacagattggagtggagcacagaatgattagtttcatactaatactaaccatactaatactaaccttactaatacttacctagcacagtcatggcgtataaaaagtgttcaataaatgttagcaatgctgttaattactaatactaagtgctggtgaatgtgtagggaactatgaacaatctcatactgttggtatcaatgttaattgttacaagtactttgaaaatagtttagcattactagtaaagtagaagacctgcataatctgtgatccagtaatttcactcctgggtatagactctttaaggccttcctgctccaaatgtggtccatagaccagctataacatcacctgggagcttgttagaaatgtgtgatctcaagccccaccccagaactacagaatcagaatctgaattttaacaagatatcaagtgatttgtatgcacattaaagtatgagaagcatctagaggaactatttacttgtaaacaaggagactttgtttcaagaatattctttctttcaagaatattcatgatatcaaaaaacagaaacaacccagataccagtgaataggagaatagataattatggaattttgatagtatgcatagcagtgctaaataaatgaactagagccacatggataaatctcaaaaacataatattagagtggaggacaaattgcagaatgcatataatgtgataacttttataagacttaaaaatatatcacttatactttttatacatatatactaaaagtataaaaacatgcatgggaataaaatcaccaaatataaggcttaaaaatatatcagttatactatttatacatatatactaaaagtataaaaacacatgggaataaaaccaccaaattcacgatagtagttacttctaggatggagaggaatgggatcttggagggttattcactggcttgaagcatatttataatatttcatttacttgtttgaaagcttaagcaaatatagcagcatgctataatttgacaaacttgagaattagctgcatggattttcattattttattctttattctttttcaaataatctaccagagagaatgcatctaatagtatcacagccatattaatataggtacctgagaaatactaaacctgttaaaattttctctcctcagttacttaaataaatcatcttttctttatatgtgatctgtgattgatgaccatctccccttcagtatcactccagtctggagaatctctagtccccaaagttcatcactcatcatatattgattgtgaacatattaggtgggtatacagtggtgaacaagacaaaaaaagcaattacactcatggaggttgtattctagtggtaaaagacttgtaagaatctagtcgaggtggagccaagatggccgaataggaaaagctccagtctacagctcccagtatgagcgatgcagaagatgggtgatttctgcatttccaactgaggtaccaggttcatctcactggagagtgccagacagtgggtgcaggactgtgggtgcagtgcaccgtgtgtgagccaaagcagggcgaggcattgcctcacgcaggaaacgcaaggggtcagggaattgcctttcttagtcaaagaaaggggtgacagatggcacctggaaaatcgggtcactcccaccctaatactgcacttttccaacgggcttaacaaatggcacaccaggagattatatcctgcacctggttcagagagtcctacgcccatggatcctggctgtttgttagcacaggggtctgacatcaaactgcaagtcggcagtgaggctgggggaggggcgcccgccattgccgaggcttgagtagtaaacaaagcagccgggaaactcgaactgggtggagcccaccacagctcaaggaccctgcctgcctctgtaagctccacctctgggggcagggcacagacaaacgaaatgcagcagtaacctttgcagacttaaatgttcctgtctgacagctttgaagagagtagtggctctcccagcatgcagcttgagctcagagaacgggcagactgcctcctcaagtgggtccctgacccctgagtagcctaactgggaggcaccccagagtaggggtggactgacacctcacacggccgggtactcctctgacacaaaacttccagaggaacgatcaggcagcaacatttgtagttcaccaatatccgctgttctgcagcgaccactgctgatacccaggcaaacagggtctggagtggaactccagcaatctccaacaaacctgcagctgagggtcctgactgttagaaggaaaactaacaaacagaaaggacatccacaccaaaaacccatctgtatgtcaccatcatcaaagaccaaaggtagataaaaccacaaagatggggaaaaaacagagcagaaaaaccagaaactctaaaaatcagagcgactctcctcctccaaaggagcgcagctcctcactagcaatggaacaaagctggacggagaatgactttgacgagttgagagaagaaggcttcagaagatcaaactactccgagctaaaggaggaagttcgaaccaatggcaaagaagttaaaaaccttgaaaaaaaattagacaaacgactaactagaataaccaatgcagagaaatacctaaaggacctggtggaactgaaaaccatggcatgagaactacgtgatgaatgcacatgcgtcagtagctgatttcatcaactggaagaaagagtatcagcgatggaagatgaaatgaatgaaatgaagggagaaaagaagtttagagtaaaagaaataaaaagaaatgagcaaagcctccaacaaatatgggactatgggaaaagaccaaatctacatctgactggtgtacctgaaagtgatggggagaatggaaccaagtcacaaaacactgtgcaggctattattgaggagaacttccccaatctagcaaggcaggccaacattcaaattcaggaaatacagagaatgccacaaagatactcctcgagaagagcaactccaagacacataattgtcagattcaccaaagttgaaatgaaggaaaaaatgttaagggcagccagagagaaaggtcgggttacccacaaagtgaagcccatcagactaacaggtgatctctcggcagaagctctacaagccagaagagatggggtgccaatattcaacattcttaaagaaaagaattttcaacccagaatttcatatccaaccaaactaagcttcataagtgaaggagaaataaaatactttacagacaagcaaatgctgagagattttgttaccaccaggcctgccctaaaagagctcctgaaggaagcactaaacatggaaaggaaaaaccagtaccagccactgcaaaaacatgccaaattgtaaagaccatcaaggctaggaagaaacggcatcaactaacaagtaaaataaccagctaacatcataatgacaggatcaaaatcacgtataacaatattaaccttaaatgtaaatgggctaaatgctccaattaaaagacacagactggcaaattggataaagagtcaagacccatcagtgtgctgtattcaggaaacccatctcacgtgcagagacacacataggctcaaaataaagggatggaggaagatctaccaagcaaatggaaaacaaaaaaagacaggggttgcaatcctagtctcggataaaacagactttaaaccaacaaagatcaaaagagacaaagaagaccattacataatggtaaagggatcaattcaagaagaagacctaactatccgaaatatatatgcacccaatacaggagcacccagattcataaagcaagttcttagtgacctacaaagagacttagattcccacacaataatagtgtgtcactttaacaccccactgtcaacattagaaagatcaatgagacagaaagtgaacagggatgtctaggaaatgaactcagctctgcaccaagtggacctaatagacatctacagaactctacaccccaaatcagcagaatatacattcttttcaacaccataccaagcctattccaaaattgaccacatggttggaagtaaagctctcctcagcaaatgtaaaagaacagaaattataacaaactgtctctcagaccacagtgcaatcaaactagaactcaggattaagaaactcactcaaaacctctcaagtacatggaaactgaacaacctgctcctgaataactactgggtacataacgaaatgaaggcagaaataaagatgttctttgaaaccaacgagagcaaagacacaacataaccagaatctctgggacacattcaaagcagtatgtagagggaaatttatagcactaaatgcccataagagaaaacaggaaagatctaaaattgacaccctaacatcacaattaaaagaactagaaaagcaagagcaaacacgttcaaaatctagcagaaggcaagaaataactaagatcacagcagaactgaaggaaatagagacacaaaaaacccttcaaaaatcaatgaatccaggaggtggttttttggaaagatcaacaaaatggatagaccactagcaagagtaataaagaagaaaagagagaagaaccaaatagacacaataaaaaatgataaaggggatatcaccactgagcccacagaaatacaagctaccatcagagaatactataaacacctccacgcaaataaactagaaaatctggaagaaatggataaattcctcgacacatacactctcccaagactaaaccaggaagaagttgaatctctgaatagaccaataacaggctctgaaattgaggcaataattaatagcttaccaatcaaaaagagtccaggaccagatggattcacagccgaattctaccagaggtacaaggaggagctagtaacattccttctaaaactattccaatcaatagaaaaagagggaatcctccctaactcatttgatgaggacggcatcatcctgataccaaagcctggcagagacacaacaaaaaaaacagatttttagaccaatatccttgatgaacattgatgcaaaaatcctcaataaaatcctggcaaacggaatccagcaactcatcaaaaagctaatccaccatgatcacgtggacttcattcctgggatgcaagcctggtttaacataggaaaatgaataaacgtaatccagcatataaacagaaccaaagacaaaaaccacatgattatctccatagatgcagaaaaggcctttgataaaattcaacaacccttcatgctaaaaactctcaataaattagttattgatgggacgtatctcaaaataataagagctatctatgacaaacccacagccagtatcatattgaatggacaaaaactggaagcattccctttgaacactggcacaaaacagggatgccctcttttaccactcctattcaacatagtgttgaaatttctggccaggacaatcagtcaggagaaagaaataaaggacattcaattaggaaaagaggaagtcaaattgtccctgtttgcagatgacatgattatatatctagaaaaccccattgtctcagcccaaaatctccttaagctgataagcaacctcagaaaagtctcaggatacaaaatcaatgtgcaaaaatcacaagcattcttatacaccagtaacagacagagagccaaatcatgagtgaactcccattcacaattgcttcaaagagaataaaatacctaggaatccaacttgcaagggatgtgaaggacctcttcaaggagaactacaaaccactgctcaatgaaataaaagaggatacaaacaaacggaagaacattccatgctcatgggtaggaagaatcaatatcgtgaaaatggccatactgcccaaggtaatttatagattcaatgccatccccatcaatctaccaatgactttcttcacagagttggaaaaaactactttaaagttcatatggaaccaaaaaagagcccacattgccaagtcaatcctaagccaaaagaacaaagctggaggcatgacctgacttcaaactatactacaaggctacagtaaccaaaacagcatggtattggtaccaaaacagagatataaaccaatgtaacagaacagagccctcagaaataatgctgcatatctacaactatcttatctttgacaaacctgacaaaaacaagtaatggggaaaggattccctatttaataaatggtgctaggaaaactggctagccatgtgaagaaagctgcaactggatcccttccttacaccttatacaaaaattaattcaagttggatgaaagacttaaatgttagacctaaaaccataaaaaccctagaagaaaacctaggcattaccattcaggtcataggcatgggcaaggacttcatgtctaaaacaccaaaagcaatggcaacaaaagccaaaactgacaaatgggatctaattcaactaaagagcttctgcagagcaaaagaaaccaccatcagagtgaacaggcaacctacagaatgggagaaaactttcacaacctactcatctgacaaagggctaatatccagaatctataatgaactcaaacaaatttacaagaaaaaaacaaccccagcaaaaagtgggcaaaggatatgaacagacacttctcaaaagaagacatttatgcagccgaaagacacatgaaaaaatgctcatcatcactggccatcagatgaatgcaaaacgaaaccacaatgaaataccatctcacaccagttagaatgacgatcattaaaaagtcagaaaacaacaggtgctggagaggatgtggagaaataggaacacttttacactgttggtgggattgtaaactagttcaaccattatggaagtcagtgtggcgattcttcagggatctagaactagaaataccatttgacccagccatcccattactgagtatatacccaaaggactataagtcatgctgccttaaagacacatgcacacgtatgttgattgtggcactattcacaatggcaaagacttggaaccaagccaaatgtccaacaatgatagactggattaagaaaatgtggcacatatacaccatggaatactatgcagccataaagaatgatgagttcatgtcctttgtagggacatggatgaagctggaaaccatcattctcagcaaactatcgcaaggacaaaaaaccaaacaccgcattttcttactcataggtgggaattgatcaatgagtacgcatggacacaagaaggggaacatcacacaccagggactgttgtggggtggggggtggtggggtggaatagcattaggagatatacctaatgttaaaggttgagttaatgggtgcagcacaccaacattgcacatgtgtacatatataacaaatctgtacgtcatgcacttgtaccctaaaacttaaagtataataataataaaattaataaaaaaagaatctagtcaacaaatgcataggcaagataattgcagcttatggtcactattacaatgaaaataaatcaggataatgaagggtgagcgactagaacgtatatgtaatgaagatcgtttcgattgggttgcatagggaagtttttatattaggccatctttaggctggttcctaggataatggaaaagagttagacatgtgaaacatggaagaagagcatgtccgacagagaagccaacaagtgcaaaggccctgaattgaaggcaagttcagactgttggaggaatagctagaagttcaatgtggctggtgcatagtcatcaagtaatggagaattgttaagagagttctttaaagcactgagacattgaaacattttaagcatatcagcatgttctgtggatgcctgtgacctgtccggagactgtggcccaagaaagagatgattcttcagcttagatggtagcagtggagacagaaatgtagacagtgtcagaatccattttggaagtagagttgaccagacttaatggagtgaatacagcggcgagggaatgaaaagaacaaaggattatttttaatttttggcatgagtgacagagcagttggtggtgctatttactgagatgaggaagaaggggagtgaattttggaactaaaattaacagtttagtgctggtcatattgaatttgaaatgcttattagatatccaagtagaagcactagagcagcatagctcgaaataaaaatttgggaatcattaggatagagatggtatttaacaacacggtactagattagattacccaaagaaagggtgtacagggagaagaaaagagatttgaagactgagtctaggacatcccaacatttaaaagtctggtagatgagaagccttcactggtttgatgagtctattcatggcgggaggtgagaggaaagttggtgactaggtttctgatgactagcagctgaattttaacttcagatttcgcttcttatccttggtaaaataattagccacagagacttcctgatagctcttggtaaggtagtgaagaaggcatgggctttggggaaggaagaaactctaggaggtgaaaacttaagtgggacgcaaatgttgttcagtgtaaggctatggaggaaagccaatggcttactgctctggttttcatctgctttcacctttcagctgcattctaaatggctgtaattaaaaacaacttctttggaacattgtgtttgcagctgtctgctttcccttgagaactcaggtgatctctggaacctcattccgaatctaccctgcacacatggagtctgtttgctggatggggtagaggtttcaaggggagtgaaccctgatgtttgcagataaaattatgcattgaactctaagaattgtttgttcaatgacaaattcactgtttttgttttattctttttgatagaaatgttccttccataggaatagactccttgagagtttttagcatgaagtgttgaattttgttaaaggccttttctgcatctattgagataatcatgtggtttttgtctttgattctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgtcaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactctttttggttggtaagctattgattattgccacaatttcagagcctgttattggtctattgagagattcaacttcttcctggtttagtcttggcagggtgtatgtgtcgaggaatttatccatttcttctagattttctagtttatttgcgtagaggtgtttatatattccctgatggtagtttgtgtttctgtgggttcggtggtgatatcccctttatcattttttattgcgtctatttgattcttctctcttttcttctttcttagtcttgctagtggtctatcaattttgttgatcctttccaaaaaccagctcctgtattcattaattttttgaagggttttttgtgtctctatttccttcagttctgctgtgatcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgtatgtgtcccagagatcctgttatgttgtgtctttgttctcgttggtttcaaagaacatctttatctctgccttcatttcgttatgtacccagtagtcattcaggagcaagttgttcagtttccatgtagttgagtggttttgagtgagtttcttaatcctgagttctggtttgattgcactgtggtctgagagacagtttgttaaaatttctgttcttttacatttggtgaggagagctttacttccaactatgcggtcaattttggaataggtgtggtgtggtgctgaaaaaaatgtatattctgttgatttggggtggagagttctgtagatgcctattaggtccacttggtgcagagctgagttcaatttctgggtatccttgttaacgttctgtctcattgatctgtctaatgttgacagtggggtgttaaagtctcccattattgttgtgtggtagtctaagtctctttgtaggtcgtatctcaaaataataagaggtatctatgacaaacccacagccaatatcatactgaatgggcaaaaactggaagcattccctttgaaaactggcacaagacagggatgctctctctcaccactcctattcaacatagtgttggaagttctggccaggacaattaggcaggagaaggaaataaaaggtattcaattaggaaaagaggaagtcaaattgtccctgtttgtagatgacatgattgtatatctagaaaaccccattgtctcagcccaaaatctccttaagctgataaacaacttcagcaaagtctcaggataaaaaatcaatgtacaaaaatcacaagcattcttatacaccagtaacagacagagagccaaatcatgagtgaactcccattcacaattgcttcaaagagaataaaatacctaggaatccaacttgcaagggatgtgaaggacctcttcaaggagaactacaaactgctgctcaatgagataaaagaggatacaaacaaatggaagaacattccacgctcttgcataggaagaatcaatatcatgaaaatggccatactgcccaaggtaatttatagattcaatgccacccccatcaagctaccaattactttctttacagaattggaaaaaactactttaaaattcatatggaaccaaaaaagagcccacatcgccaagtcaatcctaagccaaaagaagaaagctggaagcatcatgctacctgacttcaaactatactacaatgctacagtaaccaaaacagcatggtactggtaccaaaacagagatgtagatcaatggaatagaacagagccctcagaaataacaccacatatctacaactatctgatctttgacaaacctgagaaaaacaagaaatggggaaaggattccctatttaataaatggtgctgggaaaactggctagccatatgtggaaagctgaaactgggtcccttccttacaccttatacaaaaattaattcaagatggattgtcgacttaaacgttagacctcaaaccataaaaaccctagaagaaaacctaggcattaccattcaggacataggcatgggcaaggacttcatgtttgaaacaccaaaagcaatggtaacaaaagccaaaattgacgaatgggatctgattaaactcaagagcttctgcacagcaaaagaaactaccatgagagtgaacaggcaacctacaaaatgggagaaaattttcgcaacctactcatctgacaaagcgctaatatccagaatctacaatcaactcaaacaaatttacaagaaaaaaacaaacaaccccatcaaaaagtgggcaaaggacatgaacagacacttctgaaaagaagacatttatgcagccaaaaaacacatgagaaaatgctgaccatcactggccatcagagaaatgcaaatcaaaaccacaatgagataccatctcacaccagttagaatggcgatcgttaaaaagtcaggaaacagcaggtgctggagaggatgtggaaaaataggaagacttttacactgttggtgggactgtaaactagttcaactattgtggaagtcagtgtggcgattcctcagggatctagaactagaaataccatttgacccagccatcccattactgagtatatacccaaaggactataaatcatgctgctataaagacacatgcacacgtatgttttttgcagcactattcacaatagtaaagacttggaaccaagccaaatgtccaacaatgatagactggattaagaaaatgtggcacatatacaccatggaatactattcggccataaaaaatgatgagttcatgtcctttgtagggacatggatgaaattggaaatcatcattctcagtaaactatctcaagaagaaaaaaccaaacaccgcatattctcactcataggtgggaattgaacaatgagaacacatggacacaggaaggggaacatcacactctggggactgttgtggggtggagggaggggggagggatagcattaggagatacacctaatgctaaatgacgagttaatgggtgcagcacaccagcatggcacatgcatacatatgtaactaacctgcacattgtgcacatgtaccctaaaacttaaagtatagtaataaaaaaaatgcaatagactccttgagtgttggggatcagagcagaatcaaatcaatctttttctttgagttttgtgcctaagtctaacccctcatgactttctgttgagctctaagaagccttgcaaaataaatgctttatattataatgtagaagattcttatgtgtgtataagtcatgccccaatattttaaaaaacatttcctcttttaaaaaagcattaagtgtatttaaatagtttctagaaacataactttttctcatgaaaatacagtgtacatttttgctagaggtacaattagatgcagagaaattatttgtgccaataactcagtccattattttatgtattttactcagtatatgggtgtattagatgttgaaaatatttgcatacatttttggtgctggaagttgggaagtatagctcatatgccagcaaataagatagtgtgcttgcaaacaggtttattttttaactagttcattttctttttaaggaataccagtaattagctgattaacattctcgactctttacactcacactagaagttgttaatgtagaagacaagtcagcaaagtttttctgtaaatgaccaataaaactttaggctttgcaggccatatggtctctattgcaacaatgcaactctacccttttaaagtgaagagttgtatgtcatacatagacaaataggtacagctgtgttccaatagtactttatttctgaaactagctacagagctggaattggccaagtttatagtttgcccactcctgttgtagaagatcattttacctggaatgtctcagacctgatttattcccaattaagaagttcttacaattgcagaaagatactttaaaacagttgttacatatcataccatatatagcatatagcaactgaggatcttttcaacttgtgaaagtcaccatagatgatgcagtcatgtctacagattattgtttaatatttctttataatctgttctaccccatagcatttaaggccaccaagacatcaccaacaggtttttggagcccgttagatcataccatcaccactcttgcaatatagtgggagacaatttagtgtagtggttataagatcagactttgaaactacacagttatgaggttgagtcctagctcttactcttccactgtcatgtgacttactaaacttcccaatgtgtcagtttccacatctataaaatgagttcttacatgtaaaatactagtacttagtaagcactccacaggcattatctgttattctagcaataattattcagttgtggcaatggcatttttaaatagatcatcaatggaaaagtccttttagacagttcccttttttcatgtgtccagcgtttgaactctcaaataaattatcttctatgatactagtcttagatgaatgtcttttagtcaggctagagtaactcttgctttacagggcaaggcaaatacatcaagacattgaaattaggcttaagcaaacattatggtttacgactcaaattaaccaatctttgttagtatattttattgatgaatccacttctcattttcccaggccccatggacagttgttacaaatgcagacttctctagggctttactgtttttgaccttggtaaacctatgtgttttgcctcaagttggtgggcagttttcatatgctgtgtgtgtgtgtgtgtgtgtgtgtgtgtgtgtgtgtgtgtgtgatgcttttaaaagaattagtcaagttatacaactttcgtagaggatcctctgttgataataattgggaaggggtaggtttctggagcacttatttggtttatttggtttagctcacagacaagaaaacaagaagcaccgggcatggtggctcacgcctgtaatcccagcactttgggaggccgagggggtggatcacaaggtcaagaaatcacgaacatcctggccaacatggtgaaaccctgtctctactaaaaatacaaaaattagctgggcatggtggtgggcgcctgtagtcccagctactcgggaggctaaggcaggagaatcgcttaaacccgggaggcaggggttgcagtgagccaagattgcgccactgcactccagtctggcgacagagcgagactccgtttcaaaaaaaaaaagaaaagaaaagaaaagaaaacaagaagctttagcttttgatgcctgcaggactctcccgggacaaatgctctgggacccatatgtttaaggtgaatatgggaaaagttaactttattaccaggaagtaagcaatcaatgtttgaaaaatgctgtattaaagtttgagtagtagtataatatgccaattattattataaaatgacaactgtctccaaactggagtattaaagcatgatttaaaaccattagtttctctacctaagtaatgtagcttacatatctaccttaattttggaactgaagtattttggctctttatgaatagtcattatgtccttctgcagtgttccagaggaacactgccttccaaagtctggccacctgcatgaggatatcctcagctgagagtttgaacagatgaacatgtggcacatctaatagagaggtgtaatgtttcaccaagaagaagagctggttgtcatgagttagtcctgcagagagcgggagatttcagagtggccaacagcagtatgagtagttagaggctcagttagagtatcagggaaagcagcattatgtagtagttaaaagcaaagcctctagagtaaaacagacccggattcaagtattacttctaccactcattttctgtgcataaccttaagcaagttgctcaacatttcagaatctcagtctcctcctctctaaaggaaaggtgatgataatgaacttaaatcattgggggctgttatgaggattaaatgagcttatgcatgaacgctctttgcacagtaacactaagtgatagttattaatcctccaccagtatcaccctgtctaggcaagcccctggaaaaatcctactaattctgtaaggattatctccaaacttttcttcatgccctggtgatactttgaacctctcttatggcacttttcctgtttttctgtttcttacaattataaatatacttgcctaatctcttcctgctagactgaaagtaacttgagggtagagatattgtgtatgtgtctcccacaaagactaacagaaaatcttgcataaggtaggcacttaatacttactgagctgaattaaattgcactagtttatatttaaaatatacttaccaataagtaccatcagttggtgtcatgttatgacactgccattggcctttactttccttctttccagaggtctatcatttgtcctgcagtgatagttcaagattatctgccatagaagtgagttgggagttcatagagtttccagaaagtcttttcctgtaacactcacagaaagtcatagagaccaaaatggcaataagtactgctgggtcaattcagtaaatatgtattgaaggcttgttgtatgtaagagattgtgggctctgggcacggtagctcatgcctgtaatcccagcagtttggaagggtgaggtgggtggatcacctaaggtcaggagtttgagaccagcctggccaacatggtgaaaccccgtctctactaaaaatacaaaaatttgccaggtgtggtggggggcgcctgtcatcccagctacttgggaggctgaggcaggagaatcgcttcaacccgggaggtggaggttgcagtgagctgagaccatgccattgcactccagcctgggcaacataaaagcaaaactccgtctcaaaaaaaaaaaaaaagaaagaaagaaagaaaaagaaagagattgtgataggtctatggggatacgcaaagctccaggagagagaaagaatgaggagagcaagagagataaattctgactgggagaattattttttgtttcttggctagtgaaggaggcttcaagaagttccaagtcttggtggctaattatgtggacatatcttacggctttggagggggtgaggactgcttacggaccttaaaagatctggtaaatatatatatatataggaacagtggttttctcaatcttggctgctctttggaaacaacttggagggggatggattaaaaatagtgataactgggtcccaatccttagacattctgatgtaattggtgtaggttacactttggacactgggattgttcttaattgccccaggtgactgagatgcacagctgcagctgaaaatcacggcttcagagttgtgtttctgagggagcctcaagtggttatttagttcttgtttataccctggctgagtaagataacagttagtccatccatttatatcaaggacattccctgctataatttggtaagctatttcttggagggaaaaatacttttttgtcattgttgcaatttttactgcctttattcatttctcaaacgggaataattgacgattaagatgtgtaatggacaatttttacagcaaagtgaggaggtgactggagaccatatgttgcctacgaacagagcctacagcaaacgttgaagagagaaatactttttaataacagactccaatcacttattcatttatttagaaaacattaaaaaggactatattaatttcctattgttgccgtaacaagttaccacaaacttagtggattaaaacaacacatttattatctaatagttctgaaggtcagaacgcctaaaatcaaagtgttggatactgcattctttctgatggctctagggaataatttgtttccttgcctcttctagcttccagaggctactcatgttccttggcacaaggctgcatcacttccacctctctgttgtcacatcttctctgactcttgccttcctcttacaaggactcttgtgattacagtggacccacttgggtaatctaggataatttggcaatttcacctttcttaatcacatctgtaaaattcctttggacatgtaaggtagcatattcatagattccagggattagaatgtgggcttctttgggggaggtcctcattcagcctcccacagggattaaagatgacactggtactatgactgctaatatttacttatgtcctctataacacatcacaaatacctaaagattatttattgtgggccaggccctgtgataaatgcattaatgccattatctcagttgaacttatgacgtggacattattaatatccccatattttgtatgagaaaactgaggtgcatagagattgtgatttgctcaaactcacataacaactaagtggtgaagtcagatttcaaacccacgtgagtctgagttcagtgccctaatcatcatcaaagattacattttctagtactcttgactttaagggcttaggtattcattccatagataaggtagttgttcgagtgtgtatcaaacatcacactacaggtacagtagtgaacaagatgaggttcctgcctgacatcttggagctcacattctcgaggagtatatagcaaagtattcagagaaacaaataatgttaggtagtggtaagtgctgcaaggcaaattaaagccgggtacagggatacaaaatgacaggaagtgaggatgccccattgagctattgtaaataaagtagtcagaggaaccttctaagaagagattattgtgttcatggatgagaatacccaattttaagatggcatttctcctccaactgatctacagcttcaacacaatccctcaaaatcccaggtggattttttttttttgcagaaattgataaggtgaccctaaaataaatatttgaatacaaagggcccagaatatccaaaacaaacttgtaaagaatttaggggaatcatgtttcccaatttcaaaactcactatcaagctatattaatagatagtgtggtacttgcataaggatagacatatagataagtggaatagaattgagcccagaaataatcccatgtgtctatggccaattgattttcattaaaggtgccaaaacaatttaatgggataaagaatcatcttttcagcaaatggtgctgagataacgtgatacccacatgtaaaaattggacccttacttcataccatacatataattatgtaaagagcaaaaactataaaattcttaaaagaaaacataaatgtaaatgttgttatttgggttagacaatgcctttttagatagaacaccaaaagtacaaacaaacaatcaaattatatatatatgtatatatatatgcatatatattttttttctaaattaaaaactttagtgttccagaagaaactcaagtaagtgaaataacccatagaataggaaaacgtatttgcaaatcatactgtttgtaaggagtctgagatccagaatatataaaggactcttataactcagtgattagaagacagataacccaattaaattatccagtctatcattgatgggaatttgggttgtttccacacctttgttattgtgaatagtgctgcaatgcacatatttttctccaaccagagattaaaatagctacatcttacttgttttgtttgtttctttaaaccatcttactacaaggaaaggatcaacagaagctgggtctctgtgagaaatcccatgtcattataattcctgatcctgtatattaaaatgatatacttcacaaaaaaatagacaaaggatttgaataaacatttctccaaagaagatattcaaatgaccatatgagagaaagcctcacatccttagtcattaggaaaatgcaaacaaaaccacaatgagaagccactttatactcaccaggatagccataatagaaaaaaatgaaaaataagtgttgtgaatgtggagaaatcagtaccttcaaacattatttgtggaaacgtaaagtagtccagtcactttggaaaagagtttgacaattcctccaaaagacgaaactgatttatcatgtgccctagcaattccacatattgatatctactaaagagaaatgaaaatatatatccacaaaaatatttacatgtgaatgttcacagcaggattaatcataatagccaagaagcagaaaaaatctcaatgctcatcacctgacagatggttaaacaaaatatagtatatccgtacaatggaataatattcaacagtgggcaggatgaaccttaaaacattatgctaagtgaaagaagctagatgtaagaaaccacatgttgtatgattctatgtatatgaaatgttcagaacaggaacagaaggtagattaatgtttgactagtactgtgtgtaagaatagggaggactgcaaatgtgcatgagggatctttttaaagtaatggaaatgttataaaattggattgtgatgagagttgtacaacttcaaatttactaaaacttattaaattatactattaaagctagtgaactttatagtacatataactcaacaaggctgttaaagaggaaaaaaggtgatatttgagcatacaaatgaatgacaagaaggacaagccatgccaagaatctgggtgaaaaaattataggaagaaagaacagcaagcaaaaaagtcctaggcaggagtgttcttagagtttttgaagaatagtaaaaaatgccactgcatgtgtgatagtagtaggagatgaggtcagagaagagtcaggagatctgatcgtgaaaggccttgtaagcaaatataaagatttccaagttttactgtacgtgtgatgatagccataacagggttttgagcagaggagtgatgtcatctgctttatgtttttaaaggtaactctcactgctgtgtattgaaaaagctatagtggaagcacttaggagtacattgccatgtttctggggtataaattgagcaaacaaaaaatgttttatgggagtaataattgagtaagaaagttcaggctgttgagttaattaagctcgagtactgattgggcacccagtattgctcagcatttcgttaggttctataccaagactttgtctctgatatttagaatttaagggctatgaagacagggacagagtcttccttgttcactgctgtatccttagctcctagagttgcacctggtaggtgatcaagaaatactcattacatgattgaataaatgaatgtaggagctttagaacgtaaatcatacagtgtttttattttattccaatgagttgccaatatttaaaagtcaagaaattccatataaggataagaatgttcagcttttatggtgatattggagctctatttctgcatccatttagaggagatatgcactgaccagtttcaatagttcccactcagccagtttactcatatatattacctatctcatctgtataagcatcatgggacttctcagccttcctaatcacatgagcgaattccttctaataaatatctatctatttatctatctatctatctatctatctatctatctatctatcatctatctatctatctatctatgtatctatctatctatctatcatctatctatctgtctatatgctatttattctatttctctggataaccttcactaattcaaagacattttgtttatccatttgtctataagtggaaattagggttgcttctacttcttggctattgtgaataaaactgctatgaacataggtatacaaatatgtctttgagactctgcttttgattttttttgtatatacacccaaaagtgagattactaaattatgtggtgcattatttttgattttgggcagaactttcatgctgttttccgtaaggcttgtaccactgttggtgtacagtcctaccagcagtgcacaggggttccaatttctctgcatcctgaccaatacatgctattttctgcttttcttttgatagtagatattttaataggtgaggtgatatttcattttggttctaatttgaatctctctgatgattagtggtgttgaacatctttccatatgcttattagtcatttgtttatcatctttggagaaatgtttattcaagtcagttgcccatttgtatttcacattttgttgctgagttgcaggaattttttatggattctgaatattaaccttttatctgatattttatttgtaaatattttatcccattttataagttgccttttcagtctttggatcatgtcctttgatacataagtttttaagtatgatgtacttccatttgtccatttttgttttgatttcctatgcttttggtgacatatccaagaaatcattgtcaagttcaatgtcatgaaactttcccccagtgttttttttaggaattttataattttgggtcgttaggtctttgatccattttgaattaatttttgtatatggtgtaagataagggtccagttttattcttcttcatgtggttattcagtttccctaatgccatttgttgaggagactgtcctttcctcattgagtggtcttggcacccctggcaaatatcgtttaaccatatatgtaacagtttatttcttggctttctattgtgttacattggtatatttttctgtctttatgccagtactacagtgtttttatcactgtaacctatattaaggtttgaaatcaggaactgtgaagcttccaaatttgttgttcttctcgaaaatggctttgactattcagggtcccttgagattccacatgaattttaggaagaatttttctatttctgcaaaaactactgttgggatttttataaggattgcattgaatctgtagattgctttgagtagtagtggcttcttaacaatattaagtcttccagtctatgaacacaagatgtgtttccatttatttgtgttttcattattttctttcagccatgtttggtatttttcagtgcacatgtcttgtgcctccttggttaggtttatccttaagtattttattattgttgatgctattgtaaatggaattgtttctttaatttcctttttcagattattcattgttaattgcttggtgatttttttaaagtttagtttataattatgtaactttggaggttgataatgagaaaatcacagaatatttctatgcagaatattattaaatttatcaattttgggaataataatggcacataatgaggctttactttgttccaggcattaagtgtttatcataaactcatttaatttataacaaccctataaagtgtgcactattactattctcatttaacagatgagaaaattaatgcatagagaaattaaataactttttcaagattacacatccaggaagctttagatgcaggaatagaaaaataaaaacatattatgtttagccagataaaataaattagcttataataatttgacacttactcctttgactgggtcttgggaatactaataccacttagtattgctccacttctgatgtaacagatgtaagagaaaaagatcagctaagatctggctcttgttctcatgaacagacatgcagtatgaatagaagaaacgttgaataccagccatggaataggactatttaaaagcatatttcatttcagatgatgctatgagactcagcttaacttgctcattatttcctttataagaagtcaggtaatataaactgggttgggcagtggggggagtgagacactgttgcagcatcaaccaaggcctgctacaagaggttttatacctttaatcagtcatattttatctgaagaaggactctcaggctgtgagaatttctccttggattcagaaatgagaaaatgggggatgggtaatttttgctattttcttttctttttgttccctatacccaaataaatgggccttttcaatttttaaatccctggttaagcatatttttactgttataaatgcatggagatatgcttcattcaatcagaatgccctgcctggtggaatagacagaatagaaatggaatgactaaaaattactgaaagtagtctagaacatcttgcaacagcaaatgaattacttgttacaaatattatagagaggatttaagcactgattagagagtaggaatagataaggttcttgtcaactctaagaaaatataattaaatacattcatagaagagagacggtttgggcacacccaccactgtcccttctggtgcatgcatcaggcagacctgcagtcacacacatgtgctcagacccaccactgccccactgacatgcacatgtgtgaggacccctgccaccctactgatgcacatgtgcaagggggctcaccactgtcctgccagagctcttttgccaacagactccatcagactgttgttgctgcaggactgggaaaccctggccccaccagtgcagctggtgcttaacctcaaggaagcagagaaaaaagctgtaggccaggtcccagtccctcagggtaagagtatgcagtccaaaagtgctgagctaagccttggctccatgaaagtatctagaaatgaagccaatagactaaaaccaaattataccacattcaaaccctcaagagtatggaagaatatacaaataaaaagccacatccaaaacacagcaactttgaagattaaagaaacatcaggccacacagatgatagagaaccagtgctagaactctggcaactctaaaaaccgagtgtcttcttacctccaaatgactacactagctctccagcaatggttcttaaccagactgaaatgacagacatacagtacagaatctggatggcaaagaagctcatcaagatagaggagaaggttgaaacccattctaaggaacacagtaaaatggtccaagagttgaaagatgatgtagctattttaagaaagaaccaaacaattttaggaagtaaagaactcactacagaaattttagaatgcaattggaagcactaataataaaatagaccaagccgaggaaaaaatctcagagctcaaaggctgcttcttcaaatcaatgcagtcagaataaaaaaagaataaaaatgaatgaaacctccaagaaatatgggattatgtaaagagaccaaacctatgacatattgcattcttgaaagagatgaagacagagcaagcaacttggaaaacatatttcaggatacggtgcatgaaattttttccaacttcattggagagattgaaatgcaaatttaggaaaatgcaaaaaaaaaaactttgcaaattactataggagatgaccattcctaagacacatagtcatcagatgctccagttaacatgaaagaaaaaaatcacaaacgcaactagaaagaaggggcaggtcatgtacaaagggaaccccattaagctaacttaagtgagtctttcagcagagacttgcaagccagaagacattggaggcctataagcatcactaaagaaaagaaatttctaccaagaatctcatatcctgccaaactaagcttcataagtggagaaataagattcttttcatacaagcaagtgataggagaattcagtaccacaaaacttgcctctgaagaagtccttggctgggtgcagtggctcacgcctgtaatcccagcattttgggaggctgaggtgggtggatcacctgaggtcaggagttcaaaaccagcctgaccaacatggagaaaccccgtctctactaaaaatacaaaattagccaggtgtggtggtgcacgcctataatctcagctactcgggaggcagaggcaggaaaatcacgtgatcacaggggcagaggttgcggtgagccaagagcatgccatttcactcctgcctgggcaacaagagtgaaactctgtcaaaaaaagaaaaggaagaagaaaaggaagaggaagaggagaaggaggaggaaagaagaaggaggaggaggaggagaagaaggagaaggagaaaaaaagaagaaggagaaggagaaaagaagaagaaggagaaggagaaggagaagaagaagaagaaagaagaagctcttaagggagtgctaaatgtggaaatggaataccagtatgtggcaccacaaaaacacacttaagtacatatcccaatgacactgtagaggaactatgcaatcaagtctacataacaaccaactaacaacatgataacaggaccaatttctcacatatcagactaaccttgaaattacagtggcttaatgcccaacttaaaaggcacagagtatcaagccggataaagaagctagacacaactgtatgctgtcttcaagagacccatctcatatgaaatgacacccataggttcaatgtaagggaatggagataggtttatcaggaaaacagaaagcaaaagagagtaggggttgttattcttatttcagaccaaatagactttaaaccaacgattaaaaaaaaagaaaagcaatacatgatgataaaggttcaattcattcaattcaacaagacttaacaattctaaatatggcccactctccctccactctgtcctgtggctgcccactgccctcctactgtccagcgtggccctgctgcactccagccatgtcctctccaggatccccactgccttccacccaggcctcaccaccacagcctctgccagaggtcctggtggacctatgtggagatgggacttccagatcccatcctgggagtcaccaaagcctttaagagggacaccgatagcaaaaagatgaatctgggagtttgtgtctactgggatgataatggaaagccttacatgctgcttaatgtcaacaaggaagaggcccagattgccacaaaaaatttggacaaagaatacctgcccattgggggtctggctgaattttgcacggcatctgcagaactagccctgggtgagaatagtgaagtgttgaaaaatgtccagttattcactgtgcataccatttctggaactgcgaccttaacgatcagagcctgttttctgcaaagattttttaagctcagccaggatgtccaaaccatcctggggaaatcacacacccatcttcagggatgctggcatgcagctacaaatttattgttactatgaccccaagacttggtgtttgacttcacaggtcgtatggaggacatttcaaaaataccagagcaaagtgtttttctgcatgcctgtgcccataatcccatgggagtggaacctcgtctagagcagtgaaaagaaatagcaacagtggtgaagaaaaataatctctttgcattctttgacatggcctagcaagggtttgctagtgatgattgtaacaaggatgcctgggctgtgcaccacttcatcaaagagcattaatttttgtctctaccaatcataagccaagaacatggagttatctggcaagtgtgtgggagccttcactgtggtttgcaaagatacagatgaagccaaaaatgtagagtcagcagttgaagatcttgatctgtcccatgtattataatcctcccctcaatggagcccagattgcttctaccattcttaacaccgaaatttgcaaaaacaatggttgcaagaagtgaaaagcatggccaaccacatcattaacatgcagactcagctggtctccaacctaaagaaggagggttctacccacatctggcaacacataactgacaaaattggcatgttttgtttcacagggctaaagcctgatcaggtggagcagctgaccaatgagttctccatctacatggtagaagatggccacatctctgtggcaggggtcaccttcagcaacatgggctaccttgcccatgcctttcatcaggtcaccaagtaatatcactggtgcaaggaaacagaaacaacctttctgtcttcagtctctgctattgggagcttcacaaagaggatgacagaaggtggatggtggtgagtagatcatttctttcagctgcattgtgtaacaacattcagcaattgaatgtttctcagaaaagaacatgtagtgacatagggcagagacatccatgtttggtgtctggaacattgtggctctaaaccaaactctcccctgtccttttatctcccaacttttctcaaagagtttatacatgcaagaaagtcatcacaccaaaaaacctgtcagttatgccattgcaatatttcagaagctttaactgaagtgtaatacagtgtcagggttcctcatgagaaatagcacacattggaagctttgagagaagacctacttctatcatgaacagtcagcactgtgtctgtcctcccatgatggagcaaccttaaaaagagaccatattgcagaaattgcattttatgaaaaccaatcagtatgctgacattacagcaaggaaaataaaagatgttgttttctgtcttatttaagaaaaagagaaggctctctcttctcccttgtcattgttgtttttttccttatgcacaaagatttttaactaatgtagattttcattccattctactgcttgattgatcatcaaccccatcctgttgggatttatttaaaaataaagaacataattttctgctgatgccttaccatcacctttctcagcaaagaatagtggagagtaggtaactgcactttatctcagcatcctcttcaaggattgtatatttgtcttctgttgagatgttgtctctgcccagttggacctactctctttgttgaatgtagttgtgcagtcactcatttcacatcatgagttaggtggcacagggcagtaccaggaaataggatattctaggctttatgtgctgccagctgggatcaagctacaccctttggaaagaatcactatctgctctaatcatgtagacttattgcagcctggcttctctgttacaataaaattactgaagacactccccctctgaaaataaaaaaaaatcatttctaaatatatattcattcaacactggagcacccagatacataaaacaagttcttggacacatatgaagagatcaagataaccacacaattatagtgaaaggcttcaacacaccacaaacagtgttaaacatatcataaaggcagaaaacgaacaaagatatttgggatgtaaactggatacctgttcaaatgtacctaacaggcatttacaggatactccacccaataacagagtatatattcgtgtcatctgcacatgacacatactctaatatcaaccatgcacttggccataaggcaattctcaacaattttttttaaaaaagccaaaattattccatctacacttttggagcataatgcaacaaaaatagaaatcaatacaaagaagatctctcaaaactcataaaattacatggaaattaaacagcctgctctctaatgacctgcctcgaatgtaaatgaggcagaaatcaagaaattatttgaaactaatgaaaccagggatacaacataccataatttctgggacacctctgaaacagagttaagaggaaagtttatagcactaaacacccacatcgagaacttagatctaaagttaacaacctaccatcacacctagaggaactagagaaaaaaagagcaaaccaacctcaaaagtagccaaagaaaaataacaaaaatcattgctaaattgaatgaaattgagatgcaaaaattcatacaggttcacacctgtattcccagcactttgggaggccaagacaggtggatcacttgagcccaggggtttgattccagcctgagcaacatggtgaaacttcacctgtataaaaaaatgcaaaaattaaccaaatgtgatggtgagtgcctgtagtttgagctacttgggaggctgaagtggaagaattggtggagcctgggaggtgaaggttgcagtgagccaagattgtgccactgcactccagcctgggtgacagagtgagaccctatctcacacacacacaaaatctatacaaaacatcaatgaaatcaaaagttggtttcttgaaagaataaataagattgatagactgctagatagacaaatgaataacagaggaaagatccacatgaacacaatcagaaatgacaaagatgacattaccacaaccccacagaaatacataaaaactaccagagactattacaaacacttctatgtacacaaattagaaaacctagaacatattcgtgaattcctggaaatacacaacttttcaagattgaaccaagaagaaactgacaccctgaacagaccaataaagacttcccaaattgaatccctaataaaaaatacctatcaaccagaaaaagccttccactggaaggattcacagctaaattctaccagacatatttaaaagacctggtaccaatcctactgaaactattccaaaaaattgaggaggacttcttcctaattcattctatgaggccagaatctttctgataccaaaacctggcacagcaacaatgaaagagaactccaggccaatatccctgattaacacagacacaaaaatcctcaacaaaatcaaattaaccagcacatcagaaagctggtctaccatgatcaggtaggctttattcctggcatgcaaacttggatcaacatatacaaatctatacatgtgatcatcacataaacagaactacaaaaacacatggtgatgacaatagttgaagaaaaggctttcaatgaaattcagtattccttcgtgttaagaaccctcaacagactaggcatggaagaaacatacctcaaagtaacaagagccatctctgacaaacccacagccaacatcatactgaatgggcaattgctggaccccttccccctaagaattggagtaaaacaagaatgcccactctcaccacttctattcaccataatactggaagtgctaacctgaacaatcaggcaagggaaagaaataaatggactctaaataggaagagaggaagtcaaactatttctcttcacagatgatataattctatagctagaaaacatcatagtctctgcacaaaggctgttagaccttactaacaacttcagtaatgtttcaggatacaaaatcaatgtacaaaaattaataggatttctatacacaaataatgttcaagctgagagccaagtcaagaactcaatcgcattcacaatacccacaaaagaataaaatacctaagtgtagagataaccagggaggtgaaacgtctttacaattagaattgcaaaacactgcctattttggacctactctggctcagagggcagcccactgatatgaagtttgtgtctcgggcctggcagcattcaccacaagctgattgaagaacatttgggccttaagtgaatatcaatgttagcctacagcactccccatgggctattggtggtggtggcatgtggagagacttgtctgactgtggaagaaggaggcaagagtgtgaaggacattgtcttgtggcttgagtgccagcttagctgcagtagaaaacagtaccagttagatctctaaggtttttgactccagtccctggttcccagatggcatgtctggacttggcccagacctggagaaactcacctgtctggcttcaccatctgctaattgtggagccctagggcattaggaaaacataagcattagctaggtagtggttatggaggccttgggtgagaccaagtgctttgctggcttcaggtctgtcccagcacagacgcaatgatggtagctacatgggtgcatgtgtcattcctctaccagtccaagacagttgtccatggagagagagactctatttggaagaaaacaagggaacagaacaagagtttctgtcaggtaatccagataattcttccacaacttatctaggatcagaaaggcattacctctatgagtctgcaagaactactgcattactggacctggggtgcccactaatgcagatatgtctgcagtgaccaaaaacttagatcacactaccaaagtccatttagatacctggcaagtcttcccaagaggtattggtacaaagaagcccagactgcaaagactgcaataaatactcaactcttcaatttgcagtcactgatgaacatccacatgcaaaaagaccatccaggaaaacatgccctcaccaaacgtgctaaagaaggcaccagggacaaatcctggagaaacaaagatatgtgaccgttcagacagagaattcaaaataactgtgttaaggagactcaatgaaattcaagataacacaaagaaaatattcagaattctatccgataaatttaacagagattaatgaaaaacaatcaagaaaaaaattagagttcaaaaatgcagttgacatactgaagaatgcatcagagtctcttaatagcagaattgatcaagcagaaagaagaattagtgagcttgaagaaaggctataggaaaatacacagtcagagggacaagaataaaaataaagaagaacacctacaagacctggaaattagcctcagatgagaaaatctaaaagttattggccttaaaggggaggtagacaagatgtggatagagagtttattcaaaggggtaattacaaagcacttcccaaacctaaggaaagatattaatatccaagtacaagaaggttacagaacacaaagcagatttaaccaacaattgtctcaaagcatttaataatcaaactctcaaagttcaagaataaaaacaggattctaaaagcagcaagagaaaagaaacaaataatatacagtaaagctccaatacctctggaagcagacttttcagtgaaaatcttacaggacaggaaagagtggcatgtatttaaagtgctacaggaaaaaaaaaaaaactttagaatactgtagccagtgaaaatatacttcatacatgaaggagatataaagactgtcctaaagtagcaaaagctgagggatttcaccaacaccagacccatcctacaagaaatgatagagagaattctgctatcagaaaggaaaggacattcatgagcattaagaaataatctgaaggtacaaaactcacgggtaatagtaagtccatagaaaaacacataatattataacattataattgtagtttgtaaactacacttaccttaaatagaaagacaaacagatgaaccaataaaaaataataactaagacaacttttcaagacatagacagtacaataagatataaatggaaacaaacccacaaattttaaaagtggggagatgaagttacagtgtagagtttttattagttttcttattgcttgtctgttcatgcaatcagtgttaagttgtcagcagtttaaaataatggattttaagatagtatttgcaagccttatggtaacctcaaatcaagaaacatacaatagatacacaaaaagtgagaagcaagaaattaaaacagaccttccagatggaaaatcagcaaagaaacattgggcttaatctacactatagaccaaatgtgtctaatggatatttacaagagaatcactttcactaaaaggaagacatgaaggaaggaaaaaaggaattgaagatcacaaaacaaccaggaatcaaataaaaaatggcaggaggaaggacttacttattaatagtaacattgactgtaaatggtctagacattgcaatcagaagacatcaagtggctgaatggatttaaaaaaatgcaataatttgtttcctacaagaaatatacttctcctagaaagacacacgtagactgaaataaatggatgaaaaagattaatatcttggcagtggaaaccaaaaaatgcaggagtagttataccagtgaaaatagatttttaaggtgaaaagtataagaagagacaaagaaggttatatgatttgtctgtgtccccactcaaatctcaccttgaattgtaataatccccacatgtcatgggagggacccagtgggaagtaattgaattatgggggtgggttttttccatgctgttcttgtgatagtgaatgagtctcacgagatctgatggttttataaaagggcagttcctctgcacatgctttcttgcctgctgtgatgtaagatgttgtgtgcttccccttcatcttctgccatgattgtgaggcctccccagctatgtggaactgtgattcaattaaacctctttcctttataaattatctagtctcagatacatctttattaggagcatgaaaacagactgatacagaaggtcattatgtaatgataaggtggtcaattcagcaggaggttataacaattgtaaatatatatgcacccaacactgttgcaatcagctatataaagcaaatataattagagctaaagagagagagatgccaatacaataataactagagacaccaacatctcactttcaccattggacagaccttctagatagaaaaattaacaaaggaacattggacttaatctggactatagaccaaatggatctaatagatatttacagaacattcaattgaatggctgcaggatatacattcttctccttagcacatggttcagtctcatggataggccatatgttaggctacaaatgtgtcttaaaacatttaaaaattgagataatatcaagaatcttctgtgatcacaatggaataaaaccagaaatcaaaaacagaacaattttggaaattatacaggcacatggaaattaaacaatatgctcctgaatgaccagtgggtcaaagatgaaattaagaaagaaattgaaaatttttttgaaacaagtgaaaatggaatcatgacatatctaaacctacaggatgcagtgagagcagtcctaataggggagtttataactataagccactatgtgaaaaaaagaaatacttcaaataaacaatttaatgatgcatcttgaagaactaggagggcaagagcaaaccgaacccaaaattagtagaagagataacaaagagcggaaatacatgaaaatgaaatgaagaaacaacacaaaagatcaatgaaacaaaaagttgtggttttttaaaagataaaactgacaaacctctagccagacttactaagtgaaaaagagagaagacccaaataaataaaattagagatttaaaagcagacattacaattcatttcacagaaatccaaagaaacattacaggctaatataaacaattatacaccaataaattgtaaaatctataaaaaattgataaattcttagaaacatacaacgtatctacattgagaaaattcaaaacctgaacagaccagtaataagtaatgagatcaaagctgcatttaaaagtctccccacaaagaaaatctgatgactcaatgactgtgctgctgaattgtaccaaacatttaaagaagcactcatattatttctactgaaactattccagaaaataaaggatggaatactttcaaactcattctatgaggccagtattactctcatatcaaagccagacaaaaacacattaaaaaaactccaagtcaatttctctgatgaacattgaattgaaaatcctcaacaacattaactagcaaaccaaattcagtaatacgttaaaaagatcattcatcatgattaagtggatttattccaaggggtcaagactgttttaacatgtataaatcaatcaatgtgatacactatagcaaaagaatgaaggacaaaaaccatatgatcatctcaattgatgctgaaaaaaaaatttgataaaattcaacatcccttcattataaaaaccctcaacaaaatctgggtatagaacaaacagaccacaatgtaataaaagtcaaatacaacagattcacaaccagtatcataataagtagggaaaaaccaaaacctttaagatcagaaacacacggatacctgttttcaccactgttattcaacgtagtactgcaagtcctagctagagcagtcaggctggagaaatacagggcatccaaattggaaaggaagatgtcaaactgtttttgtttgcagatgatatgatcttatatttggaaaaacctaaagacaccacgaaaaaactattacaatgggtaaattcagcaaagttgtaagagatcaaatcaacatgcaatcatcagtaggacttctatatgccactagcaaacaatctcaaaaagaaatcaagaatgtaatcccatttaccatagctaaaaatataatttttaaacctaggaattaatccaaccaaagaaatgaaagatctctataatgaaaactgtaaaacactgaggaaagaaattgaagaggacacaaaaacttgcaatgatattctatgttcatggattggaagaatcaacattgttaaaatgttcacactacccaaaggtagtctgcagattaaatgcaatctctacgaaaatgctaatgacattctttacaaaaatagaacaaaaatcataaaatttatatggagtcacaacagacctagaatagccaaagtcatcctgagcaaaaagaagaaaactggaggaatcacactaccatacttaaaattacactgcagagctgtagtaagcaaaacaacatggtactggcataaaaataggcacatagcacaaatggaacagaatggagaattcaaaaataaattaatgcatttacagtgaactcatttttgacaaaagccaagaacatacattgaggaaaggacagtctcttcaataaattgtgctggcaaagctggatatttataagcagactcaaaaaactatacccttatctcttgccatacacaaaaatcaaatcaaaattgattaacgacttaaatctaagacctcaaactatgaaactagtacaagaaaacattgaggaaactccccagaacattagagtggcaaagattttttgagtaataccccacaaaaacatgcatctaaaacaaaaatggaaaaatagattacatcaatttaaaaagctgtacagcaaaggaaacaatcaacgaaatgaagagacaacccacaaaatgagataaaatatttgcaaacttcccatatgacaagggattaataaccagcataataaggagctcaaacaactctataggaaaaaaaatctaataatctgatcaaaacatgggaaaaagatttgaatagacatttcccaaaagaagacatacaaatgacagacaagcatatgaaaaggtgctcaatgtcatttaccatcagaaaaacgcaaatcaaaactataatgaggtatcatctcacttccattaaaatagcttttatttaaaagacaggaaataaatgctggtgaggatatggacaaaagggcacccttacacactgttgatgggaatgtaaattagtataaccattatggagaaccatttggttctccataaaatccataaaatccagcaatcccacttctagatatatacccaaaagaaaggaaatcagtatatcaaagagatatctgcactctcatgtttattgcagaattatttacattagccaagatttttaagcaacctaagtgtctgtcaacagatgaatggataaagaaaatgtggtacatatacacaatagtgtatcattcagccataaaaaagtcttgtcgttggcaataaaatggatggaattggaggtcattattttcagtgaaataagccaggcatgaaaagacaaactttgcatgttctcagttatttgtgggagctaaaaataaaagcaatagaattcatggagatagagagtggaagtatggttacaagaagcttgaaagggtagtggggcattggagaggggtgtgaggatgtttcatgagtacaacaaatagaaagaataagatgtaggatttgacagcatgagggtgatcatagtcaataatgatttaattttatgttttaaaataatgacaagagtataactggattctttgtaacacagaggataaatgcttgaggtgatgaatactacatttaccctgatgtgatagttatgcattggctttctttatcagaatatttcatgtaccttttaaatatatacatctgctatgtacccataaaaattttaaattacagaaaaactgctgaaggatatcagagacaacacaatgaaatggaaaacatttcatactcatggataggaaaaatctatattgttaaaataaccatactgcccaaagcaatttacagatcgaattctatttctatgaaactaacaaggttacttttcacagaatttggaaaaactattccaagagtcatattgaaccaacaaagaacctgaatagccaaaggaattctaagcaaaagaagcaaagccagaggcatcacactacttgacttccaactgtactacaagaatacagtaattaaaacaccatggtactgatacaaaaacagaaacagaccaatggagcagattagggaacctagaaacaaagccacacacctgcaatcatttgatcttcaacaaaatttcaataacaaacaatgaataaccttttcaagtagtggtgatagcataactggctagccataagcagaagattgaaactggactcttgtcttttttcatatacaaaatcaactcaagatggattagagactcaaatgtaagccctaaagctgtataaaccctagaagaaaacctaagacatactattttggacataggccatggcaacgatttcatgtcaaagactccaaaagcaatatcaacaaaaacataaattgacaagtgggaagtaattaaattaaagaggttctacctagcaaaagaaatgatcacagagtaaacagtcaacctacaaaatgggagaagttatttgcaaactatgcatttgacaaagatctaatatccagaatccataaggaacttaaattaacaagaaaaaacaaccccattaaaaatgggcataagacatgaacagatacctctcaaaagaggacatacatgctatcaacaagcatatgaaaaattctcaacgtcactgattattagagaaataaaaatcaaaaccaccatgtgataacatcttacaccagtcagaatggctatttaaaagtcagaaaataacaaaagtttattagattttggagaaaagggaatgcttatacactgttggtggaagtgtaaattagttcagccactgtggaatgtagtttgaagaattctcaaagacagaaataccattcaagtcagcagtatcatttctggatatacacccaaaagaacacgaattgttctaccataaagacacctgcagttgtttgttcatagcagcagtattcacaatagcaaagacttgaaatcaacctagatgctcatcaacggtggtctggataaataaaatatggtacatatacaccatggaatagtacacaggcataaaatacaaaacaatgttcatttcagcaacatggatgcagctggaggccattattttaagtgaattaatacaggaacagaaaaccaaataccacatattctctttcgtaagtgggagcttatgaggaattgagtacacatggataaaaagaagggaattgtagacaccagaacctacttgagagagagggtgggaggaggttgagggtcaaaaaactacctgttgggtactatgctcactgcctcattgcacatcaaatcacagtgacatgctatttactcacttagcaaacctgcacatgtacctccaaacctaaaataaaagttgaaacagaaatagaaaaagagttgtagaattttgaaaaaaaatattccagcccatatttatcaaaattttattatatatgtcaagcattgcatactggagtatgaggatccaataataaacaataataaggaaaaaatagagatagtgtaggtgcagggtagctaggatcatttctttattaatttttcacaaagaagattgaatacactgtgtttggtcatttataaaaataaatacatgtattaacataaaccttcagataaataaatatttgctgaaaagcattctgatgagtagtatttacttattcatttaatccatatttattaccacatattatgtgccaggtacttaactaggtgctggagaactgcaatgaataagacatacttggcttctgcctttacagatattatagtctagtaagtgaagacaaacaagctttctgtaaagaatgtcattagcatttttgtagagattgcatttaatctgcagactacctttgggtagtgtgaacattttaataatattgattcttccaatccatgaacatagaatatcattgcaagtttttgtgtcctctttgatttctttcctcagtgttttacagttttcattatagaggtctttcatttcttcggttggattaattcctaggtttaaaaattatatttgtagctattgtaaatgggattacattctgataaacagaaaattaatgaaaaaacaatcagtatgatacaaactgtaaaatgtgttatgaaggaaacgtaggatatagtgaaaaaggatgactagaggaggccacacagggtggtctggcctctgtgagatgattacatttgagttgagatctaaaagataaaaaggaaccaacaaagacaaaagtttggagcagggatagtgttccaggaaggaagataagtgcaagaccctgaagagagaatgcatttggcatgttgggaggatttaagggtaatgcaaatgtggtgaacaaggggaagagtaggagaggaattcagaaaggtaagaaggatcttttaacaaataaggaatgtataataaaatatgcatttattaataaatttctttatttgattttaaatgtctctcctcaatctacactttgggacttttactaaagtcccgaatttcatcctcattccacatattgggacttttatcctttcagcatagggcagatgcactttgtgtgtttgcatgaaactttatgaacactgaaatttgaattttatataattctcatgtttcgcaaaatagtgtttttcttttgaaatttttaatcattaaaaaattttaaaaccgttattaccttgcaggcactacaagaacaggtggcagaatttggccaatacattatatcatgcaggaccccttgtgtcctcatttgtataataggcctcttttgatgaagggaatggctgacttttttaaaaaaaaattgaggtataattaacacataaaaatgtattcatggccaggcgcggtggcttacgcctgtaatcccggcactttgggaggctgaggcgggcggatcacctgaggtcaggagtttgagaccagcctgaccaacgtggagaaacaccatctctactaaaaatataaaattagccaggcatggtggtgcatgcctgtaatcccagctactcgggaggctgaggcaggagaatcgcttgaacctgggaggtggaagttgcggtgagctgagatcacgccattgcactccagcctgggcaacaagagtgaaactccgactcaaaaaaacaaaaaaacatgtattcatattttcatatatctatacattgtgaaatgattaccacaatcaagctaattaacatatcacttcacatagttaccttttttggtagtgagaatatttaatatctgttcttttagcagattttgagtacacattacagtatgatgaacaatgtcacaatgctgttcattagatctctggaacttattcatagtgcataactgaaactttgttctttttactcaatatcgtcccatttcccccagctcctgattaccaccattcttctctatgattctatgagtttgacttttttagatttcacatataagtgagatcatgcagtattcgttttgtggcttgcttttttcacttttacttagcataatgacctccacttttatctacgttgtcacaaataactttatttttaaggctaactagtagtccatttgtgtacacacacacacacacacaccccatgttttctgattcctttggcagttcggcatgttttgtggtttcatatgaactttaggattttgtttttgtgtttctgtgaaaagtgcctttggaattttcatagggattgcattgaatcattagattgagttgtactgacattttaacaatattaattctaatctatggacatgggatatctttccatttatttgtgtcatcttcaatttctttcatcagtgtttcatagtttttggtgtacaggtctttcacccactcagttaagtttattcctaaagaatttatactttttgtcattattataattcttaatgtctctttcagaatttgttcttagtgtaccaaaatgcaattgattttctatgttgattttgtatcctgaactttactgaatttgtttattatgtcttagagtttatttggtggagtatttagagatttttatgtataagataggtcatctgccaacagagacaattctactttttactttatgattttgatggcttttatttctttgtcttgtctacttgctctggctaggacttctatactgtgttgaatgaatagtggtagcagaagtgaacaccttgtcttgtttctaatcttagagaaaaagtcttcagcttttcaccgttgggtatgatgttagttgtgggcttgctatatatgcctttattatgtcaaggtacattcagtcttggtaaatgtatgtctgggaatgtattcatttcttctttgctcttcaatttgttagcatttaattgttccttggaatttttgtggtatcagtagtaattagttttatttataattttatttattttatcttcattcttttttcctttttaaatgtaggtagagttaactgtcctttctaccccttgcaatgcatccttcgtgtgtgtgtgtgtgtgtgctccacaaaagtgctataatctctcagtgacttccctatctcttgtaattgtattttcatgcatagataattgttcaaatggatgttttgtgagaaaattagcactggaaactcctattccgccgtcttgcttgtgaatgcacttttattatgtgtactggctaaagttgacttaaattttattctgaatgttaaagggtagccattggaaggtataaagaaagggggagatattatttgatttatgttttaagatcacttgcactgctaagtagagttgaaattgtgggagacgagagtagaagcagggagaccttttggaagggaattgcaccagtccaggagcctctttatatagtaaggacaaggagagctctatcattttccagagatgactattatttgtgctggattggctgggtttttttggtctacgttataattatgggctgtccttccatggtagaaggcattgatgatctgatggttggagtggttcaaagggggcattctgctttgctttctcactctctcttacattctctctctctctatatatatatagatatacatgtagaaagatagacacacagacatgtttctgtctttccctctcctttttctccttgccttctgtgtttccattctcattttgatttgtcctcaatcccatataagtagtatttccgttttgtggcttttcaattaccctcttaactatgaaaaatgtagggaacattatccaatatttgtatttggaagatctcaccactatggtttctagtttcccttctgcagacatacagacatatgtacaagttgatgtttttccgtcttttaacaattagtgtggaaaaggctgcatttcaaagaacaggtaaccttcttttaaaaattttgtgtatactcgttattttctttacaaaaatctcatcaggaggaaatgtatgccagcacatgttttctgatttctttttttgttattgaaaagtatagtttatgtaccataaaattcacccattttaagtttgatgagttttggtgaaagtagccacaaccagtttgaaatttttgagcactttcatcatagtgaagtcttcaggaggatgtctttgaagaccacatgcctcattgttttacattttttaaaggaaacttagatgcatacctagaaacaacctgagtttttattattaaaaaactcatgcttaggttaagctgaaattgcctccctataacttttgtcctggtcccgtactttgtctcacattgtaatagtaaggacaggcagcaatataaataagagcatataaatgttatcagttctaggagataaacatattaaggatatagtgaggttacaaagaaggcaatcatatatctacagaggcaaagaggggtatggcttaaggaatgtttggatctgtcttaaaagataaaaattggacttgggtagactgcagacttggcatattttatacagaggacacatgataaccaagacaaagagtaatgatataatttggcttagttcaagaacttgtaatcagttccataaatctgaagcatatagggcgagagagagagagagagatgtgcagtaatcccttgttatccagttttactttgggcagtttcagttctcatggtcaaccatggtctgaaaatattaagtggaaaattccagtaataaaaaattcataagttttaaattgcatactgtttggagtggtgtgatgaaatcttgcaccatcccactctatccttcctgggatgtgaatcatctctttgcccagcttatccatgctgtgcacgctacctgcatcctagttgcttaacagctttctcagttctcagaacgagaaaagtaaaacatagtatgtatgaagtttggtactatccatggtttcaggcatccactgggggtcttggtacatatcccacatggatacagaggcactcctgtagggaaatataaaaagggaggatgccaaatcacagaagactttgtatgttttgattggtaccttgtactatctttatagataatagatagacattgatgaattttcagcaattggtatggccagctttaataagattactctttgtgaagcagcaatataaaggctgtaatggaaggactgaagctgaggtcagaaagactgattaggaaaacactgcagtgatcttgcaagatatggcttccaaaacaaaaaagcaaatgctgtgggaatggagaagaagggttagttttgagagacgttttgaagttgattcaacaggatttgatgacaaactggatatgggaggtgagtgagagagaagttaaaaatgactcccagatttttgactatgtgtaggtctgccattcactgagatgggaataccaggaaatagagtaggttctgtgatgcttctttgtcaatatttatcaatttagaaatagtataggccaccagaaagggctatttagagcttgaacagggccaaggcagaaaaagttttaaggtgctagttagtataccattgaagttagtctaccatttaagtgactgcaggccagaaaggaggcaagtgaggctttgaatgggctgatggatcgagagaacacatatgtgctgaggaactggaaatcagtataaggatgaaaaggagtttcagtggggaaagatcagtgggagaagtcaagaggtcagaatgataggactatgtaagaattgtttcaggcaataagaaaataaactcacatttactgagtgcttgttgtgagtcacatgccacaagtgttacctcatttaatactcaggtcagacatcaacttcgctgagcttcaggtaattaatgtctcagatggggacaatatgatcacacatagggaatagaggagggtaaggtttggagataggattgggagaacaattaatttaatttgggtcatgttgagtttgagaggcatctgtgttctgacaggtcagtataaactgatacatgcagtgacatccattctgattggtcagtgcatgtaccttatcaattaaatattctgaatattgcaccttttcctggtctattcaccgtgcataatttgatgccaccgtggtaaaggacaaatgactatagatcctgtattttaggtcctgcttaatgattcctgggctaagagacatggttaaatcaattgtccctaatgcaactaaagcctggttcctcactttgtgccctaaaaggaggcattatggatgatgtgtggacagagtatgcactttgtgcacaaattatgtacctaataagtgtgcgaactgttatttgccttaaaatcttaggcttctccccccctccatagcatatgacctccttttaccgtttgaagtctgaggtaaaattattttaagtaggccgggcccggtggcccacgcctgtaatcccagcactttgggaggccgaggcaggtgaatcacctgagatcaggaatttgagaccagcctggccaacatggtgaaaccccatctctactaaaaatacaaaatatagccaggcttggtggcgtgtgcctataatccaagctacttcagaggctgaggcaggggaatggcttgaacccgggaggcggaggttgcagtgagccgagattgcaccattgcactctagcctaggcgacagagcaagactccatctcaaaataattaaaaaaaattattttaagtaataccaacgttcaaaagtaggtggttcaggggatactgtaatccactttagttctctggacaagaaaataggttctaaagaacaacagaaagtttagtggtcacagtttgtgaactgaagtgcttaattagggctacactattggcagcagtgtatacatattcacatgccactgcttttatgaaaccccaactcctcaggatactttcatttcagtcttttttcttttgaaaatatcaaacaacaaattgaaaatatgagagaaagaagtctatattttggtggtattaacctttccttctaagacgaggaaattaccttgaagaaacatttccttcttgcacaaggattatcaccaaaattatgattggaattcaatttctagtaaggtaaacaaggatatttctagaagttactgcagagcatggaacaatgaattaacctcaaattcaccatctttcccacagccttctttgggtggaatcttggaaagcataaagcactgtggagaagggatggacagatgggctatggagcactgtggaaatgctgcacaggccgaacaatgacaacaatgtatacttactagaaacaggaaaagactgggaacaggcagaacaatactgtaccctgaagcagacatccttcctttgctccacccacctattcaggtgaaagcagctaagctaagtttgagggtagcacagcttttggaatacttggaggctctgggctttagggctttttttctggctttgttattttggtgggacttggtgaaagaagagcaagaagggccataatggaatccagaggacaggaagtaagagctggctgatttgagaatgatagtgactctaggtcaccaagttcatattactgaggaaggaaagcaagcagggattcagtagagatactctccaggaataaagaatgtgcattttcctggtattctcctcagagtgatatattaaagcaagttaagcagggcaggagagttttaaaacctaacattaatgttttgtagtacatttgtgaaccattggtgtcaaggggttctggtgtcttacttctacaaccaacgtcatctcaagtcctatcaattaaggtcagaggccatagagctttctgtagtcaggctgtaccacagcttctcctaagactatcttaaaactcttaaatctgtcctatttactctgtctccactgcctctttcctaggtcaggctgtcattatttcactcacgatttattgtaatatccttctaactgatccttctgcctctaacctgatttcttccaatgttactctacattggctgtcagaataatttttctaaaatggagatagcatagctattaaaatggttaaaattgggggttctggggttggtctactagagctagtatcttagctcaaccacttaccttgaataagttgcctaacctccctttcaaccatcacatttgtaaaatgaggattgtaatattatcacccccacagagttaagtgagaattaaaagaatcaatttcaacaatttaaaacagtgtcttacacagcaaaaatgttctatatgaaagctattgttatattaaaaatctgacaatgcaacttttctgtctccctgtcagaggtcacaaatataaatgcttacagtgctattcattcatgtaaggtaaatgaatgaagtaggcaggcaaatgcattattcatctaaaggggacagcctatacttatcacacaaagttgaggttttagctttgccagatcttatttttcaagtcaacgtggaaatctatgttgttgtcatataactttttattagtgttttttaaatctgtggtagaaaaagtatcctacctaaaattagaaaactactttctggctcatgggtctccagtttgcaacctctgagtgattaaaatccaaattccttaatattgaatttgataccttactttttattccatttttatattttttgtaggtgatggatatttttattactttgtggtgatggaatcatgtgtatgcatatttctaaacttattaaaattctatatattaaatatgctcagttttctgtactgaattatacctaaataaagctgattataaaagaacagaaaaggaataggttaaccattttgtttctaagctactccacatggttttccaagtacagtctaatttcatccacatcaaagccttacctaactaatgccaccaacttcatctcttagtattattcaagaattatacttcattctactcagaacaatttcaatatcctgcaaacatactgctctactccatgtcatacttacaattactttactccaattatttagaaataccatttctatttgtggttgataataacttcctacacatagtcttgcctaaatttttaaataaatagctttaatggtacaagtgggttttggttacatgcattaattatatagtggtgaaatctgggctttttgtgtacctgtcaaatggatagtgtacactgtatgcaacaggtgacattttatccctagctctcttccagtatcccccgttctgtggcttcattgtctattataccactctgtatgcctttgtgtacccatggcttagctctcacttataagtaaaaacatgtgatattttgttttccagtcctgtgtaattacacttgggataatggtttccagttccacccaagttactaccaaattcattatttcattcttctttatggctgtgtagtattctatggtatatgtgtatatataatgatatatatatatatggtgtgtatatatataatgatatggtatatgtgtatatataatctatggtatatgtgtatatataatatatatattaaggaatttggatttgtttttttcttctcttcaactttttaagttctgggctacatgtgcaggatgtgcaggtttgttacataggtaaacgtgtgccagggtggtttggggcccagatcaatgcatcacccaggtattaagcccagcatccatttactatttttcctgatgctctccctctacccgctcacctaacaggtccccacgtttccgagtgttctcatcattcagctcccacttataagtgagaacatatggtatttggctttctgttcctgcattagtttgctgaggataatggcttccaactccatccatgatccctgcaaaggacatgatctcattcctttttgtggctgtatagtagtctatggtgtatatgtacatggtgtatatgtatcacattttctttacccagtctatcattgatgggcatttgtgttgattgcatgtctttgctattatgaatagtgctgcaatgaacatatgagtgcatgtatctttataacagaatggtctatattcctttgggtatataaccagtaatgggattgcagggtcaaaatggtatttctgcttctagatctttgaggaatcgccacactctcttccacaatggttgaactaatttacattcccaccaagagtgtaaaagtgttattttttctccacgaccttgctagtatctgttgtttcttgacttttaatcgccattctgactgttgtgagatggtatctcactgtagttctcatttgcatttctctaatgatcagtgatgttgagattttttttcatatgtttcttggttgcaggaatgtcttcttttgagaagtgtctgttcatgttatttgcccaatttttaatgggattgtttgcttttttttttgaaaatttgtttaagttccttgtagattctggatattacacctttgtcagataaatagattgcaaaattgttttcccatactgtagattgtctgttcacactgatgatagtttcttttgctgtgcagaagctttttaatataattagatcttattcatcaatttttgcttttgtcgcaattgctcttgatgttttcgtcattaaatatttgtctgtgcctatgtcctgaatggtattgcctagattttcttctaggacttttatagtttttgtttttacatttaaatctttaatccatcttgaatcaatttttgtgtaaggtgtaagcaatttttaattctttaattttctgcatatggctaccacattctcccagcaccatttattaaatagggtgtctttaacccattgcttgttattgtcaggtttgtcaaagatcagaatggtagtagatgttctgtcttatttctgaattctctattctgttccattggtcaatgtgtctgtttttgtaccagtaccatgctgtttggttactgcagccttgtagtatagtttgaagtcaggtagcatgatgcctccagctttgttcttttcacttaggattcctttggctattcagcgtcttttttggttccataagaattttaaaaggttttttttttttctaattttgtgaaaaatgtcaatggtagtataatgggaagagcattgaatctataaattaccttgggcagtatggacattttcacaatatcagttcttcctattcaggagcatggaatgtttttttcatttgtttgtgtcctctctgatttccttgagcagtggtttgtagttccccttcaagaggtccttcgctttccttgttagctttattcctgggtattatattctttttgtgggaattgtgaatgggggattattcaggatttggctctctgcttgcgtgttgttggtgtatagcagtggtagtgatttttgcacattgcttttgtatttttgtatttcagattttgctgaagttgcttatcagattaagaagcttttgggctgagatgatgcggttttctagatataggatcacttcatctgcaaacaaagatgatttgacttcctctctttatattcgaatacctttatttctttctcttcctgattgccctggccaaaacttccaatactatgttgaacagcattggtgagagagtgcattcttgacttgtgccagttttcaaggtgagtgcttccagcttttgcctattcggtgtgatattgtctgtggatttgtcataaatggctcttataaatttgagatatgttctttcaaaacctactttattgagagtttttaacatgaatagatgttaatttttatcaaaggtttattctgcatcataatcatatggtttttctatttagttctgtttatgtgaggaattacatttattgatttgtgtatgttgaaccaaccttgcatcctgaggatgaagccaaattgatcatggtggataaggttgtgcctagtcagtcccagtatgagaacctggatattttagctgaagatgtttaattcacttgcaactttcattcttctctgtgagtgctgcagaccgcagctgcttccaattgaccatcttgacctcatgtatcttcttttgagaaatgttttttcacgttatttgcccactttaatgagattatttgattttttcaacttttattttaggttcacagagttaatgtacaagttggttacatgggtaaattgcatgtcatgggagttttgtgtatacattattttggcactcaggtaatgagtatagcaccagatacatagctttctgatcctcatcttctcccagccatcactctcaaataacatgtagtatctggttttctgttttctcttaatttgcttatgattttggcctccaattccatccaagtttctgcaaggggcatgattttgttcttttttaatgcctgcatagtattccatattatatatgtaccatattttcttagtccaccattgatgagcatcttggttgattccatgtttttgctattgtgaagagtgctacgatgaacatgtgtatgtatgtatttttatggtagaatgatttctattcctttgggtacatacctagtaatgaggctgctgggtcaaatggtagttctgtttgaagtttctttttttttttcattttaattttatttttttattataatttcagttttagagtacatgtgcacaatgtgcagctttgttacatatgtatacatgtgccatgttggtgtactgcacccattaacacttcatttaacattaggtatatctcctaatgctatacctcccccctcccccaaccccacaacaggccccggggtgtgatgttccccttcctgtgtccatgtgttctcattgttcaactcccacccatgagggagaacatgtggtgtttggttttttgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttaggttggatccaaggctttgctattgtgaatagtgccgcaataaacatacatgtgcatgtgtctttatagcagcatgttttataatcctttggatatatacccagtaatgggatggctgggtcaaattgtatttctagttcaagatccctgaggaatcaccacactgacttccacaatggttgaactagtttacagtcccaccaacagtgtaaaaatgttcctatttctccgcatcctctccagcacctgttgtttcctgactttttaacgatcgccattctaactggtgtgagatggtatcccattgtggttttgatttgcatttctctgatggccagtgatgatgagcattttttcttgtgtcttttggctgcataaatgccttcttttgagaagtgtctgttcatatcctttgcccactttttgacggggttctttgtttttttcttgtaaatttgtttgagttcattgtagattctggatattagccctttgtcagatgagtagtttgcaaaaattttctcccattctgtaggctgcctgtttactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatgtaagtctttaatccatcttgaattaatttttgtataaggtgtaaggaagagatccagtttcagctttctacatatggctagccagttttcccagcaccatttattaaataaggaatcctttccccatttcttgtttttgtcaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagcatgatgcctccagctttgttcttttgacttaggaatgacgtggcgatgtgggctcttttttggttccatatgaactttaaagtagttttttccaattctgtgaagaaagtcgttggtagcttgatggggatggcattgaatctttaaattaccttgggcagtatggctgttttcatgatattgattctccctacgcatgagcatggaacgttctttcatttgtttgtatccttttttatttcatggagcagtggtttgtagttctccttgaagaggtcctccacatcccttgtaagttggattcctaggtattttattctctttgaagcaatgatgaatgggagttcactcatgatttggctctctgtttgtctgttattggtgtataagaatgcttgtgatttttgcacattgattttgtatcctgagacattgctgaatttgcctatcagcttaaggagatttggggctgagacaatggggttttctagatatacaaacatgtcgtctgcaaacagggacaatttgacttcctcttttcctaattgagtaccctttatttccttctcctgcctgattgccctggccagaacttccaacactgtgttgaataggggtggtgagagagggcatccctgtcttgtgccagttttcaaaaggaatgcttccagtttttgccctttcagtatgatattggctgtgggtttgtcatagatagctcttattattttgagataagtcccatcaatacctaatttattgagattttttagcacgaagggctgttgaattctgtcaaaggccttttctgcatctattgagatagtcatgtggtttttgtctttggttctgtttatattctggataacgtttactgatttgcatatgttgaaccagccttgcatcccagggatgaagcccccttgatcatggtggataagctttttgatgtactgctgcattcggtttgtcagtattttattgaggattttgcatcgatgttcgtcggggatattggtctaaaattctcttttttttgttgtatctctgccaggctttggtatcaggataattctggcctcatcaaatgagttagggaggattccctctttttcaattgattggaatagtttcagaaggaatggtaccagctcctccttgtacctctggtagaattcggctgtgaatccatctggtcctggactctttttggttggtaagctattaattattgcctcaatttcagctcctgttattggtctattcagagattcaacttcttcctggtttagtcttgggggggtgtatgtgtcaaggaatttacccatttcttctagagtttctagtttatttgcctagaggtgtttatagtattctctgatggtagtttgtatttctgtgggatcggtggtgatatcccctttatcattttttattgcatgtatttgattctactctcttttcttctttattagtcttgctagtgatctatcaattttgttgatcttttcaaaaaaccagctcctggattcattgattttttgaagggatttttgtgtctctatttccttcagttctgctctgattgttatttcttgccttctgctagcttttgaatgagtttgctgttgcttctctagttcttttaattgtgatgttagggtgtcaattttagatctttcctgctttctcttgtgggcatttaatgctgtaaatttccctctacacactgctttgaatgtgtccctgagattctggtatgttgtgtctttgttctcattggtttcaaagaacaactttatttctgccttcatttcattatgtacccagtagtcattcaggagcaggttgttcagtttacatgtagttgagcagttttgagtgagtttcttaatctcactgctggtgaggagttgtgttcctttgcaggaggagaggcgctctgatttttagagtttccagtttttctgctctgctttttccccatctttgtggttttatctacatttggtctttgatgatggtgacatacagatgggattttggtgtggatgtcctttctgtttgttagttttccttctaacagtcaggaccatcagctgctggtctgttggaggttgctggaggtccactccagaccctctttgcctgggtatcagcagtggaggctgcagaacagcggatactggtgagcagcaaatgttgctgcctgatcattcctctggaagttttgtctcagaggagtacccagccgtatgaggtgtcagtctgcccctattgggggatgcctcccaattaggctacttgtgggtcagggacccacttgaggaggcagtctgtccattctcagatctccagctgcatgctgggagaaccactactctcttcaaagctgtcagacagggacatttaagtctgcggagttttctgctgctttttgtttggctataccctgcccccagagctgggttctacagaggcaggcaggcaggcctccttgagctgccatgggctccatccatttggagcttcctggccactttgtttatacctactcaagcctcggcaatggcaggcgcccttccccagcctctctgccaccttgcagtttgatgtcagactgctgtgctagcaatgagcgaggctctgtgggcgtaggaccctccaagccacgtgcgggatataatctcctggtatgccttttgctaagacgattggaagggtgcagtattagggtgggagtgactcgtttccagttgccatctgtcaccgctttctttgactaggaaagggaattccgtgacccctttcacttcctgggtgaggcgatgcctcggcctgcctcggctcccactcggtgcactgcaaccactgtcctgcacccactgtctgacactccctagtgagatgaagccggtacctcagttggaaatgcagaaatcacccgtcttctgtgttgctcacgctgggacctgtagactggagctgttcctattcagccatcttggctccactgatctgttttaagtttcttgagaattctccaaactgctttccacagtggctaaacttatttacgttaacaccagcaggatatttattccctttcctctgcaacctcacaagcatatgttattttttgtctttataataattgtcattttgacttgtgtgagatgttatcttattgtggttttgattttcatttctctaatgattagtgatgcttagtattttttcatatgcttcttgtccacttgtatgtcttcttatgagaagtgtctgttcatgtcttttgctcatttgttaatgtggttgttttgtttttgcttgttaatttgttgaagttccttatagattctggatattagacctttttggattcatagtctgcaaatatattcttctgttgtgtagttggtctgtttactctcttgataatttattgttctttgcagaagatgtttaattaattaggtctcaattatccatttctgtttttgctatagattttggagtcttcatcatgaaatatttgtcatggcctatgttcagaattatattcctaggatttttcctagagtttttatagttttaggttttgcatttaagtctttaattcacatcgagtttatttttgtatgtggggaaaagatagggttcacttcaaatattctgcatatgtctagccagttatcccagtaccatttatagaataggaattcatttttccattgcttcttgtttttgactttgtcaaggtcagatgactgtaggtatgtggctttatttctgggctctctaacctgttccattcatctatgaacccgtttttgtgccagtaccatgctgttttggttactgtagccttgtaataccatttaagtcaggtagagtggtgcctctggttttgttctgtatgcacaggattggtttgactatttgggatacttttttgttccatatgaattatagaatagtttttttctggttctgtaaagaatgtcattggtagtttgatagaaatagcattgaaatcagaaattgctttttggaatatggccattttaataatactgattctttctatctatgataatggaatgtttttccagttgtttgtttaatctctgagtcctttgagcagtgttttgtagttctcattgtagagatctttcatctttctgtttagctgtattcctagttattttattgtttttgtggctattgtgaataggctggggttcttggtttggttcttagcttggtcattattggtgtatagaaatgctactgatttttgtacattcactttataccttgaaactttgctgaagttgtttgtaaggtctgtaagcgttttggcagagattatggtgtgttctaggtatagaatcacatcatctgagaagagaggtagtttgccttcctctcttcttttttggctgccttttgtttctttctcttgactgactgctctggttagcactttcagtactatgttgaataggagttatgagagttggcatccttgtcttgttctggttttttagaagaatgctttgagctttgacccattcagtatgatgttggctgtgagttttccatagattgctgttattattttgacgtgtgttccttcaatgcttagtttgttgagggtttctaacgtaaagggatgttgaattgcattgaaagcattttctatgtctgttgagatgatcatgtggtttttctttcaattctttttatgtgatgaatcacatttattgatttgcatatgttgagccaaacttgcattccagaaataaaggagatccacttgatcatggtggattaactttttgttgtgttactggatgtggactgctagtattttgttgaaaattttcgcatgtatgtttatcagggatattggcctgcaattttcttacctcattgtgtctgtgtgaagttttggtatcccaatgatgctggccttataaaatgtggtagggaggagtccttccttctcaattttgtggaatagtttctgatagattggtatcagcttttgtttgcatgtgtagtaaaatatggctgtggattcttatggttcagggctttttctggttggtagttttttggttttgtttttgttttcttcactcattcaatttcagaactcattcctggtctgttctctgtttggaattctttctggtcaatcttgggaggtagtatattcccagaaatttacccatttcatctacattttctagttggtgtttatagaggtttttttttttttttttttagatggagtcttgctctgttgcccaggctggagtgcagtggtgcgatctcagctcactgcaacctccgcctcccgggttcaagagattctcctgcctcagtgtcctgagtagctgggactacaggtgcataccaccatgtccggcgaattttttgtatttttagtagagacagggtttcaccgcgttagccagggtggtctcaatctcctggcctcatgatccacctgcctcagcctcccaaagtgctgggtttacaggcttgaggcactgcactcggcttatagagatggtcttaatagactttttttttttcttttgtatttctgtagcattggtggtaatgtctcctttgtcatttctgatagtgtttatttggatcttcttttttctttatcagtctaactagtggtctatcaatctcacttattatttcaaaaaaacaacttttcattttgttgattgtgtgtatggctttcacgtctaaattttgttcagtttagctgtaatttttgttatttttttttttttcctgctagctttggggttgatttggtcttattttcttagttcctctatttgtgatgttactttgttgagatttttctaacttttggatgggggtgtttagtgctgtaaatttttctctcatcactgctttagctgtgtcccagagattctcatatgttttatcattggtttcattagtttcaaagaattctttgatttctgccttaatttcatgtttacccaaaagtcattcaggggcatattgtttaatttcaatgtaattgtatggtttttgagagatcttggtattgatttctatgtttaatatgctgtggtctgagagtgtagttggtatgattttgggtttttgaatttgttgagaattgctttatggctgagtgtgtggttaattttagactatgtaccatgcctaggtgaaaataatgtatattctgctgttagtccagtgttctgctgaagtctgttaggttcatttggacaagtgttgagtttatttcctgaatatctttgttagctttctagctcaacaatctgtctaatactgttaatggagtctcccactattgttgtgtttacccatgtctcttcataggtctccaagaacttgttttgtgcatctgagtgctccaatgttgggagcatatatatttaggatagttaggtcttgttgaatggaaccctttacctttatgtaatgcccttttttgtcttttttgatccttcttgctttaaggtctgttttgtttgaaataagaatagcaatttctgctttttgtattgatagatcttcctcattcactttactttgagtctatgtgtgtcattgcatgttagacgagttccttgattatagcatgcacttgggtcttgctttatccagtctgctactctctgcctttgagttggaacatttaacccatttacattcaaagttagtgttgaaatgtgaaatttgatcctgtcttcatgttagctcattctcatgtaaacttgattgtatagatgctttacagtcttattggtctatgtacttacatgtgtttttgtggtggccagtaattgtctattgtttctgtggttagcacttcctaatggacctcttgtaaactatgtctagtggtcacaaatatccttattatttgcttttctgaatggaattttatttcccctaatttatgaagcttagtttggcaggatatgcaattcttaatttggatttcctttcattaagaatgtctaatatagaccccaatgtcttctggcttgtaggatttctgctgaaacttccactgttattgtaaaaggttccctgtgaaggtgacttctctcttctctctagctgcctttaatatttttttctttcttgttgaccttggagaatctgatgactatgagtcttgatgatcctgcatagtatcttggagggtttgtctgaatttcctgaatttgaatgtctccctctctagtaagtttcggaaattttcactgacaatattcttaaatattttttgtaagttgcttgctctttcggggacaccaatgagtcataagtttggtctctttacataatcccatatttcttggtgatttggttcatactttttaaaattattttttctttatttttgtcttattgagttgacttgaagagcctgtcttcgagggctgggattcttttctcagcttggtctattctgctggtattacttctgattgtattatgaaattcttgtagggagtttttcagctctctcagatcaatttgattcttaaagtggctattccatttttcagctcttgtattgttttactggattttttagattcttttggattcaattttaactttctcttgaatcatgataatctttgttgccatccaaacttttaatcttatggttgtcattccagacattttagtctggtttagagccattgcttaggagctagtgtggttgtttggaggtaaacaaacactgtctttttgagtcatcagaattcttatgctagttctttctcatctgtgtgggatgatgttcctttaatctttgaagtttatgtcctttagatagggctttttgcttttgcattatttgatgcccttgagggtttgactgtcgtataagttggatttagttgacaggcttcgtttctgaatgatttctggggtcgaaggattagcgcagcattcttgggctgcatactctaattctgggggctggtaccaggcccacagcttttttctctggcccctacaggttgaacacctgctctgctggaggagctgaggtgttcctggtttgctggcaagagcactccagtggagggtgtctgcagaagttctttgtcaggatagtggcagcatggtactcacatctgttggcagcagtggcatggcagggtccgtgcatacatgcttgtgatggaggtggcaagggtgcacacacatgcgtgctagtggggcagggcagtcatggtgatgtttgcgtactcatgcctgaggcactgggatggtgaggtctgtgtacatgcactcacccacaaagcagtggggggaggctgtgagcagctgtatgcttgcagggacccatctgtggaagctctctgatggttaggcagagtctgctggtaaaggagctatggtggttgcctctgggaagtgcccctggtgcagccaggcagggaccctgggggaggctgatatacagtaggggcactcacatcacaccagctctatcccactggtgagatagccctgttatgtccaggtccaacagttaacaaaggtgaaaggcacctagagaagcatcattagccagtgcggatgggcatctctggccatgctccactgcagccattcctgcaccaaaccctctggggtctgtactgactggagtcctgttcctgctaactcttcaagcagctctcccagccagctcaaatgtctgtggggatcatgaagtctcctgcagctaggtttctggatgtctgtgcaagagtgtactactccaatgctcatttaactcatcctttccctaggagccactcagggccagtatgattcctggtgcttgacaaccatgtgtaggattcccagctttttctcccttcagcccaggttctgtgtcctccctctgtccactctcaatacctttcttctgaagatctgcttggagtgtgctggtcttcttgttggtcttatcttttgatgagagaagctcttcttggctgcatacagtcagcattcttgacttttcttccttttcgcttttgttcttgctgattcttttgaattccttgcagattctggatgaaggggtgggttgcccctccacacctgtgggtgtttctcataaggtggaacaagagacttggaaaagaaaaagacacagagacaaagtatagagaaagaaataaggggacctggggaaccagcgttcagcatatggaggatcccgccagcctctgagtccccttagtatttattgatcattcgtgggtgtttctccgagagggggatgtgtcagggtcacaagacaatagtggggagagggtcagcagacaaacacgtgaacaaaggtctttgcatcatagacaaggtaaaggattaagtgctgtgcttttagatatgcataaacataaacatctcaatgctttacaaagcagtattgctgcccacatgtcccacctccagccctaaggcggtttttccctatctcagtagatggaacgtacaatcgggttttataccgagacattccattgcccagggacgggcaggagacagatgccttcctcttgtctcaactgcaagaggcatgccttcctcttatactaatcctcctcagcacagaccctttacgggtgtcgggctgggggacggtcaggtctttcccttcccacgaggccatatttcagactattacatggggagaaaccttggacaatacctgtctttcctaggcagaggtccctgcggccttccgcagtttttgtgtccctgggtacttgagattagggagtggtgatgactcttaaagagcgtgttgccttcaagcatctgtttaacaaagcacatcttgcaccgcccttaatccatttaaccctgagtttgacacagcacatgtttcagagagcatggtgttgggggtaaggtcacagaatctcaaggcagaagagtttttcttagtacataacaaaatggagtctcccatgtctacttctttctacacagacacagtgacaatctgatctctcttgcttttccccacactggatattagttctttgttgaatgtatattttgtgagtattttctctcattctgtatgttgcctacttggtcttttaatttttttttttttttttagcagaagctttttagtttaattaggtcgcatttattttttgtttttgttgcaattgcttttggggatttagccaaaaactttttgtcaaggctaatgttgagaagggcattgtttaggttttcttctagtatttttatagtttgagatcttacttttaaatctttaatttatcttgagttaatttttgtatatggtgagagagagtgatccagtttcgtactttggcttgtggctatttagttttcccagcaccatttattgactagggtgtcctttccccagcttttctttttgtctgctttatcaaagagcagttatttgtgggtattttgctttaattttgggttctctatcctgttctattggtctacgggggtattttatttcactaccatgcttttttggttactataacctcgtattataatttgaaatcaggtagtttgatgcctccagattttttttttttgcttcgttttgttttgactatctgggctcttttttggttccctgtcaattgtaggattttttctaattctttgaaaaatgacattagtgtttgatagaaattatgttgaatatgtagattgctttgggcagtatggtcattttcataatactgattcttccaatctatgaccatggattgtatttccatttgtttgtgtcatctatgttttcttttatcagtgttttgtagttcttccagtcgagatattttaccttctttgttaagtatatttttagatattttatttttttcagctgttttaatgtgtagaaagatgtaaaataagaactgatttcttgatttgattatcagcttggccattattggtatatagcagtgctactgaattgtgcatattgatttttattacctttaatgaattcatttatcaaatttaggagtcttctggaggagtcttttgggttttcaaggtataagatcatatcattggcaaaaaaagatagttcaacttcttcatttcctatttggatgcctttattcttttgcctgattgctctggctaaaactaccagtactaagttgaatagaaatgttcaaagtgggcttccttgtcttgtcccagttctgaaggggaatactttcaacttttccatattcggtataatgttgtctgtgggtttgtcatatatgacctttatgatttgaggtacattctttctatgtctagtttattgaagatccaagtcattaggggatgctggattttatcagttgctttttctgcatctactaggatgatcataggctttttgtttttaatcctgtttttgtggttaatcacatttattgacttcgatgtgtggaaacatccctgcatctatagcatgaaacccacttaatcatggtgaattatttttttaatgtgatactggatttggtttgctagcattctgttgaggatttttgcaactatcttcatcaggcatattagtctgtagtttttgtgtgtgtgtgtcctttcctggcttggttttaacgtggtacttgcttcatagtatgagtcagagaggattctctccttgaccttttggaattgtttcagtagaattggcaccagttctttgaacatctggtagaattcagctgtggatacatctgttcctgtgctttttcttggggggggggggagggatttttttttattactgattcaatctcattacttattattggtctatgcaagatttctatgtctccctgattcaagcttgggagtttgtatgtttccagtaatttctccattttctttagattttctagcttgtgttcatagatgtgttcatagtagtgtcagatgatcggttgtatttccctggtattagttgtaatgtttttatttttatttttgattataattatttgaatattctcttttttgtgaatctagctagttgcatataaattttgtttatcttttcaaagaagcaactattcattttactttttttttgtattgttctatctcaattgacaccttactttaaaaaaagacattgtttcctttgcatgtatgtatcagtcagtttctttggttgcaagccactgaaaccagctctgtctcacttaagcagatgaggaatttgtgaaaagggcagagtaattgctagaattgcttggaagcttagtgaaacagacagagtaaataggcaagaacaaagcaccacagccatatttacactagaggagccatctgatatatgggccttattgttgctatcactgatactggaatgctgcagtgggcactgatgctatctctggaaatggccaccgctattgggatcatcgaaactgctgtgcttagaaatcaggtgttgttgattccaacacctgtacaatgtgtacttttttcttgttgcttctctgcatactttcttccagaatcaaatgtccaggacatcacaatcatgtgatgagctgagttcaaatcatgtattcatcatgccttagcagcctaatggtgggaaaaagagaatatctgcatctgcacccattctttcctttttccatcttgttaatgatggaggacgaggccctctttctttctgtggccaatccttggactatgctttagaccctactcactggttctttcctggaaactttattatttctcccttttgcatcttcaatttctctatctgtatgtaatgttttctatcagtaaacaagctatactttcttccatcttaaaaataaaatcagtcttctttcccgtgggtaaacaagtaaatctatatattctcctcaaccagatttctcaaaagacttatatgcattcactgggtacattgcctcagttcccacttgctcttcaacctcatagtcatgcctcagctcttaacaactccacaaaaacttcccttgtaaaagtcatcagtggcttccttgtcactcaatgctcacatgtcagtacttattctctacatgaaatctgatgagattcatcactcttttcttattgaaactctagtggtttctttactaacctcctcaaatgctctcttgcaacccattctcacatagtagccagtgcaatcttttcaaattaactatcagatcatttcaccctttaaacagaatctttttaaagattcccagtgtttttagaatgaagtccagactttttatgaaggcccgcctacaaataatctgtatgatcagggacaaattagaaggaaggagagatgaagtgatttgagaaagctaaaaatgaagaatgttttctctttcaattattcttaccctccaacttcatcttctatcactctctctttcacttgctttatttcagtcacagtgatcctcaaagtagttggatattttatattcctttacgtatcaaagcctttgcacttactgttctcttggcctggtattctctttgctaacccctgcacacctattcttttttttgaatttctacacactgttttagtttttactcaatagatatttacttagtgaaacatttttaaacccctcattcacactcatcacactttgtacttctcatttgtagcacacagaaaattgtaattaatcaatttgtgtgtatgtgtgtgtgtgtgtgtgtgtgtgtgtgtgtgtgtgtttaagtgtctaccttcctccagtagactgtgagcttcatgagagcagggaccatttttttctttcattcattgaagtatccaacattgtttctagcacatgattgacactcagaaaatagtagttgaatcgatgaataggtattcttaagcacctatgttttctgctacagaatagtcactcaatgaatatttgctgaatgaatggatgagtgaatatataggtaaatgctacatatgtgatgctataagttgctatgctagtcatataaactgcatcttagctcaataaacaacctcaattgtttcactcccatagctttgaagactccatatggctatcagtctaactaagcgaagctttattttcaggtatctaattgtcttttttcgctgagcataccaaagagagtaacaagtacaaagtacttgatgtttaaaggaatgcagaatatccaatgctacaaaaggaacaatgtatctggaataaaatgagtgaaggggatagtgatacaaggagaagttgaaaaggtaggaataattgaaaaaccattattcacttttagctttcactaaaaatcacttcattcctccttcctttcttcctccttctctgtccctgactatgaaagtcttttgtgaaaagtctgaactttggccgggcacagtggctcaggcctgtaatcccagcactttgcgaggccaaggcaggcagatcacctgaggtcaggagttcgagaccagcctgaaaaatatggtgaaaccccgcctctactaaaaatacaaagaaaaacaaaaacaaaaacaaaaaactgggcatcgtggtgtgatcctatagtcccagctactcgggaggctgagagaggagaattgcttgaacctgggaggcggaggttgcagtgagccgaaatcatgccactgcaccccagcctgggtgacagagcgagactccgtaaaataaataaataaataaataaataaataaataaataaataaaagtctgaactttatttcaagatcattgggaagcttttgaaggattttgatcaagagtgcttagcccagtgggattgaaaaaaaagagaatgaactttctctgtttattgagagaacaggaaaacatgtgaaacaactaaaggacaatttaggactatatatgataaacaatacagttgcatggcaatgtagtgtcattgaaaaattcctgggcaaggtgataaaatacctcattgatttgcatctatggcttattttcttatcctcttctttttaccgctcttcctggtggctgattttaacaactgtttaaaacagatctgtgtgttttcttactattgttttgcttatcatgggcttctacttcttcttaaaatctgttttacctctttttcctcttcatcctgtgtagcctgaaaatcattttccgtgacacaaagtgaggaacaacgtatcttatgttattcaccaactttgtacaattgaccttgtgtagtttttctatccattctttgcttatcttgctctgaatataataaccaaatcatgtcctttctgtcacccttattaatatttttgcaagccatgatgaattatgggccttattccttacttcccctttaaactgtagcaggagtagaagctccagtttcttttcacagtaaaagggagaggaaaatatctggaacagaaatgaaggaaggaagagtataggaagatttgtagaaaagaaagggatatttaccacatagtttttgtgaaggtcaaatgagtcaatacatgtcaagtgtttgaaattaagccttgcacacggtacctgttcaacagatgttgactgttattatttgaatggtaatgatggtaatggttttatcagtcagggttccagaagaaaacagatgccattgagtaattgggggagagtttaatactggaactacccacaaagttgtgagcaaagaataagaaaaccacaaagaatagtgtattaccctaggtataataatgacaggtgcttttagtacccctaggctgaagaggtacaagtaggaaataatttctggaactttatatgagtatctatagctattagagagagccactggacagaagctgtgatctttggttgaaggaaacagccagctcacagtgactgtagggtggaagcttggagaaaaaaataattcaatcatgccctctttcctcatttcgaagtcttgcgggtaattcttattgcccaaaccccaaacaaaagccagagaagaggggagcccattaatgaaatacatataaactaggcttcagggacacaaagcagagtggagaagtttgaagagtgaatctggaggacaaaatagaagataacagcataatcatgaggttaggtattgaagacaagttgcaaagcatttgtggtatgactgacaactcgcttgtcagcatacctggagatttccgtgggaatatatgtaagctagtccacaaataaaagccacccactttgctccagggttaaattaatgactgctagcccagaatgatgccttaatgggagcttccctatacctttatcctttatgattattattattattattattattattatttgagatggagtcttggtctgtcgcccaggctggaatgcagtggtgcggtcttggctcactgcaacctctgcctcccaggttcaagcaattctcctgcctcagcctccagagtagctgggattacaggtggtgggattacaggggggtggtgtcagccccccagctttgttctctagcccctcaagattagcaatcttctgcactgtaggcaccaatatgtccccaattattggttacagtgctttgtcgggatggtggcagtgggatttatactcatttgtatgtgccaggagcagtggctgtgcagcagggtgcacattgcattagctggggtggcataccagtgagagcaaggctgctgcagttaagtgcatgctgtagccaacagtgttggtgagggcatagcactggtgggtgtggggttgctggtctccatgtgcatgattgcagcagcaatattggcagcacagggggtggggtggggttttcagccttcatgcacatgttcgcatcagcatcagtggctgcatgggtcaggcttggttgcaaatgtttgtgtgcatgtgtgcaccagcaatggcagcacaactgggttcacggagtgtgctcacacctgcaggataggcatggcagggtgtgtgcatgcagaggagaggaggtgaggtccatctgcatgtgcacacactggcagagaagttggtgggtggctgtgggtgatagcatgctggcagagcggtgcaggtgaggctgcagtggtggagaggatgcaggtaggctggtgtgtggtggtggaggacactctggtggagctctgcagtggtcagttatggtctgccagttaaggagctataatgaggaccctttggaagcaccctgattgggcatccgaggctgcactgcaggcaggcgtggccaggcttagaccctggcggaggccaacagacaggggcattcaggttacactggccccatcttacacacaaggctgtcctgctctctccaggttcaacagtccccttaaggctaaagtctcctagaggaatatagcaacctttgggacttacacatccctggccatgctccactgcaggcatttccacaccagaccctctggaatctccacagcctggagtcctgctcctactatctgtctaagtcgctgtgctgccagctgaagtgtctgtagtggttgtgaggtctcctgctgccaggattccagaggtccatggtgaaagtaggttgctcctcacctgtttaactcaccccttccccaggagttgctgcaatccaggaacaagtcccagtgcatggtagctctgtacatggtttctatcatcttcccccttcatcctagcatctttgtccttgctacatccattctcaaggcttcactctgaagatctgctcagagtgtaccaatctttctgatgtctgtttcttgatggcagatgtacttcctggctgcatctagtctcctatcttgaatccagaatctcactgtggttttgatttgcaattctgtaatgattattggtgttgagaattttttatatgtctgttggacatttgtgagtcttcttttgaagaatgtttattcggattatttgcccacttttaaatgggattatttgtatttttgctcttgagtttttttggtatcttagtatattccagatattagtcacttgttggattcatagtttgcaaatattttcttccattctacaggttgtctcttcagtctgttgactgtggcaggttgacagggcctgttgttaggctttcctattgtgcacatgtgtaccagtgtcaacaggcaggctgggtcgtttcccaggcccccggatagcagatagtgtgcttgggtgtcagtgtcagtgggcagggtgggcctgttctcaggcccctcactgtgcctgggcaagctggtcccaggattcatgaatgtacatgtagacaaatggcttccttgctgctagtggtcagtggggatgccatcagtggcagcagccctaggcaagtggctctcaggatctggttactgcatattttagctccatatgtcccagaggcagcctatccagtgcactgctagagttctgagtatctggctgcatttatgggtccagccagtgtcataatgttgcattcctctgagtgggcatgagaggatgtctgcagggcttttgggatgtagagatgcagggtctgttgggtcccagagcaggatgtagtctggtgggagtcgtactctcaaaatggcgctgtgaagcagctgcttgggtcccagagttgtatgtggaacccagcacacactcctctggaataatgccagggtgtaggctttaggtaactccctatactcagggcctgcaacagctgagggcttctccatggctaggattacaggagtctgtggtgggaacctgaaccactggggatctcttgcttgcttttcttccacactggggagttctttttgactctgcactactttgcgtccctctccttccatgccttagaggtttcctgtcactgctttgctaaattccagtgttctctcttaaactctgtctttgacatgtgattatctacttgctgtttttgtacttctccgtggatgagttgggtgctgggtgcctgtagtaaaccatctttgaaaaaaacgttttcaaatacataaagtacaatgcattagactaaaaaagggacccattttatggaaatatacttaccaaatcattttaaagtttgtgatagaataatgtgattcttagctaagggatgctgggcttaatacctaggtgatgggatgatttgttcagcaaaccaccatggcaaatgtttacctgtgtaacaaacctgaagatgtacccctgaacttaaaagttgaagaaaaaaaatgtgatttttttattaagttcattcaataggaagatatttcagtgagcctagtagttactataatctaaaattactaatgagcataagcaatattttgagattactctaataactaatatgttatgcaaataactggaattttattagtgcaaagctatatatatatatatatatacacacacaaatacaattaattgtaacattttgcctacatgcataattaaaagaaatgctaaatttcaattagtgaaaataaaaatggggggaggtggccaagatggccctctagaaacagctttggtaggaggctcccactgagaagaatgaaaacagcaagtgaattctgcaccagcaactgaagtatccaggttctcttgctgggactgacgaggcagttagcatgacccatggagaataaggaaaagcagggtggactgatggcccacccgggagccacgtggggcaaggggaactcccacccgcaacgaagggaggcagtgagcaattgttctatcccacatgggaaaccacatttttccttccacggatttgtgcaacccacagatcaggagatcccctcatgagcccatgtcaccagggccttgtgtcccaagcagacatctgtacagattatcagtggccacttggctggggactgcctgactactgagttcccatgaggagaggtgacggccatcactgcaattgcctgctgcctgagatgactgagctcctggggtgaagggcagcaccctcactgcagctccagtctgccattttttcctgctggtgccagggagactgggcagtttggaaccaggaggaattctccacagcacagcacagtggctgtggcagatcgtggccagactgcctctttaggccagactctgatccgtcctaactcactgggctggttctccctgcagaaacttcagcaactccagccagggttttgcagacagaagtctgatctctctgggacagaggccctagaaggagtggcagccatggatgccatggattagtcgactgagtctttcctcctgctggctctgaagaatctaggcagtacggagaagcaacattacccccagcaccaaggggcaaccagagggcttatttaagctggtccctgatcccatgcctccccaactaggccactctaggtggtcccctagatcaccccaaaaggggtctctaggcatcttatacaggagtgttcctgctggtatcctgtcagtgccagtctgggacggagctcccagaggaaggagcaggcagccatcttttctgttcctcagcctccactgatgacacctccaggtgtgggaggaacccaggtgaataggttctggagtggacccctagcaaacttcagcaggcctgtggaagagaggcctgactgttaaaagaaaaacaaagaaacagaaagcaacaacaacatcatcaacaaaaaaaaaagtcctcacaaaaacctcatccaaaggtcagcagcctcaaagatgaaagctaaatataaactcatgaagatgagaaagaattaatgaagaaacactgaaaaccaaaaaagccagagtgacttttctcctccaaatgatcacaacaccactccagcatggacacagaactggttagaggctgtaatggatgaattgacagaagtaggcttcagaaggtgagtgataatgaattttgctgaactaaaaaagcatgttttaacccaatgccaagaatcaaagaaacatgaaaaaaattacaggagctgttaaccagaataaccagtttagagaagaacataaatgacctgatggaactggaaaacacagcacagaaacttcacaatgcaaccacaaatatcaataaccaactagtccaaccagaggaaagaatttcagattttgaagactatcttgctgaaataaaacaggcagacaagattggagtaaaaataatgaaaaggaatgaacaaaacttaccagaactattgaattatgtaaaaaaaccaaacctatgactgattggggtacctgaaagagatggagagaatggagccaagttggaaaacatactttagaatattatccaggagaacttcctcaacctagcaagacaggccaacattcaaattcaggaaacacggagaacctcagtaagatattccatgagaagatcaaccccaagacacataatcatcagattctccaaggctgaaatgaacgaaaaaaatgttaagggcagccagagagaaaggccaggtcacctacaaatggaagcccatcagattaaaggcagacctgtcagcagaagccctacaagccagaagagattgggggccaatactcaacattcttaaataaaagaattttcaacccaaaatttcatattcagtcaaactaagcttcatcagcaaaggagaattaaaatccttttcagacaagcaaatgctgagggaatttgtcagctctaagcctgccttgcaacagctcctgaagaaagcactaaatatggaaaggaaaagccattaccagccactacaaaaacacaatgaaatacaatgaccagtgacactgtgaagcaactacatcaacaagtctgcaaaataaccagctagcatcatgatgaccagatcaaattcacacataacaatattaacctttaatggaaattggcaaaatcccccaagtaaaaggcacagaatgggaaggtggataaagagtcaagacccatggtgtgctgaattcaagagacccatctcacttgcaaagacatgcataggctcaaaataaagggatggaggaaaatttaccaagtaaatgaaaagcagatagaagcaatctgttgcaatcttagtttatgaccaaacagactttaaacaacaacaacaacaacaaaatcaagaaagagaaagaagggcattacataatggtaaagggatcaattcaacaagaagagctaattatcctaaatatatgtgtatccaacacaggagcacagattcatgaaagaaattcttggagacctataaagagacttggactcccacacaataatactgggagagttttacatgccactgacaatattagacagatcattgagtcagaaaattaacaatgatattcaggacttgaacttagctctggatcaagtggacctgatggatatctacagaactctctacccaaaaacaacagagtatgcattgtttttagtgccacatggcactgactctaaaattgatcacataattggaagtaaaacactcctccacaaatacacaagaactaaaatcttaacaaacagtctctcagaccacaggacaatcaaattagcactcaagattgagtaattcactcaaaaccacacaactacttggaaattgaacaacctgctcctgaatgcctcctgggtaaataatgaaattaaggtagaaaagaagaagttctttgaaaccgatatgaacaaagaatgtactagaatctctggatgcagcaatgttgagggaaatttataacactgaatgcccacatcaaacagctagaaagagctcaacttatcaaactaacatctcaactaaaagaactagagaagcaacagcaaacaaatcccaaagctagcagaatacaagaaataactaagatctgagtggaactgaaggaaatagagacatgaaaaacccttgaaaaaaattcaatgaatccaggagcagtttcttgaaaaaatttaagaaatagaccactagttagactaataaagaagaaaagaaagaagaatgaaatagacacaataaaaaatgataaatgtgatatcactactgatcccacagaaatacaaacgaccatcagagagtactataaacacctgaatgcaaataaactagagaatctagaaaaaattgataaattcctggacacatacaccctccaaagactaaaacaggaagaagttgaatccctgaatagaccaataacaagttctgaaattcagaccgtaataatctatcaaccaaaaaaaatcccaggaccagacggatttacagctgaattctaccagaggtacaaagaggagctggtaccgtttcttctgaaattatctgaaagaattgaaaaggagtgacccctccctaactcatttaatgaggccagcatcatcctgataccaaaacctagcagatatacaacaaaaaacaaaaacttcaagccaacattcctgctgaatattgatgccaaaattttcagtaaactttcaataaaatactggcaaaccaattccagcagcacatcaaaaagcctacccaccacaatcaagtttgcttcattcccaggatgcaaggccgattcaacccatgcaaatcaataaacagagctgaagacaaaaacacatgattaactcaacagacgcagaaagggcctttgataaaattcaacatcccttcatattaaaaattctcagtaaagtaaatattgatggaagatacctcaaaataataagaaccatttatgacaaacccacagacaataccatacttaatgaacaatagctggaagcattccctttgaaaaccagcacaagacaaggatgcactctctcaacacttttattcaatgtagtattggaagttctggccagagaaatcaggcaatagaaagaaatgaaggtattgaaattggaagaggagaagtcaaactgtctctatttgcaggtgatgtgatcctatatcttgaaaaccccatcatctcagcccaaaagcttcttaacctgataagcaacttcagtaacattggaaaaatcaatatcatgaaaatggccatactgcccaaagtaatttatagattcagtgctattcccatttaactactattgtcatttttcacagaattagaaaaaaaaactattctaaaatttatatggaaccaaaaaagagcccaaatagccaagacaatcctaagcaaaaagaacaaagctggaggcatcatgctacctgatttcaaactatactataaggccacactaaccaaaacagcatggtactggtacaaaaacatagaccaatggaacagagtagagaacccagaaataagaccacccatctacaaccatctgatctgcaacaaacctaacaaaaacaagcaatggggaaaggattcctgcccaaggcaatgagagcctacctcttgcatcagcaagacctggatgtgagacatgaagtcgaaagagattattttggaactttaaggtttaatgactgccctattggatttcagacttggatggggcctgtagccccttcgttttggccaatttcttccacttggaattggtgtatttactcaatgcctgtagccccattgtatctagaaagtaactaacttgctttcagttttacaggctcataggtggaagggacttgccttatctcagatgagactttggacttggaattttgggttaatgctggaatgagtaagaccttgatactgttggaaatacatggttgtgttttgaaatgtgaggacatgagatttgggagggtccaagggtggaatgatatggcttggttttgtccctaccaaaatctcatctcattgaattgtggtttccataatccccatgtgtcttgggagggaccaggtggagataattgaatcatgggggtgatttccttcttctttttttcgttatgatagtgagttagtgctcatgagatctgatggttttctaacgggcttccccctcactaggcagtcgttcttctgctgccaccatgtgaagaatgacatgtttgcttctccttctgccatgattataagtttcctgaggcctccccagctatgctgaactgagtcaattcaacccttttcttttatgaattacccagtcttgggtatgcctttattagtagcatgagaacagactaatactattccctatttaataaatggtgctggaagaactggctagccatatgcagaaaactgaaactggacccctttcttacactttatataataactaactcaaaatggatgaaacacttaaatgtaaaacctgaaactataaaaatcctaaaagaaaatctaggcgataccattcaggacataggcacgggcaaagattttatgacaaaaacatcaaaagcaattgcaaaaaaagcaaaaatttacaaatgggattctgttaaactaaagagcttctgcacagcaaaagaaactatcatcagagtaaacagacagtctacagaatgggagaaactttttgcaacctatccatctgacaaatgtctaatatccaaaatctacaagaaacaaacaaatttataagaaaacaaccctgttaaaaagtgggcaaaggacatgaacagacacttctcaaaagaacacatacatgtggccaacaaacatatggaaacaagctcaacatcactgatcattagagaaatgcaaatcaaaaccacaatgagataccaactcacaccagtcagaatggcaattattaaaaagtcaagaaacaacagatgatggcaagactgcggagaagaaggaatgtttttacactgttggtgggaatgtaaattagttcaacttttgtggaagacagtgtggctattcctcaaagacctagaaccagaaatatcatttgacccagcagtcccattactgtgtatatacccataggaatataaattgttctattataaagatacatgcacgcatatgtgcattgcagcactattcacaatatcaaagacatgcaatcaacacacacgcccatcagtgatagactggttaaagaaaatgtggtacatgtacaccatagaatactatgtagccataaaaagcaacaagatcatgtttttttttttttttttttttttgcagagatgtggttggagctggaagctgttatcctcagcaaactaatgcaggaggagaaaaccaaatactgcaagttctcacttataagtgggaactgaatgatgagaacatttggacatggtaaggggaggacaacatgcagtggggcctgttggggagtatggcaggagggaaagcatcaggaaattcactaatagatgctgggcttaataacttgatgatgggatgatctgtgcagcaaaccaccatggcacatgtttactaatgtaacaaacctgcacattcagcacatgtacccctgaacttaaaataaagcaaaataaaaataaaaa

SEQ ID NO: 4634 - DNA, 88270 bp, human
ggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccaggtcagattctttctcatctaggacatctaggctctttgaaacttatttatgcattctcacaaatttccttccccttttccctgttctttccatgatttcaaaatagaaaaaataacatgcagggattaagcagctctttcacaaaatatgcttgaatgaaatgatggatatttaacgacattaaataattatttgtaatattttagatgaaataattgtagttatattttctaagaaatagacttgaatcttttgatttgcttgaaagtaagtcattggtgccaaggtggagggaaagtgtaataaaaatgctcatgagttgataatttaaagctgggtgatgtatatgtagggatttattatattattctctctacttttgcgtgcattggaaaatttttttgttaaaaaaaaaaaggctggttcaaggccaataaaaagcatctgttgaaggccagccttcagaagtgtatgtctttctctgtgtaaggcaggagagttgaatttttttttttaaagctacaatgtgatagtcaaatccaagtgccataatgtttgcttgttcaaggtattcaggaagggtggaggatggaccaagtcactgcctggtagtaatcatgagccatcaaaaaggaggagtaggggggcggacgcggtggctcacgcctattatcctagcactttgggatgccgaggtgagcagatcaggtcaggagttcgagaccagcgtggccaacacggtgaaaccccgtctctactaaagttacaaaaattagccaggcgtgatggtggacgcctgtaatctcagcaactcgggaggctaaggcaggacaatcatttgaacctggaaggcagaggttgcagtgagccgagatcgcgccattgctctccagcctgggcgacaatagcaaaaaactacgtctcaaaaaaaaaaaaaaaaaaaaaaaaaaaaaaaaaggaaggaggaactttgggtgggccttaaaggttgagtgacatctgccatgtggaggggcagggaatgcttttcaggccgagggtttccagagaaaaggcagaattcttctggaaacagcttggctataattttgaatctacaagaaggactaggaggtgaagataaagtgcttcagggccttaaatgttatgctgagcatatacttcattccaatatccatcaagtgctactatttgtattttaagattcctattcttactatcagaaaaggaatctctgatatttagatgaactttatagaatgcaaattataaaactgaatctgacccaagttttatagatccttttaattcaaaggagagaagcatcttttcttcattcgtgcagtaaacctttatgaagcccttgcaatgggtaggaattattctgagagctgtaggggatggatggccaaggcatagtgcctagtacataataggagtgaaacagatatttcaataaataaatcaatgaatgatgggacaactttggcgaccaaaaaagttttagacattgggtttggtggtaatgcatagaaaaaaaaaaatagaaatctattttacttgaaagcatctccctgtcattccatacagttttacttctcacatgtttacctctattcaaaggggtagtggagtggaaggttgcagggagtagggagaaaattgctcagatagaaaacaaaagagcagccgggcgcagtggctcacgcctgtaatcccagcactttgtgccgctgaggtgggcagatcacctaaggtcaggagttcgagaccagcctggccaatatggcgaaaccccatctctactaaaagtaaaaaaaaaaaaaaaaaaaatagccggtcatggtgttgtgtgcctataatcccagctactcgggacgctgaattaggagaatcgcttgaatccaggaggcagagattgcagtgagccgagatcatgccactgcactccagcctgggcgacagaccgggactcggtgtaaaaaataaataaataaataattttaaaaaataaaaaggaaaaagaaaagaaaacaaaagaacaaaacaataagtgcagtagctacataatttcccctccaagtgattcaaatcactgataattgtaataatagccaatatttactgaagatttatgtgccaattttctaaagggctttgcatgttataatttatttaatcacaactctactagagaagtttgtatagaccaagggaagttgtatgacttgccacaagttacacagcaagaagtagctgagctgagctttgaacccagaacacctgattccagagtttatgctctaaacttctatataatacatcccttctaatactatgtatacaactgttttataggaataaatcattgaaatagaggtatgggaaggataatgatttgaggagaccaagggacaaagagatggacaaaaacagaaaaaatgatgccacaatattttttactatttttcagtctttgagtgattgcagtatgactccatttccctggtgcattcatataatagttcacctggtgaaaacaatgaagattatttacaatgctaccctgctttttctggtgtcctgaacctggaagttgtgctttttaaggtaatctctttaccaaaaattattaagaggaggaagagaaaaaaaagagttggttttgacacattaaaaagtagccaaacaaaactcaaaaagatagcagcaaatgataaaattgaaactatattctacattatatgaaaacatattcataataatagtgtaatctgaagaaatgttttgttagattcacttgtacttatagtttctattattactgtgaaatatatcatctttttaactacattttctaattgtttctagtaaatgggaacatgattgatatttttgtatatttattttatatgctggagccttcttaaattctgtttattctaataatgtatagattttcttggattatctgttaattaattatattttgaataatgacagtttctttacaatatttctttaccttatattactgtgctagctaggatcttcagtacaaagaggaacaacagcattggtagaggatttccttattttgttcctaaattctacaaaagtttcaccttttttagtagattgtctttctcaagttaaggaactttcttaatgttcctagtttgctgagaggttttattacaaatattatgaagttttttcccgtctatatgtactgccactttcatatcctttcttcaccattaatatcacagtgtgaccatgtgataaattacaataatcaattttctaatgtatttcttgcttttgctttcatcgagcctcgtcattggatatttggttcctattttaatcattttgacttttatttttatattgaactttcttctactttccttttattgttctttttctaatttattgagttgaatctttagcatcttaattttcaatgttcttctgtaaaataagaatttagaactataaattttcttctaccactttagaaatatttcacagacttttatatatagtatttttatcattcaatatttattatttttaaatttctcttatgatttttttgacccatggtttgttttttttcaatttctaatcatatgggattccttttttaaaaaatatattatgaaatcattacattattcccattctagtttaactttatcttatttttcttttttaattttttttacatctatagactttattagatgttctttatacagtcatctggtatgtataaagagtgaacaatcatataaaaggaaatatggtcataactgattgaattaataaaatcctgaaactaaataactcataattcattgcacaacatatattaggtttcattagatcagtatatagcttagtagtaaactctcctgatggccataaacctctaaggtgttgtcatcctgaaaaatgaaggaggggagggagctggtggggtgcagaatggagaaaccttccatagtgctggtgtgatgtaccctaagttgtaaagttatagggcatcgccacctagtggcagaatttcatgccttgttctaattaagggactttccttgttttccaaagagcaatgtgtcttgttcactttctaaccatccctctctgatgctgtccttcctaaaatccatgcctcctcccatacagtgtaaacccatctgcttttcatccatcaagctgtcaaggatttggttatgacaatttttatgttcacctaactttttagttccaagtacttcggttattttcaaagctacacacaggatgcccatatttttataactccatcttatttgtgaaggattattactttgtgctttggcctagtttttattcttactgctgaatcttttcataagttaaagttattgcagagttaatgctttaaaaggcagtccttagagtaaatagctaaatgaaatcattaccaaaatgtacactttggatttattaagattctagaatttaaaaacaggaaaaggtgccattagtgaaaattccatcactaacattttggtaccactcgtagagcatcacataaatattcagaccgtgataactcagtgcaggaatgttatcaaatatgtccatgcaatctggaactaggaccagagttggcaattgggggtctgaaggcccaacatcccttacactgcttcctacaccttgacaacaggaaggctgagtgatactaggtagtgcactacaacagtgaacataagccagccatctgttttttgcaaagtataataaaatagaaaaacagaacatagaccacttcagagcaaacaaacatatccttcttcaagatgtaggaaaaccatatattcaaaaccaatctcaaactttaaacaataaaagatatcaaacattttaaactgtacaaagcaaattagcaagattttaatgttggcagttttaaaatgtcacccatccaaaacacaaaacagggagataaccaagtcttagctccatcctaatcaaagctgtcatgcagatccagttccactcttctcatctccagcaggtacttcactcaaggaggtaacacccaaggggagtagatggaccaaaaacaagagtgccacatagaaggaagagaggggaccttggactttagctactggttagctattcaactttgatgatattcagtgttttcccaagttattttttctcgcttctcatcacataatttacattatgcatactatgtgccagagactgtttgacatgtagtcagttaattttcacaactgtgtaaagttggtttctatcattagctctatcttagggccaaagaaactgaagcacggagaggttaaattgtattcctaaagcactacacagtgagcaaatagattcagacctgtgcagtctaacccagaattagctctgaatcactctaccattctgtctacaggacaacaagcctgtgtgtttcaggtactttcatggtgatttttcacacaggacagcttttgataatagaaaggccctctctttcaaatgaaaggacttcactgatggattaacaaattctcaccttttcacctatgtgagccaaatactagatctactttcttagtcttcataacaagcaggacgataaccataatttataatgaacacaaaacattgatatagtgttcaaagaacttttgcacacttggtctcgtttggaagaatgaagtaatctggaaacatagaataggcatacactgtgactttaggaagaactctcacaaaatcagaggttgccctatgtaatatcacactttttaccttgagcaggtggatagcctgggagttcttgttatacctcaatcttggtccattctatttgttcccctgtccttcagcagtgcccttaggcttgctttaaacattaacagcattcataagcatggtttctagggtcagagcccagcctccctccacccacccggctccctacacaccttgacagtgctctttgagatgcctcagttctagtctccttgtaattgtgcacagtagatgtctgaacaaatagaccagagtcctgcaaaagtgatcttgaaatcacaattaaaagagactttggagagatctactcaggaaaattttctgaatagacaaatgcttttaaagggggttctagacagtccgtcttttctgcctccttctgcgaagtagggctacactaaaaccttgtcacaatgtgacctgagcaaaaccattatcaagtgatttagttgtcttgaaccagacaaaagaaaattgacatgatttcaagataggtttagaaaaataatctgactagcaaaaaaaaaaaaaaaaatggggggtggttcctagggaatatgagacttgatattttagcaaaaatttaaatatgctctttatgatacacacatttctcgttgctttacaaattttaaatgtaacacaaatttgtttttcacactgttttgttagttgaggtaaggcattcctgccgcacgcagcaatgactcgtcctggaaaaccagggaggctgcatatcctactgttccttctctactagctgtggctccacactctcacctccaccaaagaaagcatttcagaatttaggggtggaaatgatgacaacattgaataattctatttttttcttttttttgagacagagccactgtcgctcaggctgaagtgcagtggcgcaatctaggcccactgcagcctccgccccccggggtcaagcaattctcctgccgcagcctcccaaacagctgggaccaccggtgcccgccaccatgcccggccaattttccgcatccctagtagagacggggtttcaccatgttggtcaggctgatctcaaattcctgacctcaggagatctgcctgcctcggcctcccaaagtgctgggaccacaggcgtgagccaccacgcccggccaatgattctaatttatatttttaaaaattaccttataatcttaaaacttttaactgatgagtatccaacccttaaactttataacaatcatttccaaagtggaaaagtcactgggatatggggaaaagtatgatttgtttttgtacttctatttttctaatgtctactttttgttttctagtctacatgttagcacaggagtatatatattacttaagtatacctatgttggagtgcatacagaatttctttttaaatgataggatgcaaaatcaaatctatttggatagcagtgaagaggctgtttttcaatcctggcaaactagggggtgcatacccccttttttatttagtagcttccataaggctataactcatggaagttacatccttacataaactgatgggctatccaaccagtgaggaaaactgataaagtggcctctgagctccaggaagtagttaaacactactaaaaacatcttgaaaatttggaaaaaaatttaacagtaaatggattcagtagttattcagtataaggtttggaataactccagccattacaatagacatttatttaaagtaaaacatctgcagaccaaataattcttaaaattgtttgtttcaagtttaaccatcttcataacagctgcatccacagacttcaactacatgattacttctttgcccattcttctctttcttttctttcccgaataacctcttgcacatacagttcaaggtagaaattttcctcttcatatttggtccactgctctttaggcaagatctgatgcttcatggtcaggtccaatgcactcttaatgtgacacatcctgtcattataaaggttctcaggaagccttcttatggcttcttttatgtcttcatcctcatatattgtatcatctctcattaaccccagtttattgaatcctgcagtattgtaataccattttcgaataccatccagccacttgcctgatgctgaaatggcctgcttgccagccattttgacctgctttaattttttttaatccttcttataacaagatacaaaaattatacactggctgctcatcccaacagaatttggcaatataaaacattttctttcattaaatacatagaaaaagtgtggttattgatatttattgatgtagttattattgaattttatatttgtgtttttaaaatttttatttttatttaatttcacacttgaaaaaccaggaatattacaaagaactcccagaatgtcctttacccagattcaccaattaacattttatcacgtttgccttatcattctgtttttctcttcctctcctccttctcctatttgacagtagtttgcaaatatcattctcctttacctcttaatatgtcagtgtgtatttcctcagaatgatgatttcctcttatacatcctcagtaaatgtgtcacaatcaagaaatttgacattgtttcaatatcataatctacgccatattccaatgttatcagttgtcccaataatgtcttttgtggttattttctttccttggtcaaagtgctaatccaagatgatgcattacatttacttgtcatgtctcttcagtttttaatatggaacaattccttgacctttctttgtcttttatgtttatagaaaaacaaacttagtttctctcattatattctcacaaccccacttctgacactgattgtgtggaaaaaaagtttttctttggctcttgtaccacagcaaccaacacagaaagcttgtgaacaaatgtattgggattttttctcaccgacaggcaagtaaacaattctgcagtggacaccagctgggtgttctccaatccaattcaattctgaagctatctccctacagaaagtatcagatcccacagattgagggcttagtcccacgagactgcctcaactttagacatcagtttcaaatctgggcctctggaacttttaactgaccagcttcaagttagggttcccgcaacctctctctttaggctcaaataatttgctagaacaacacacagaactcagggaaacacttacttacatttacccattaacagccagatgaagagatacatagagtgaggtctggaaggctactgagcacaggagcttccattcctgtggagttagggtgtgccaccctcctggcatgtggatgagttatttgtcacctttctgaaatcctccacaaattcagctgtactttgtcctcttgtgctttttatgaagactttatctgataggcactaatgaagcatgaacaaccatgtagaaatgtgactggactaaagggtatgatctaataccaatagacttggtggagaaacccagcaaggcttgtctgttcagattcttcttggtttctctgtgcagcattccttcctcctgggtatggggcaggactctttctgaaatgggagtcttatgacccacagtcaaactaggtaggtcagagaatttctttacgaccagctccaagccagaaagctgggtgaagattagagtatatttttagtttctatggcttgcctttgggagaaaaaaaaagcaggtaaaaggagggcaggagaaagtcagagagagattctgttttgtgaagcctaaagtgccccaacattatacatatatatgtgtgtttgtgtgtgtatatatatatatatatatatatatgtatgtatatatatatatttttatatatatatatatagagagagagagagagagagaaactgtctctcacttttatttctctgaagctgtttcaaagctgcttcaggaaccaaagacaaaagaccaaatactttaacaagagatatgcttatttctttagtcacttaggaaataacaagagatttgggagttataagccaggaaccatggacaaaaaccaatatatatatatcacaatatcacacatcgacaattgacacttgggtaaatacaggacacttatttcatagattgtcctttaatttaaatttgtgtgccatttccccattattcagagtacgcatattagcaaaagcaccacagaagtaatgtattgttctcagggcatcataatggtggtacatgatgctggtttgaccctttagtagtaaagttaactttgattacttggttaatgtggtgaatagttgctagattaatccactttacagttatcattttcctctttataattaatgattttgctggggatactttgagactatgtaaatatcctgttcctcattaaattatcatccactggttttcaaatccattgataattcttgactgaatcagatattgctatgatgaatgcaaaatggtaattttcaaactccatcatttttagtacatttattagtttatattctacatcaaggtagagctttttctccatttatttgtttattaattactttggacacatagatttttactttattttaaaaataccctattgttattatttattttaatacccaaattgtctcagatttagtgactggctgcccattcaagttggctcccctgtcttttgacatgtgtcatcattcttaaacacactttttacttactttaaaatttttttacttccttactttcaagcttgtcttgtacttcctaccccattaatcatttctctatagacctctgttatcttttatggagacagtatttagaaactaagtcattgtatatagctgttttttagcttaacattttgtcattgttttccatttaaaagacaatattgcttatgtgataatgattatttagtgtttgttgaaacttgctttatgtcctagagaacatgatcaactagtgttttatgtgtgcctggaaagattgtgtatctaatttttgcgtgtagtgttctgttcattaaatttaactgtgttgtttaaatcttctctattcctaagttttttgtttgctggacctatcagttaccaagagagttaaaatctcccactgtatttgtgtatttgtcaaattcttacacttttgacaatttttgctttgtatacttgaggcattgttagtatgtacatacaagtctagaatagatacatattttacaattttaggaactctttttatctttttgaatgtaaattttttttgtttgctgggtctttttaattttgtaaaatctttctgggtacctagtagttgtatacatttatggggtatatgagatgttttgatacatgcaaagtgtaataatcacatcatgtacaatggggtatccatcatttcaagcatttatcctttgtgttacagacaatttaattatacagttatattattattgactatagtcaccctgctgtcctatcaaataataggtcttattcattctttttgtatacccgttaaccatccccactctcccccaccacccattacccttcccagcctctggtaaccatctttctactctccatctccatgagttcaattgttttgatttttagattccacaaataagtgagaacatgtgatgtttgtctttctgtgcctggcccatttcacttaacataatgatatccagttccatccatgctgttgtaaataactagatctcattcttttttatgactgattagtactccactatgtatatataccacattttcttcgttcatgtatctgttgatgaacccttaggttgcttctaaatcttagctgttgtaagcagtgctgcaacaaacatgggagtgcagatatctctttgataatactgatttcctttgtttggggtatatacccagcagtgggattgctgggtcatatggtagctcaatttttagttttttgaggaatcttcaaatcgttctccattgtggttgtactaatttacattcccatcaacagtgtacaagcattccctcttctccgcattcttgccagcatttgttattgcctgtcacttggatataagccattttaattgaagtgagataatatcccattgtagttttgatttgcatttccctgatgatcaactacaatgagtactttttcacatgcctgtttgccatttgtatatcttcttttgagaaaggtctattcaaatctttgtcacaattttgatcaaattattagattttttcctattgagttgtttgagctccttatatattttggttattaatttcttgtcaaaagtgtagtttgcaaatattttctcccattgcacctatactttatagactgtttgctttgctgtgcagaagctttttacttgatgtgatcccatttgttcatatttgctttgattgcctttgcttgtggggtattaattaagaaatttttgcccagatcaatgtcctggagatttttcccatattttcttgttgtagtttcatagtttgaggtctttgacttaagtctttaatacattttgatttgatttttgtgtatggcaaaagatagctatctagtttcattcttctgcatatggatatccagttttcccagcaccaattattgaagagactgtcttttccatagtgtatgttcttggcacctttgtggaaaatgagtttgttaggtgtgtggatttgtttctgggttctcagttatctttcattggtctatgtgtctgtttttgtgacaataccatgctgttttgattactgtagttctgtagtataatttgaagtcaggtaatatgattcctccagttttgttctttttgcttaggatagctttggttattctgggtcttttgtggctccatataaattttaggattgttttttctatttctgtgaagaatgttttttgtatttttataagtattgcattgaacctgtagattgctttttgtggcatggacgttttaacaatattgattctttcaattcatgaacatggactatctttccattttttggtgtcctcttcaatttctttcatcagtgttctacagtttttattaaagagatctcccacttctttggttgagttaattgctaggtatttaattttatgtttggccattgtaagtggaattacttttaaatttctttttcagattgcccaatgttggcatgtggaaatgctactgattttcgtatgttgattttgtatcctgcaactttactgaatttatcagttcttatagtttttgtggaatctttatgcttttccaaacacaagatcaaatcctctgcaaacaacggtaatttgacttcttcctttccaatttggatgcccttaatttctttctcttgtctgattgctctaactaggacttgcagtactatgttgaataacagtggtgacaatgggcgtccttgtcatgtttcagatcttagaggaaaagctttcagtttttccctatttggtatgatactagctgtgggtctgttatatatgggttttattatgttgaggtatgttccttctatacccatttttgaaggtttttatcatgacggcatgttgaactttatccaatgctttttcagcatcaagtgaaatgaccatatggtttttgtcctccattgtgttgatactatgtatcaccactgttgaaccatccttccatcccagggataaatcccacttggtcatgatgaataatctttttaatgtattgttgaatttgatttgctagtagtgtgttgaagatgtttgcatcaatatttatcagagatattggcctgtttttttttaatttgtttctgtctgattttggtatcaggcctcatggaattagtttggaagtatcccttcctcctgtatttttcagaatagttcaggtaggattgatattagttcttctttaaatatttggtagaattcagcagtgatgccatcaggtcccaggcttttctttactgggagactttttattatggctttttattggtcttttcaggttttggattatcttcatggttcagtcttgatatgtcatatgtgtagaggagtttctctatttagtctagattttccactttattggcatatagttgctcatagttgccattaatgatcctttgaatttctgcagtatcagttgtaatgtgtcctttttcatctctggttttatttatttggatcttccctctttttttcttagtctgggtaaaggtttgccaaatttgtttcacatttcaaaacaccaactttttatttcatttacttatttattttgtattgttttcttcattccaatttcatttatttcggctctggtgtttattatttcttttcttcctctaattttgagtttagttttctcttgcttttctagttctttaagattcattattggtttctttattttaagttttactttttttttatttaggcactaaataactaaacttatatataactaaactttatagctataaacttccctcttagtactgcttttgctttatcccgtaggtttttgtatgttgtgtttccattatcatttgtttcaagaaatttttcaattttcttcttggtttcttcattgacccactgcttattcaggaacatactgtttaatttccaggtatttgtatagtttccaaaattcttcttgttattgatttctatttttattccattgtggtcaaagatgcttcatattatttcaatttttttgaatgttttaagacttgtattgtgacctaacatatggtcatgtgacctaacatggtggctttagagaatgatccatgtgctgaggaaaagaatgtatattctgcagccgttggatgaaatgttctgtaaatatctgttaggtccatttggtctacagtacagattaagtgtgatgtttctttgttgattttctgttcggaagacctgtccaatgtttccttgctgttaacatagctactccacctttccttttttggtggtatttctttttccattgttttactcattcacttttttctttcttttatcttttacaaaatgttctgccaaaaaatcaatgcattgatttgtttgtttctgaatttaccaatagaatttataattagtattaaggataagctttatatatccaaacattatctttctttactaattttttattttatagaatttaaactctacagaaaagtcaaaagatatctttcatgtattgtagtgccattcttttccaagggagatacattccaaaatccccagtggatgcctggtaacatgaagagtaattaatcctatataaactatgtttttttcctatacatacatatgtatgataaagttaaatttataagttaggcacaatacaagattaacaacaacagtaataaaatagaacaattattacaatattcatagtttcatggatagaagactcattcttaccataggtcttagcaacttcaacacatgatttttttcttcccttattaagttgaaaacttcctccttttcacttaaaggaagcattttacagcttctctttagcatatgtgaactgccagcattatcattcttgcactttggggttactattaagtaaaataaggattacgtgaacataagcactgtgatactgcaacagtttattggataaccaagatggctagcaagtgactgatgggcgggtaaggaatacagcgttgatgtgctggacaaagggatgattcacatctggagcaaacatgagatttcatcacactactcacagtggtgtgaaatttaaaacttatgagtcgtttatggaattttccatttactgttttcagactgcagttaatcatgggtaactgaaactgtggatgaggggggaccactttagattcatcagggcatcaatttggctacatatggcttatctctttttctaaatactatatacatatatgtatatatacatacacagatttttttgctgagccattgggaagtaacttgcagatatcatgacacttcaaccctaaacactaaatcatatatctcttaagaacaattaaattactattacacccagagaaatttaacattgatacaatactattatctaatatactatccatatcaagttctcacaattttcctaacaatatcctttatagctttttatttgttttggtccaggatccagtcaggggtcatgcattgtatttagttgtcatgctcctttttagtctttttaaatctagaatagcaccctccctttttttttcttgtcctttttttgtgacgttgccatttttgatgagtccaggtagttttcctctatatgtctcacagtatgaaatgtgtctgattgttttcccatgattagtttaagcgtttttagcaagaagactacatgggcgatgttctgtccttcttaggcacaaaattctagtttatcccaagagcatagatacctttggggattttacagatagctaggtgggtattttttacttcccccttaagaaagttacttttctggacacgggtcaaattatggtttataatttgcaccatattccatgtctaggttacctgtttacagaaatgctcagcatgaagaggagtttctatatctgttctgccatcacattttcctacttcagagcatttacttagtccggttggttgtctgtctgtgtattcacaaactttcacaatcaactcaatagggaataaagttttttttttcagcagcttcatgtgcagtctccttaagtactttttcctatgacttggtcacttttctccctctcattgtataaagactttctcatactactctatattgatcatttttaagaggcaaatatgatatgatcgagttcctctcctgttattcttacctcctgacatgttatcatagcatctgggtcttctgtctctgggaagataagccagattttattgcatggattctgtattagttttatatttctaccataacaaaatgatcacaaatttagaaatttaaaagaacatatttattatagttctggaggccagaagcctgctatgggtctcatcagacctgatgagaagtcaagctgttggctggctgcattcctttctagaggctctggggggatatgtcctgctcatttggttattggcagaattccgttccttgccactgtagatctgagatctgtagatctcagttccttgccactgtagatctgtagatctgagatccctttcttgctggctatgagctaagagctgttcctagcttctagaggccacccaaattccttagattgtcatctcttttctccatcttcaaagccaaccatggcaaattgagtccctctcatacttagaatttctccattttcttttgtcattacatctttcactgactcagatgatatgcttttaaagatatatgcaattagagtatgcccacccaaataattcagaatattctcccccatctcaagatccttaacttaatcacatcagtaaagttccttttgccttgtaaaataacatagtcatggattcttgtaattgtggtgtggacatctttgggtggccatcattttgcctaccacagattttattatagcagcaagccataacctgacaccgagtgtgtgattcatccattcttttattcaaccaacacaaatattaaagaatgcctattaaattgagcatgtattaaattccaggcattgttttatgtgccagggttacaaaaatataacatctaactcaccaaggagttcataaactggtttggtaagttctgtagatagagattggcacagagttctataagagaatacaagaaggcacatgagcaagactagaagagccaggaatggcctcctgtattgatcaatatctaagctcagtctttgaaatgaaatgaggtactaagtaaggatggatgattgtagatgggtaaagaacttcaagcagtgagaaaataatgaccaaagttacagaactcgaggtaggctggtttttggaggaggtgagatgtatggtaggtagttttcctggagtggagagatggagctagatcagcaagctgaagcataaacatgaagactttgtgcactacaaaggctcaagatagatctgtaggaaatgggatgtgactgacaatcttgaaagagagtgctgtgttcacatttatattttatataggtcatactagtggccatgtggaggatagtatagtagagcaagattggggtaagaagatcatttaagatgcttgtatgaaaatcccgacaaaaagtgatgaaggcttgaactcagccaatggtagttgggatggagcacagatcagtgaatttgagaaagttttatgaagtattattgattagatggtgtatcaatcagggttcaaccagagaaatagaaccagtaggagatatatattaagaaatgtattataaagaattggcttgtgggggctgtgtaggcaagcctgaaatctgtggagtgggctttcaggaaggacagactggaactcctggacatgggctgaagctgatgtcctcaggttaaatttattcagggagaccttagctctggtcttaaggtccatcagctgattgaatcaggtctacccaaattatttaggataatctcctttacttaaagttaactgattatagacagtaatcacatctacaaaatagcttcacagcaaaacctagttaaattgaataactgaggactctagcctagccaaattaacacatcaaaagacaatcacagatgggatgtcaagggaaacagaataatagagggtagttctcaagtatgtggcttgagtattacatgaaatcactaactgagttatagaatacaagaaaaagagcaggttttcaacattttcagtaagatacctagatggaggttcctggcaagcaggtaaagatctgagattgcaagagaagtgttgtccatataaatatatttagataaccatcagcataaaggtgatagataaaaccaggagagtaaattaaataatctagaagaaggtatatatagagaaaagttatggattgagaaggaaattctggggaccactaacatttaaggattatctagagaaagatgaacagataaaggagtaataggatgagggggaaacctgaaaaagtctgatgccgattaagaaaaatgtagtgaacagcaacataatatacattagagggttcagtactgaaaaatatttattaatttgtaaattaagtttattggtgaatttagcattaacggtttccgtgttgtgagagcagaggccagattacagtgggttgaagagttactaggaagtgccaagttgagggtagctggcatacgagatgggatgagaatggaggataaaaattggacaatattttataattaaatgataactgtaagaagattaagagccaagggagtattaaaaaataatggtaggaacttgcagttttattgacttaaagtaacaagaaaaggggtagagactgaagatataggacataagagaattcaaagttactgagaaataaaagaaataggcctggttgttagagagggtgcagtgacaagagaaggacttgttttattctttggataagactagggtattggtactcaatggaggtagtataatcctgagagggtgattggaaagtttgtgaaaggcatttaagataatcattattgaagtgcttcctgacatattgtgggcagggtcagtattgctaaataacctgcaatatgcaagacagcctgcacaatgaaattttctatatcccatacaacttttaaatatatcatcagattaaacacttatttttgttaatctagaccttgaattgaactccattctatatatatataagcaagtttttaatacacactaacttttccaggaatgtaactaccatgtaatccaaggtaaaaacctttgttttgttcagaatcttatcaagaatgtttatcattttggaaaatcgtgatacctacaaaaacgctgctcttggatatttgaaatccagataacaacacacatgcatcagtcagtaattatagctgccacctttacaggcattctctgtatattttttgcatacttcattgtcttctagtgttgtcatgtccccacatttgcatcctttttttttttttttgagacagggtctcactctgacacccaggctcgagtagagtgtcacagtcccatctcactgcagcctcgacctcccgggttcaagcgatcctcctgcctcaaccccccaagtagctgggaccacaggcacatgccgtcatgcccagctaatttttgcgtttgttgtagaaacggggttttgccatgttacccaggctggtctcaaactcctgagcttaagtgattgtccgattcagcctcccaaagtgctaggattacaggcatgaacctccatgcctggctgcacatttacgtcttaaaatacattatattttattataaattactttcttgttatttctatttcatattatagatgttttgaaatttttatcttaatataataaagcattaaaatatttaagaaagggagccagatagaattggaaaccattggcacaggagaaataagataagaatgagtgaaaatgccgatttttaaacaacaatgaagagatttgtgagaatggctaatgcattatgctttgtggaagaggttaccatagttctaattcccaaatccaatgactggattttgggttttatcttgatccttctgcaacgtttaaaattctctgctttcttccattctacaacattcttctcttctagttctccttttacatatctggccattgtttctaactatttttttctgagtacctcctcagcctagatccttaaattgagtggttcctgaatcttcctatttcaatcctcacttcttcttggcaatctcacccactgtcctgggttaaataaaaaaaatatatgcagacgacttccaaatctgtatttctagcacaagctttatgccaggctcaaactcatatagtcacctgcctgctctttctgtgtgattgccttatcaccttagactgaatgttaccaaaactgaactcttcatcaccccaccagcagcaccacaaacctctttattctttattgtttgtactagtacttctaaggcaaaaactagggtatatgtcatgtttcttctctcttacctccactttttaatctgtcaccaagtcataatggttatttcttcaaaatattccatgattttttcttctatctttcatttccaaaactctagtcccattccccggtttggaccctcaacatttttctcctgaatgacaataatagttttctaactgatctcctgcctccagtactgtgtactgactcttggcacagcctttagaatagcctctaaaataaatatctgatcacattgctcccctacttaaaatcctttaatgattttttgcttcctatgaaaatcctttaatgatttcttgctttctatgataatgtctaaagtcttagcatgacctaaaagattctgtatggcatacctcttaatcaagccttatctgttgccaccaattcctacacctcatcccaaactcacacaactttttttttttttggattttatgtgccactagggttttcttgaacatactattatttcatgcagatttctttgtacatttgactccctctaacatctttacacccttgtttacctagtgaacttcattcttcaaattcctgctcatttgtcatagcctcaatattttttttcctcatcctctgtcttcagcctctaaaaataattgcttcctctttactatttctgtgcctggtatttgtctattattgcacatgtcaaacaataacttggtgaatgtacattgaattctcagtgtagtacctttccatctggttgattaggaattttaaaaagaattacaatgcacaacagaagttacttcatttgtttctaggtttttgctttttatggtggtataagtcatagtaaagtacataaatcttaagtatatagctcaatgaatttgtacatatacttatatactagtgtaaacaacacctagatcaaaatataaaacacttccaataccctagaaagcacatttgtgtccttttcaagttaacattcacaaaaagtaaccactattctaacatctgtcaccattgattagtttcgcatattcttgaactttatttaagtggaatcacagaatatgtactctttttaaaattttaactattattttacttgtaggggctacatacgcaggtttattacatggatgtattgcactgacatccattccctcctgcctctagtaatctgcagtgtttattgctcccaagtttatgtccatatgtgttcaatgtttagatcccacttataagtgagaacatgtggtattaggttttctgtttctgcattaattcatttaggattatggactccagctccatccatattgctgcagaggacataatttcattgttttctgtggctgcatagtattccatggtgtacatgaaacacattttcttcatccagtctaccactaatgggcacctaggttgatttaatgtctttgctattgtgaatagtacagtagtgaacatacgagtgcttgtgtctttttggtataatgatctatttattatcagttatgtatacagtaatgggattgctggatcaattggtagctctgttttaaaaatttctttgagaaatctaaactgctttccacagtggctgaactaatttacattcacaccagcaatgtatacgtgttcccattgctccacagcctcaccagtagctattgttttttgactttttatagtagccatcctgattggtgtgagattttttttattgtggttttgatttgcacttcacaagactgtactcttttgtcagataggtttttatttgaagccttatcagtaccttagaactctgctgcaccctaatgatatctgtgaggaaagagatattgaaacagctcttgaggggatgctccaagaggaaggcaagacttcaacaactctttttatttttattttatttatttatttttttgagatggagtctcactctgttgcccactctggagtgcagtggcaagatctcagctcactgcaacctccacctcccaggttcaagtgattctcctgcctcagcctccgagtagctgggattacaggtgcacaccactatgcccagataatctcttgtatttttagtagagacgggggtttcaccatgatggccaagctggtttcgaactcctgacctcaagtgatccacctgcctcggcctcccaaagtgctaggattacaggcatgagccaccgtacccagccagcaactattgaatcataaaaatcagaaagcctatgattatttggatgggtgtcctcacagtgaaatagaatgtttatctaatgtgttatctacttgaaggcaaaatgaaatatccagaaatttgaagagactgtggaagaagagatcttaaacgtttccaagaaagaaagggtgttaatttgaaattaactcagttctattcagtcaacacttactgaacacttgctgtgttaggcactatatgagacaaaggggacacccagattactaaaccatgcacctgttcttgaagactactcagtctaatgctggagacaagatctttctgtaaggaagaagctaaagctaggaagcacaaaggatagatagtgatcccagacacagaaggcttcttggaagatatagggcttgaattaaacttacattataaataggaggcattcaggtgaagaaagttagcaaggtatttagttttcagtcatgtgaatttgaggtacctgtgagacattcaagtgaagatgtccactagaatgtcagaaatataggcaaagaatgcagacttgaatgataatcagcatataggtgagagttgtcatcatatagatgagagttgaagccatgggaaagtgtatattgtgagaagaaaaagtggtcaagaagaaaattttgaagaacacaaacattgaaatgactgggagaggaagtgggtcctggaaaggaaactgaattgacaaaaaaaagtaaaaaaggtaagcagaaaatgaggattcctgaaacctaagggaagaaactatctcaagaaagagggtgtggttaacagtgtcaaatatttttataagagaaggatttaaaagcatccattggtgatggggacagaagggaaggaaaaaaaaacattgagtctatcaaaggaggtcctgtattagtgactttggtaagagaagatttattggcatagaagggacagaaaaaagattgtagtggattgaagagtgcatggaggagtgtgaggaagtgggtgaagatagggaagacattgcttccaggaatttgagctgtgatgagtagcaaaaggggaagaaagttataataggaggggaacaaggttaaaggaaccatcttttaagatggaaaagacttaaacttgtttaaatgtcagtaggaaagatcaaataaagaggaatagctgaagagagaggaaaaagtgagtataatgaatagttcgaaggaagtgagattatatgggatccagagcagaggtggaagagtatgccttaggagaggaggagaattgaagggagaaataaacagttccacaataatagttggagacttaaataccttactttcaataatggataagacatgtaaacagaagatcaataaagcgatagtgaacttgaacagcactgtaaaccagtagatctaacagactgtaaagacctaacagcactgtcccatagacctaacaggcatgtatagaacacttcatctaacaacaggaatatacacatttttctcaagtgccatggaacattctccaggataggccatatattaggccacaaaacaagcttcaataaatttaaaaagatgaaagtcatacaatatcttctacaatgacaatggaaggaatctaaaaatcaataacagaggaaaactggaaaatcatataacatttttaataaatggttcaaagaagaaatcttaagggaaattagacaaaattgtgaaataaatgaaaatgaaaacatgccagaacttaagggacacagtaagatcagtgctcagagggaaatttgtagctgtaaatgtcaacattagaaaagcagaaagatcttgaaacctgactctacacctagaggaacaagaaaaataatagcaaaacaaacccaaaactagaagaaggaaggaaataataaagattagagtggagataaacaaaacagagaatagaaaaacaataaagggaaaaacaaaccaaaagttgatttttttgaaaatatcaacaaaattgacaaaacgttaccaaatacctgaaataataagtaaatcagaaatgagaatggagccacatatctacaaccatctgatctttgacaaacctaacaaaaacaagaaatggggaaacaattccctatttaataaatggtgctgggaaaactggctagccatatgtagaaaactgaaactggatcccttccttacaccttatacaaaagttaattcaagatggattaaagacttaaatgttagacctaaaaccataaaaaccctagaagaaaacttaggcaataccattcacgacataggcatgggcaaggacttcatgtctaaaacaccaaaagcaatggcaacaaaagccaaaattgacaaatgggatctaactaaactaaagagcttctgcacagcaaaagaaactaccatcagagtgaacaggcaacctacaaaatgggagaaaatttttgcaatctactcatgtgacaacgggctaatatccagaatctacaatgaactccaacaaatttacaaggaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccgtctcacaccagttagaatggaaatcattaaaaagtcaggaaacaacaggtgctggagaggatgtggagaaataggaacacttttacactgttggtgggactgtaaactagttgaaccattgtggaagtcagtgtggtgattcctcagggatctagaactagaaataccatttgacccagccatcccattactgggtatatacccaaaggactataaatcatgccgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcataaggacaaaaaaccaaacactgcatgttctcactcataggtgggaattgaacaatgagaacacatggacacaggaaggggaacatcacactctggggactgttgtgaggtggggggaggggggagggatagcattacgaaatatacctaatgctaaatgacgagttaatgggtgcagcacaccagcatggcacatgtatacatatgtaactaacctgcgcattgtgcacatataccctaaaacttgaagtataataataataaaataaataaataaataataaaatggttaaatttataatatattaatttatccacagctaaataaaaaacaattaaaagatccatttggaaaaggatacaccctattaaagtaagcctgatacatgaaacaacagctaaaaaagaaaaaaaaaaagtaacacaattgacaacctaaataaagaaaatacttacactgaaagaaaacataaacaagaccaagatcaggttataaaaaaagagttagtgtataatgtacttaaaaacattgcctctgtcaatgaataaaaagaataacatattagcgaagtgcattaaggaaggcaacagacgaataggaaaaataatgtgcaagatttagtaaataaatataggaaaactaaaatggccaggcacagttgctcactcctgtaatctcaatgttttgggagggcaagctgggcggatcacttgaggtcaggagtttgagactaggctgtccaacatggtgaaaccctgtctctacaaaaaattagcggacttggtggtgcatgcctataatcccagtgaatctggaggctgaggcatgagaatcacttgaaccaggaggcgggggttgtagtgagccgagattgcgccactccactccaccatgggtgacaaagtgagactctccctgaaaaaaagaaaagaaaagaaaagaaaatgaccctagacacattttagtatttacataatgtaaattatttaacacaacagtactgattaaactgtaataacaacgataaataatattgactggcttttgataagtataattctcaaatatgatcagaattagaatatattgctaaagaactttaggaaggtgttaattgaaaattctaattgtgagaattcagtgtccacaagagacatgttctatttcataatacattaatatatttccttatattagatttttctgaaggtttgtagaagtgcatcttgtactctgcagaggaataggatgacaaatgaactcagggttaattggaataattttaaaatgcacgttgattaaataagaaggcagcattgatttcacagcaactatatataactattcattgtggtttcataaacaacaaaaattgtaaccactaaacacactaattctgggcatcccttccttcgcttcgtgcaccatcaattcagtggccctttgcagtgagcacttgacatccgaaaaacaaaagaaaacctaaaaaacaaaatgaggaaccaactaaggtacacccttctcacttcagcagggctccccccacttgaccacattggggaaacctgcaaaagtaggaggattctctgcttccatcattccttctagattattctctcggaaagggaaaaagaagagaagagaagggaaagagaagggaacgggaggggaggggaggagaaagggagcggggaagggaaggtttgtcttcaaaaaatccaaccattggggctgtagcatggtggggggagcttgtaggaaggaaggaaggaatgcttgtcttcaaaaaatacaaccactggggctgtagtatggtgaggggagcttgtatttccgggaaacaggggaggtgtgtgtgggtattggaggagggtggctacagaatcctctatgaacctgctcaggtctcataaacaggaaaacaagccacttgcttgtgtgcaccacacttgtccctaggcagcacactccctcctgggaaagagatcaaagtttggattaaaagcagccaggtccgctaggcatggtggcccacacctgtaatctcagcactttgggaggccaaggtgggcagattgcttgaggccaggaatttgagaccagcctggcaaatatggtgaaaccctatctctactaaaattacaaaaattagcatgtaatctcagctactttgggaggctaaggcaagagaattgcttgaactcaggagacagaggtttcagggagccgagattgtgccactgcactccagcctgtgtgacagagtgagactctgtctcgaaaaaaaaaaaaaaaaagaaagaaaaaaagaaaggcagccaggtccaacaggcatctgcacattgttgacccatccagcagaacagggtcgagaaaggcatctgtcgggatggggcaggacaggacgagacagactattgtctgaggcatttggctacctctctgactggaacccaggcactcatatgtgcccaggaatgggtgggatattccggatgggttccacaggtggctctcctagagagacccacttggcatatttgatgatggagcatgcaggctccctggaacgtgatggctcactagttagtacccccggcatcttggtcattctgctgaagtgcatgggtagccaggcccccggcagtgctcagtttctcctgggcccctctgtgttcctgtggtgggtgtggaagtggaggttgaggctagagtgtctttgagggtggtggggcagctgtgccttgatttgatacagagctctctgggctcctcaagctaaactctggtgcttgccagatactcagctcagataatgaatgagacggtggaggacaaattattttgcccctttagggtctccaggcagacatgcaaaagcctggtgcagggccttcatacagagcccatgttgggtgcaaagccatgaccccgttgctctaaaggttgcatgtcctacccataccgcttggtacctggagagcagcatggaacacaatgctctcagaatattgaaaaggttttctgtgtctccactgagggatactcctgcctcaggccctgtggctgcctattgagccatcagcccattctggtgacctgcatgtgccaggacaatgtggtaatctcaaccaggagctccaggtttacataggcccccagtccttgggtaaatccttgtgtaagccagctgggtggctcccactttctcctggaatggcagccctatgatcccagtccacctgtggtgtcccagtggccatgattatgtgtcctttgtcattactttctgcactagaagcagccacaaaacctggagagggccaaaggaagggcaaaggctggatgccgaaacaggattcccacagggtctccagcctaccaggccttggtcattgggacccctgagtttggtggtcaacctgggacctagtggctgttttctttttctccccactttttctctttctccttcctatttttttttttcacatgggaaaaggcggaggacctcggggtggaggagcagggttacagttatagttagtgtttgtggagccctactgccatcaagcagaaacagtttctggcactgggatacagctgagcaccagtgctggggaaagcccaggagtgctaaacagatggcgacaagccgtccacaggctgaagcaggaggagagaggaactcctgactggcccttggcctgtgcttattcccaggatggcgccttggctccacagctctctctgaaagaaagggcaggcaggggcaccccaccatgggctcccctggcagtctccagggacttccaagcatgaatcgccccgcccccagcaccccgaagttcctttgttcccagggagaataagaaccccttggccccagcttggacccagccaatggcaccttggaactccccacaaaggagaccagagtaaacagccccagtctcgaccatcagtgcccagtggcttcccttatgcccatcacaagacagggtgtctctgcccactgggtagactggtcttgaggctgccgggttgttctgtcccagggcctctagagttgctgcttctccatgaggtcccaatggcaggtacacttccttcaagggctttgaaccccggtggggggaaaccctgccttgggctgagtctacccagcctggcacatcctcactgtttgttgtctgtgcctggaagaaggcaagtttccttgcagcctgtagttcagaaacaccttccactggatgtcactgtggctccacaaatggcagtcaccccttttctttcccccaccttgccttcctctccctccttttgctggcaaccaaacaaaacaaagaccagaaaacagaaactggggctgggtgcggtggctgacgcctgtaatcccagcactttgggaagccgaggcaggcagatcacttgaggtcaggagctcgagaccagcttgaccaacatggagaaaccctgtctctattaaaaatagaaaattagctgggcgtggtggcacatgcttgtaatcccaactacggggaggctgaggcaggagaatcgcttgaacccgggagacggaggttgtggtgagccgagattgcaccattgcactccagcctgggcaataagagtgaaactctgtctcaaaaaacaaacaaacaaacaaaacaaaataaaaaaaacaaagaaacaaaccggccaaagagcacccacctcatcttcagcattgctcctcacctacatggtcactttggggaaacttgccttcctccttccctctggattcttctttgtgcagggggtcccaatgaaccagcctatcctcaagaaatcccacccttggggctgtggcatgatgtggggaggttgcactggggaaggtgtgaggggctacagggtggcgggtgtgtgggtgtgtaggtctgcattccagccactgcagatttctctatgaatctgcataggcctcctaagaaggagactggcgcgtgcctagagaaaaagcaggaagataagaatgcaggaagatctggactgcatccttaggggtggcattgtgactctgattgtcagaggtctccgtttttaacgtttaactcccatcacatctcaactttttcctgtcttcacctgtgcttccaaatgtcctcaggcacatatatgtgtccctactcatactcactcacaagcgtctgcccaggcacctccactcatacctgggtcctgttgtgcaggcaactctcagagggcagggttcttcagcttcccggttccatcttgttcatcttcctcatcccttgttgtctggctgcccaatatttgctggcggagggtgcgggatgtgttgggggtggagacagcagggagcagggcagcctcctggcccaacaggcctctgtgcacatgcagtgcagacctgggcataaggggctgacactttctcctggctggttggtggctcttcctctgtgaagccacagaaggtcactcgggttgccacctgtccatctgggacattctgcattcttgttcgctgtcatcctcattgctcacgttgattcttagtatacttttggagtttttcttccttcacttttttcttcttcactgtctttacttctcgtccacttctggtttggggaggtcaggattcgcctggaaggcagggtccggttggcaagcgaacatatttagggagaacacgccttcttttcctcaggaaattagaaagacctcagttgactcctgccagatgtaatcggggtgcccctctcctttctgccctctctccctagtgccataggtggctgattacctcctttccctggtgtccttttcctctccgtttttcctctctcctcccatttctggggtcctacccttcattggccttgtagactaggggctcgtggccccttgcggtttgcagatgacatccagagggtatggtttagcctgcatctttgtcctctgtagcccctgcagacctatttgtggatcaaagcttttgatccgactcacaagggatcccatcaacaagaagcttcttggtggtgtgtcctttcactgggatgtcactgttgtctctttgtcactcgttatgtatgtcaccacgcattgaggcacccatgaactctatccttcaggacagctgaggtggcatgaagctgccatttcttgttctttttctccatctggttcttcttcctcttcctcctcttcctctttctttctcttttcttttcttttctttctttctttccacctcctcctcctttttcttcttcttttcttccctcctcctcctcctcctctctcttttcctttcactttcagatcttggcgagacaaatgttctatggagactgcttcttctgctccttggtaatgggggatgtccctctgcgtgctaggcaaggagaaagcttcacttttgttctgaaaggagcagagatgaaggtcacatgttcagttcctctggtcctctaaaaaaccacccatgtgttacttttaagtgaaatgtcattctgaatgcacttcctaccagtacctcacgattcatccttctaccttgttctccttgaagacgatctaataatgtaatcttggccagtaggagcctcagcaagttttcccccatttcctctccttccagtcaagccatgtgaacacaactatccggatttcagtgtatacaggcaggctgtctctgccatgtgccagtttacccactctcacacaggaaggcacccacaaaccatagacacagatacacatacacacactcactagggacctcagaaatgaaatcacaaacacacccgcacacagagacacatgcagacacacacaaacacacacatagacacacaaacaagaaacctcacaggggcacaggggtgcaggcccaagcattctcccacacagacacatacacaccaccacaggcacgagactgcctacaatttctcccacacaggttctaaatgtgcaaagggaacaggagacaggggagaattcctgactccaggcctgggccatcatgccattgattgatgggcaactctcgccttctcctgagaatcaatgtgggaagtctgttaacagataggatccagcagctggtgtaaaactggagcatcctgggtcaagctgcttaaaaaggaacctcactttgtgttagagacagagagagttcccttgggagccttggccctgtgtgatgccataagaatctgtggtgtgtggtggcattccccagcacccctgagccaccctcctcccacccccatctgtgtgaaacccaggacagcctgagcagagtcagacttgagcaagttgctgagtgtcctctctgagagatactcctgcttcaggccctgtggtttccagttgagcagtccacctattttgatgacctccatgtgtcagcccaaggcggtaaactctacctggagctccaggctttcgtaggacccccagtcctgcagcagaaccttgtgtaagccagctgggtgaccagcaccttgtcctggggcagtagccctatgatcctagtcctcctgtggtgtcccagtaatgatcatgttttttgttgtttactttctgcacgggcaagagccatgaaacctgcagagagccaaaggaagggcaaaggctggctccctaaacaggattcccacaggatctccagcctactggtcctggtccttggtcacacggtcccatgagtttggtgatcaatctgggaccaggtgactgattcctttcactcctctgtctttttttttgtttctctttcctctttaccttttttcacatgggaaaaggcggaggccctggagttgaagtggcagggttacagttgtagttggcgtttgtggagccatactgccatcaagcggaaactgtatctagaaaccggaggcagctgggcacaagtgctggggaaaccccacgagcgcaaaagagatggcggcatggagcccccaggctgaagcaggacaagagaggaactccaagctggcccttggcctgtgctcattcccaggatgcctccctggttccacagctctctccgaaaaaaagggcaggtaggggcgacccaccatgggttcccctggtcatctccaggtactgctggtcctgggttgccacgtctccagtatcccgaagctcctttgttccccgggaggatcggggcccccttgccaacacgtggctccagccaagggaaccccggaactccccacaaaagacaccagagtaaacggcccccgtctcggccagtggcttcgtttatgtccatctcaacatggctgccgggccagctccgccctctgggctgactggtcttggggctgcctggctgttctgtcctggggcctctagagtagttgcttctccaaagcgtcccaatgccaggtacacttccttcaagggctcagaaccccggtgggggaaacccaggcttagacatagtctaagcacatcctcgctgatctctgttcctggcagaaggcaggtgtccgtgcatcctgttgtgttcagaaacaacttccactagatggcaatgtggctccacaaacagcagtcttgtctttcccttcccccattttctttccctctttctgtttttggtgccaaaaaccaaaacaaacaccaaaaaaaaaaaaaaaaaaaagaaactggcctaggagcacccatctcacctacagcagggcttcccatctatgtggtcactttgggggaaccggcaacagtaggatggggtaggggtgggggccacagggagcagggcagcttcctggcccaacaggcctctgtgcccacgcggtgcagacccgggcttgaggggctgatgctttctcctggctggtggctcttcctctgtgaggccacaagaggccactcatagtgctgccagctgtccatctgaggcactttgcattgcagttcgctgtcaatctcattgctcactgattctttgtgtacttttggagtttttctcccttcacttttttcttcttcattctctttactttttctccacttctgctccaggagcagactggaaggcagggtcagctgggcgcggggacaccgttagggaaaacaggcttacttttcctaaggaaattagtaggactctagctgacccctgcgaggagaaattggcgtttccctctcctttctgccctgtctccatattgcagtgggtggctgattatctcttttccctggtgtccaattcctccccgtttttcatcttattcttttttgggcggtccttccctgccttggccttgtagccttggggcttggtagccccttgcagtcagctgatgacatcttcagggcaaggttcagccagcacctgtgttctctgtagcttctgcaggcctacttgtggatcaaagcttttgatcttactcaggaaataccccatcaacaagacgcttcctggttgtgtgtcctttaagccggatgtcagaagtggctccgtgcccctcgttgtatgtcaccacgcgttgaggccctcctaaactagatccttcgggacagctacagtggcatggacctctcacttcctgttctccttctgattcttcttcctcttcctcctcctacccctcttctttaattcttctccttctcctccttctcctcttgctcctcctcctccaactccttcttatcttcctactcctcctttttctttttcttctttttcctccttctactcctcctccccctccccctgcacttccttctcctttgcctctttttctttttttgcttttgcttctgcttctgattctgcttctgtttttcctttcacttgcggatctgggtgggcacgtgttctagcagactgcttcttcttttgctccttggtgatgtgggatgtccctctgcagaattaggcctggagaaagcttcacattcgttctttaaggagcacagatgaaggtcatgagtttagtccctctggtccaccaaaaggctacccacgtgttacttttaagtgaaatgtcatggtgaacgcaccctttacccaatacctcatggctcattgttatttcccattctccttctggatgctgtaagtgtaatcctgagccagtaggagccttggcaagttgtttcctaactcctttttttccagtcaagccatgtgaacacatcaatctgaatttcagtgtgtgcaggcagggtgtctctgccacgtgttcatttgctcacatttcagtgtgtgcaggcagggtgtctctgccacgtgttcatttgcccactctcactcacacagggaggcacacacagacacacatgcaggcacttacaagagacccccagaagaagaaataaaatcacaaacacacacacagagatacatgcacacccagacaaaaacacgcttacacatacccacacaaacacacacatacacacacataaagtaagctcacaaaatcaaaggggtaggggcccaagcattatgggacacaaacacacatcgccacaggcatgcgactgcccacattctcttcgacaggggttcgaaatatgcaaaggggaaagggagacagaggagcattcctgcctccaggcctgagtcattatgccatttattgggcaactagggccttctcctgagaatgaattcgggaagtctgttatcagataggctcaagcagcaggcatgaaactggagcatcctgggtcaagctgcttaaaaagggcccccaagccttgtccctgtgtgatgccatgagaagctgtggtacttggtggccttccccagcctctctgagccaccctcctcccaaccctacctctgtgaaagccgagacagcctgagcagagtcagtcttgagtgagttgctgaatgtccccgctgagggagactcctgcctcaggccctgtggctgcctgttgagctgtctatccgttcttcggacctccatgtgccatcccaaggtggtaaactctaactgcaactccaggctttgggaggacccccaattctccagcaaaaccttgtgtaagccagctgggtggccactgccttgtacttgggcggcagccctgtgatcccagtccttctgccgttttccagtagccatgattatacgtcctttctcttttactttctacaccagcgaaagcgatgaaacctggagaggtccaaaggaaagtcaaaggcttgctgcctccacagcgttccgacaaggtctccagcctactgatccttgatcctagggtccccttaagaggtgaaagtctgatggcagccctggcagccctcgctcgctctcggcgccccctcggcattggcgtccactctggccgcccttgaggagcccctcagcccgccgctacactgtgggagcccctgtctccactggccaaggtcggagccggctccctcagcttgcggggaggtgtggagggagagccgcgggcggtaacacgagctactcgccgcgcttgcgggccaccgggagttgccggtcggcatgagctcggcgggccccgcactccgagcagccagttggacctgcctgcccagggcagtgaggggcttagcaactgggccagcagctactgtgctccacttctcgcctatctcttctccttaactttcttttataattatgttttctccttcctctttgcttttttcacacgagaaagggcggaggccctcggattggaggggcagggttgtggttgtacttggcatttgtggtgccatactgccatcaagcggaaaccgtttctggaaaccggaggctgtagggcacaagtactggggaaaggccaggagcccaaaagggagggtggtgtgggaccccagactgaagcgagacgagagaggaactcctcgctggcccttggcctgggctcattcccaggatggcgccctggctccgcagctgtatgtaagaacgggcaggcggggcggcccgccatggcttcccctggcagtctccaggaactgccaggcatgggtcgccccacactcagcactccgaaacttttttatttcccggcaagatagaggctttctggccccactgtggccccagccaagggcatcgcggagctgcccacaaaagcgaccagagtaaacggccccgttctctggctgtcagtggccagtggcttcccttatgcgtatctcaaaatggctgccggggcagctgcaccctgtgggctgactggtcttcgggatgcctggctgatctgtctcggggcctctagagtagctgcttctccaaggggtcccaatggcaggtccgctttgttctagggctctacgcccgggtcggggaaaccctggcttaggcagagtccaccccgccccgcccatcctcactcttctcggtgcctggcagaaggcaagtgtccctgtccctgcagcctgttgtcatgtccagaatcaccttccgctggatggcactgtggctccgccaatggcggtcacgtcttttccttcccccaccttgcctttatctttctccatctgctgccgacagaataaaacaaacgccaaaaacaaaaaaagccaagaaacaacgaaagataccggccaaggagcacccacctcacctacagcagggctctccacctaggtggtcactttggggaagcctgcaacggtaggagggttctctgcctccctccttccctctggattcttctccgggcagggttcccagtgaaccagagaacgtcaagaaattccacccttagggctgtggctcggtgggggtaggtcgcactgggggcagtgtgagggggtacagggggagggatatgtgggtgtgtgggtctgcatgcgggccgctgcagattcctctaggaatctgcgcaggccgcctgagcaagagaccaggctgcatgcctgtgcgcaccacacttgtccctaggtagcactcttcctcttggggaagggatcaaagttggatggaaagcagccaggtccagcaggcatccgcaccttgttgagccatggagctgcagggagtcgggccggatgtttcttgggatgatgggactggacgggacggactcctgtctgaggccttcagctccctccctctctggagcccaggcactcgtctgtgcacagtggtgggaggagcatgccgggtgggtttcacaggtggctctcctggagagagagcctcttggcatgtctgacggagcacgcgtgctcagtggaacgtggtggttcaccacttagttgccaggcatcttggtccttgtacccaagtgcatgggtagccagggcccagcctgccccacttcgcctggaccccgtctgatttcctgtgctgcgtgtggaggtggaggttgagccttgagtattttgggggagaaggggctcgggcggggggctgtgttttggtttggtagagggctcactgggctctcgagctaaaccctggtgcttgccggatattcagcccagaaaatgcatgagaccgtcaaggacaaattatgccgcccataattagggtctccaggcagacataagaaagcctgatgcgggacatcatacagtgcccatgttgggatgcgaagccgcgaccgccttgctctaaaggttgcataggctactcatgccgctgggtgcctggacagcagcatggaacacaacgctccccgaatattgcaaatgttttctgtcttggcttgttacaaatcttcctggatgtgtaggccaccctggggacgagcagcccttcttagggcagaaaattcaccccacgggtgatgattcccacgctgggggtgtgtgaaccactctcacaaggaggaatgtcaatctcgtgagcgggcctgcactctcacggcattccgggcagaagaaccacatgaccatggaacaggagtcaccccctttctgtcacttgtcaacaaatgcggatttttttttttttttttttttttttttcctcatatgtaggtagcatgcaccagggtgcgcctctggcggtgcctagggagaacgcgagaagaaaagaatgcaggaagatctggactgcgtctttagggttggcactgggactgtgagtgtcagaggtcctcggttttaacttttaactcccatcacatctcaactgtttcctgtcttcatctgtgcttccacaggtcctgaggcaggcccgtacacgtatccccacccatactcacaagcgtctgcccagacaccttcattcacagccggggccggtcatctaggcaactctcaggggggcaggttttcagctttcgggttccctcttgttcacttcaccttccttgtcgctttctgcctggcttcccaatatgtgctgacggagtgtgcgggatggggttgaggtgtgggcagcagggtgcagagccgcctactggcccaacaggcctctgggcggacgcggtgcagacccgggcctaaggggctgatgctttctcctagctggtggctctttttctgtcaggccactcacagggctgccagctgtccagctggggcactctgcattccacttcgctctcaacctcattgctcactctgattctttgtgtactttcggagttttcctcccctcacttttttcttcttcactttctttacttttcgtccacttctgtttggggaggtgagaagcagcctggaaggcagggtcgactgggcgcggggataccgttagggaaaacaggcttacttttcctaaggaaattaggaggactctagctgacccctgtgaggagaaattggcatttccctcccctttctgccctgtctccatattgccgtgggtggccgattacctcttttccctggtgtctgattcctccccgtttattaccttcctctttttggggggggggctcttccctgccttggccttgtagacttggggttcggtgacccttgcagtcggctgatggcatcctcagggcaaggttcagcctgcacctgtgtcctctgtagcttctgtaggccgatttgtggatcaaagtttcggtcccactcaggaaagatcccatcgacaagaagcttcctggttgttcgtcctttaagcgggacgtgactggtggctccttgtccctcgttgtgcatgtcaccatgcattgaggtcttcctgaactagatcctccaggacagctacagtggcatggacctccctctttcttgttcttctgattcttcttcctcttcctccttcttcttcttcttctctacttttattcttccctttctcctctattttacctcttgctcctcctcctccaacttcctctcctcctcctcatgctcctcctttttgtcctcctcctcctcctccttcttctcgttctcgttctccttttccttcttctttttcttctcatttttcttcttcttcttaatctttttctgcctcctcctcctcctcctcctcctcctcctcctccgcctcctcctcctcctcctcctcctcctcctcctccttttcctcttcttctttttctgcttttgcttctgctttttcttccctttttcccttcacactcagatctgttcgggcaagtgttctaggagactgctgctgcttttgctttttggtgattcgacatgtccctctgcagcactaggcctggaggaagcgtcacttttgttctcaaaggagcactgatgaaggtcaccagtttattccctctggtccaccaaaaagctgcccacgtgttacttttaagtgaaatgtcgtggtgaacccaccgtttacccagtacctcatgtctcaccgttattccccattgtccttgtggatgctctaagtgtgcctttctgagccattaggagctttggcaagttgtcccctgtctcctttttctccagtcaagccatgtgaacacatcgatccagatgtgtgcaggcagggtgtctctgccacgtgttcatttgcccactgtcactcacacaggcaggcacccacagaccgcagactcaggtacacaggcacgcaatcatatgggatccggcaacccaaactgaaatacacgcgcacacacagacacatgcacacgcagacacaaacgcacacgttaaacacgcccaagtagacacacgcatacatacacaaacacacgcacgtgcgcacacacgtcagctcacactagcaaaggggtgtgagctcaagcattatcggacacagactcctacacaccgccactggctcgaaagcgcccacaacctcttccacgctggctctaaatgtgcaaagcagaacgggagacaggcgagcattcctggctccagtcctgggtcatcatgccatttattgggcaactagggtcttctcctgagaatgaatgcgggatgtgtgtcatcagataggcccaagcagcaggtatgaaactggatcatcctgggttatgctgcttaaaaagggaccccactttggaggaggggcagagacagtccccctggagtcttggctctgtgtgatgctatgagtatctgtggcgcggggtggccttcccaggcctccctgagccgcccccctcccaccctctcctgtgtgaaagccgagacagcctgagcagagtcagacttgagtgtgttgctgagtgtctcctgtgagggagactcctgcctcagccctgtggctgcctgttgagccttcggccccgttctggtgacctccgtgtgccatgccaaggtggtaaacactacctgcagctccaggccttgggaggacccccggtcctggggcaaatccttgtgtaagccagctgggtggccagcgccttgtcctggggcggcagccctatgatcccagtcctcctgtggtttcccagaggcggtgattatgtgtcctttgtcttttacttcctgcaccagcgggagccaaaatccctgaagagggccaaaggaaaggcagaggttggctgcctccaccgcattcccgcaggttctccagccggctggtcgttggtcctagggtcccctgagtttggcggtcaacctgggaccaggtggctggttcctttcccttctccgtgtctttcttttattattatgttttctccttcctctttgcttttttcacacgagaaagggcggaggccctcggattggaggggcagggttgtggttgtacttggcatttgtggtgccatactgccatcaagcggaaaccgtttctggaaaccggaggctgtagggcacaagtactggggaaaggccaggagcccaaaagggagggtggtgtgggaccccagactgaagcgagacgagagaggaactcctcgctggcccttggcctgggctcattcccaggatggcgccctggctccgcagctgtatgtaagaacgggcaggcggggcggcccgccatggcttcccctggcagtctccaggaactgccaggcatgggtcgccccacactcagcactccgaaacttttttatttcccggcaagatagaggctttctggccccactgtggccccagccaagggcatcgcggagctgcccacaaaagcgaccagagtaaacggccccgttctctggctgtcagtggccagtggcttcccttatgcgtatctcaaaatggctgccggggcagctgcaccctgtgggctgactggtcttcgggatgcctggctgatctgtctcggggcctctagagtagctgcttctccaaggggtcccaatggcaggtccgctttgttctagggctctacgcccgggtcggggaaaccctggcttaggcagagtccaccccgccccgcccatcctcactcttctcggtgcctggcagaaggcaagtgtccctgtccctgcagcctgttgtcatgtccagaatcaccttccgctggatggcactgtggctccgccaatggcggtcacgtcttttccttcccccaccttgcctttatctttctccatctgctgccgacagaataaaacaaacgccaaaaacaaaaaaagccaagaaacaacgaaagataccggccaaggagcacccacctcacctacagcagggctctccacctaggtggtcactttggggaagcctgcaacggtaggagggttctctgcctccctccttccctctggattcttctccgggcagggttcccagtgaaccagagaacgtcaagaaattccacccttagggctgtggctcggtgggggtaggtcgcactgggggcagtgtgagggggtacagggggagggatatgtgggtgtgtgggtctgcatgcgggccgctgcagattcctctaggaatctgcgcaggccgcctgagcaagagaccaggctgcatgcctgtgcgcaccacacttgtccctaggtagcactcttcctcttggggaagggatcaaagttggatggaaagcagccaggtccagcaggcatccgcaccttgttgagccatggagctgcagggagtcgggccggatgtttcttgggatgatgggactggacgggacggactcctgtctgaggccttcagctccctccctctctggagcccaggcactcgtctgtgcacagtggtgggaggagcatgccgggtgggtttcacaggtggctctcctggagagagagcctcttggcatgtctgacggagcacgcgtgctcagtggaacgtggtggttcaccacttagttgccaggcatcttggtccttgtacccaagtgcatgggtagccagggcccagcctgccccacttcgcctggaccccgtctgatttcctgtgctgcgtgtggaggtggaggttgagccttgagtattttgggggagaaggggctcgggcggggggctgtgttttggtttggtagagggctcactgggctctcgagctaaaccctggtgcttgccggatattcagcccagaaaatgcatgagaccgtcaaggacaaattatgccgcccataattagggtctccaggcagacataagaaagcctgatgcgggacatcatacagtgcccatgttgggatgcgaagccgcgaccgccttgctctaaaggttgcataggctactcatgccgctgggtgcctggacagcagcatggaacacaacgctccccgaatattgcaaatgttttctgtcttggcttgttacaaatcttcctggatgtgtaggccaccctggggacgagcagcccttcttagggcagaaaattcaccccacgggtgatgattcccacgctgggggtgtgtgaaccactctcacaaggaggaatgtcaatctcgtgagcgggcctgcactctcacggcattccgggcagaagaaccacatgaccatggaacaggagtcaccccctttctgtcacttgtcaacaaatgcggatttttttttttttttttttttttttttcctcatatgtaggtagcatgcaccagggtgcgcctctggcggtgcctagggagaacgcgagaagaaaagaatgcaggaagatctggactgcgtctttagggttggcactgggactgtgagtgtcagaggtcctcggttttaacttttaactcccatcacatctcaactgtttcctgtcttcatctgtgcttccacaggtcctgaggcaggcccgtacacgtatccccacccatactcacaagcgtctgcccagacaccttcattcacagccggggccggtcatctaggcaactctcaggggggcaggttttcagctttcgggttccctcttgttcacttcaccttccttgtcgctttctgcctggcttcccaatatgtgctgacggagtgtgcgggatggggttgaggtgtgggcagcagggtgcagagccgcctactggcccaacaggcctctgggcggacgcggtgcagacccgggcctaaggggctgatgctttctcctagctggtggctctttttctgtcaggccactcacagggctgccagctgtccagctggggcactctgcattccacttcgctctcaacctcattgctcactctgattctttgtgtactttcggagttttcctcccctcacttttttcttcttcactttctttacttttcgtccacttctgtttggggaggtgagaagcagcctggaaggcagggtcgactgggcgcggggataccgttagggaaaacaggcttacttttcctaaggaaattaggaggactctagctgacccctgtgaggagaaattggcatttccctcccctttctgccctgtctccatattgccgtgggtggccgattacctcttttccctggtgtctgattcctccccgtttattaccttcctctttttggggggggggctcttccctgccttggccttgtagacttggggttcggtgacccttgcagtcggctgatggcatcctcagggcaaggttcagcctgcacctgtgtcctctgtagcttctgtaggccgatttgtggatcaaagtttcggtcccactcaggaaagatcccatcgacaagaagcttcctggttgttcgtcctttaagcgggacgtgactggtggctccttgtccctcgttgtgcatgtcaccatgcattgaggtcttcctgaactagatcctccaggacagctacagtggcatggacctccctctttcttgttcttctgattcttcttcctcttcctccttcttcttcttcttctctacttttattcttccctttctcctctattttacctcttgctcctcctcctccaacttcctctcctcctcctcatgctcctcctttttgtcctcctcctcctcctccttcttctcgttctcgttctccttttccttcttctttttcttctcatttttcttcttcttcttaatctttttctgcctcctcctcctcctcctcctcctcctcctcctccgcctcctcctcctcctcctcctcctcctcctcctccttttcctcttcttctttttctgcttttgcttctgctttttcttccctttttcccttcacactcagatctgttcgggcaagtgttctaggagactgctgctgcttttgctttttggtgattcgacatgtccctctgcagcactaggcctggaggaagcgtcacttttgttctcaaaggagcactgatgaaggtcaccagtttattccctctggtccaccaaaaagctgcccacgtgttacttttaagtgaaatgtcgtggtgaacccaccgtttacccagtacctcatgtctcaccgttattccccattgtccttgtggatgctctaagtgtgcctttctgagccattaggagctttggcaagttgtcccctgtctcctttttctccagtcaagccatgtgaacacatcgatccagatgtgtgcaggcagggtgtctctgccacgtgttcatttgcccactgtcactcacacaggcaggcacccacagaccgcagactcaggtacacaggcacgcaatcatatgggatccggcaacccaaactgaaatacacgcgcacacacagacacatgcacacgcagacacaaacgcacacgttaaacacgcccaagtagacacacgcatacatacacaaacacacgcacgtgcgcacacacgtcagctcacactagcaaaggggtgtgagctcaagcattatcggacacagactcctacacaccgccactggctcgaaagcgcccacaacctcttccacgctggctctaaatgtgcaaagcagaacgggagacaggcgagcattcctggctccagtcctgggtcatcatgccatttattgggcaactagggtcttctcctgagaatgaatgcgggatgtgtgtcatcagataggcccaagcagcaggtatgaaactggatcatcctgggttatgctgcttaaaaagggaccccactttggaggaggggcagagacagtccccctggagtcttggctctgtgtgatgctatgagtatctgtggcgcggggtggccttcccaggcctccctgagccgcccccctcccaccctctcctgtgtgaaagccgagacagcctgagcagagtcagacttgagtgtgttgctgagtgtctcctgtgagggagactcctgcctcagccctgtggctgcctgttgagccttcggccccgttctggtgacctccgtgtgccatgccaaggtggtaaacactacctgcagctccaggccttgggaggacccccggtcctggggcaaatccttgtgtaagccagctgggtggccagcgccttgtcctggggcggcagccctatgatcccagtcctcctgtggtttcccagaggcggtgattatgtgtcctttgtcttttacttcctgcaccagcgggagccaaaatccctgaagagggccaaaggaaaggcagaggttggctgcctccaccgcattcccgcaggttctccagccggctggtcgttggtcctagggtcccctgagtttggcggtcaacctgggaccaggtggctggttcctttcccttctccgtgtctttcttttattattatgttttctccttcctctttgcttttttcacacgagaaagggcggaggccctcggattggaggggcagggttgtggttgtacttggcatttgtggtgccatactgccatcaagcggaaaccgtttctggaaaccggaggctgtagggcacaagtactggggaaaggccaggagcccaaaagggagggtggtgtgggaccccagactgaagcgagacgagagaggaactcctcgctggcccttggcctgggctcattcccaggatggcgccctggctccgcagctgtatgtaagaacgggcaggcggggcggcccgccatggcttcccctggcagtctccaggaactgccaggcatgggtcgccccacactcagcactccgaaacttttttatttcccggcaagatagaggctttctggccccactgtggccccagccaagggcatcgcggagctgcccacaaaagcgaccagagtaaacggccccgttctctggctgtcagtggccagtggcttcccttatgcgtatctcaaaatggctgccggggcagctgcaccctgtgggctgactggtcttcgggatgcctggctgatctgtctcggggcctctagagtagctgcttctccaaggggtcccaatggcaggtccgctttgttctagggctctacgcccgggtcggggaaaccctggcttaggcagagtccaccccgccccgcccatcctcactcttctcggtgcctggcagaaggcaagtgtccctgtccctgcagcctgttgtcatgtccagaatcaccttccgctggatggcactgtggctccgccaatggcggtcacgtcttttccttcccccaccttgcctttatctttctccatctgctgccgacagaataaaacaaacgccaaaaacaaaaaaagccaagaaacaacgaaagataccggccaaggagcacccacctcacctacagcagggctctccacctaggtggtcactttggggaagcctgcaacggtaggagggttctctgcctccctccttccctctggattcttctccgggcagggttcccagtgaaccagagaacgtcaagaaattccacccttagggctgtggctcggtgggggtaggtcgcactgggggcagtgtgagggggtacagggggagggatatgtgggtgtgtgggtctgcatgcgggccgctgcagattcctctaggaatctgcgcaggccgcctgagcaagagaccaggctgcatgcctgtgcgcaccacacttgtccctaggtagcactcttcctcttggggaagggatcaaagttggatggaaagcagccaggtccagcaggcatccgcaccttgttgagccatggagctgcagggagtcgggccggatgtttcttgggatgatgggactggacgggacggactcctgtctgaggccttcagctccctccctctctggagcccaggcactcgtctgtgcacagtggtgggaggagcatgccgggtgggtttcacaggtggctctcctggagagagagcctcttggcatgtctgacggagcacgcgtgctcagtggaacgtggtggttcaccacttagttgccaggcatcttggtccttgtacccaagtgcatgggtagccagggcccagcctgccccacttcgcctggaccccgtctgatttcctgtgctgcgtgtggaggtggaggttgagccttgagtattttgggggagaaggggctcgggcggggggctgtgttttggtttggtagagggctcactgggctctcgagctaaaccctggtgcttgccggatattcagcccagaaaatgcatgagaccgtcaaggacaaattatgccgcccataattagggtctccaggcagacataagaaagcctgatgcgggacatcatacagtgcccatgttgggatgcgaagccgcgaccgccttgctctaaaggttgcataggctactcatgccgctgggtgcctggacagcagcatggaacacaacgctccccgaatattgcaaatgttttctgtcttggcttgttacaaatcttcctggatgtgtaggccaccctggggacgagcagcccttcttagggcagaaaattcaccccacgggtgatgattcccacgctgggggtgtgtgaaccactctcacaaggaggaatgtcaatctcgtgagcgggcctgcactctcacggcattccgggcagaagaaccacatgaccatggaacaggagtcaccccctttctgtcacttgtcaacaaatgcggattttttttttttttttttttttttttcctcatatgtaggtagcatgcaccagggtgcgcctctggcggtgcctagggagaacgcgagaagaaaagaatgcaggaagatctggactgcgtctttagggttggcactgggactgtgagtgtcagaggtcctcggttttaacttttaactcccatcacatctcaactgtttccttgtcaacaaatgtgtgtccttttctcataagtgtataccatccacctcggggcccctccttttgtgccttgggacatcgggtgaagtaaggaacgcaggaactttggtgttgttagttttagtgtcagaggttcttgtttttacctttgaacatcaatcacgtctgaactatatcctgtcttcatctgtggttgcataggtcctcaggcacatacaagtatcttctccagtaatgacaagcttctgcctagacaccttcattcacaactgtttcccgtcatctaagcaaccctcaggaggtagttgttaagctttcacgttccctcctgttcatttttcttattgctttctctctgccttcccaatatttgctgatggagtgtgcgggatggggttgaggtgtgggcagcagggaacagggcagtctcctggcccaacagatctttgtgcagacgcggtacagacccgggatttaggggcttatgctttcttctggctggcgccttatcctgtgtgaggacacaggaggctactcacagggctgtcagctttccatatgatgaactctgctttccagtttactctgtaactcattgctcactctgattctttgtgtacttttggagttttcctcccttcacttttttcttcttcactgtctttacttttcgtccgcttctgtttatggaggtcacaatcagccaagaaggcagggtcagttatgcacggggacatggttaaggaaaacaggcttactgtttctaaggaaattagaaggactccagctgaaccctgcgaggagaagttggcatttccttattctttctgccgtgtctccatattgccatgggtggctgattacctcttttccctggtgtccgattcctccccgtttttcatctttttcttttgggtggttcttcactgccttggttttgtagactttgggcttggtggccccttgcagtcagctgatgacatcctcagggtaaggttcagcctacacttgtgtactctgtagttctgcaggccaatttgtggatcaaagttttgatcccactcaggaaagatcccatcgacaagaagcttctcgtttgtatgtcctttaaacgggaggtgacctggggctccttgtcactcattgtgtatgtcaccacacactgaggtcttccttaactagatccttcaggacagctacagtggcatggacctcccactttctgttcttgttctctttctggttattcttcctcttcctcctcctactcttttaattcctcttctcttttttgttttcttactcttcctcctccatcttctcctcctcctcctccttcttctttccttctcctcttcttttgcctcttcttcttttttgtcttttgcttttgcctctgcttctctttttcccttcactttcagatcaggacagacaagtgttctaggagactgcttcttcttttgctccttggtgattcagcatgtctctctgcagtactaggcctagagaaagcttcacttttgttcttaatttagcactgatgaaggtcaccagtttagtctctctggtataccaaaaaccttcccacatgttgcttttaagtgaaatgtcatggtgaacagatcctttacccagttcctcatggcttgctgttatttcctgttctgttcgtggatgcactaggtgtgtaatcctgagccattaggaagtttggcaagttgtcccgtgtctccttttttttcagtccagccatgtgaacacattgatccggatttcagtttttgcagggtgtctccgccacatgcccatttgcccactctcactcacagaggcaggcacccacagaccacagacacagacacaatacatacactcacaagggaccccccaatcagaaattaaatcacaaacacacacgcacatggagactcatgcacacacagacacaaacacacacattaaacacgcctaagcggacacacacacagatacacacagacacacacacacacacagaagtaagctcacactagtacaaatgtgcgggtttaagcattatcgtacacagacacacacaacacctcaggcacgaaactgcccacaatgtcttccactcgggctgtaaatggggctgtaaatggtggcgtgtggccctcaaactgaggcgggacaagagaggaactccttgctggctcttggcctgccctcattcctaggatggcggcctgtctccacagctgtatgtaagaaagggcagtcggggcggccagccatggcttcccctggcagtctccagaaactgccgggcatgagtcgcccaacactcaacacgccgaagctcctttgtttcctgggtggataggggctttcttgccccactgtggccccagccaagggcatcccagaactgcccacaaaagagaccagattaaacggccccattttctggctgtcagtggccagtggcttcccttatgcgtatctcaaaatggctgctggtgcagctccactctgtgggctgacgggtcttcaggctgcctggctgatctgtctcggggcctctagagtagctgcttctccaagcggttccaatggcaggtacgatttgttctagggctctaaaccccagtcggggaaaccctggcttaggcagagtccacccagtcccgcacattttcgcggatctctgtgcctggcagaaggcaagtgtccctgcagcctgttgtcatgttcagaaacaccttccgctggatggcactgtggctccacagatgacagtcacgtcttttccttcccttcccttgcctttgtctttctccatttgttgcgaacagaataaaacaaaaacacacacacaaagcgaagaaacaaagaaagaaacgggccaaagagcacccacctcatctacagcagggctccccacctacgtggtcactttgggggaaggtgcaacagtaggagcgttctctgcctccctccttcttctggattcttctctgggcaggggtcccagtgaaccagaggagcctatcctcaatacatcccacccttatggctgtggcatggtgggggtaggtcgcactgggggcagtgtgagtgggtacagggggagaggtgtgtggatgtgtggccctgcatgcaggctgctgcagatttctctaggaatgtgctcagctccccctaggcaagagaccaggccgtatgctgaggtgcacgacacttgtccctaggtagcactcttcctcttggggaagggaccaaatcttgtatggaatgcagtccggtccaacaggcttccgcacattgttgacccatggagcagcaaggagtttggctggatgtttgttgggatgggactggactggaaggactcctgttggaggccttcagctccctctctctctctggagcccaggcactcatctgtgcccaggggtgggaggggtattccaggttgttttacaggtggctgtcctggagagaaagccacttgttatgtctgactgagcatgcgtgctcactggaacgtggtggttcaccagttatttgccccggcatcttggtcattctgcataagtgcatgggtagccaggttccagacagtgctcgccttctcctgggcctgtctttgttcctgttctgcgtgtggaagtagaggtggatcctggaatgtgttgggtgggatggtggtagggcaactgtgccttggtttgatacagagctctctggggtcctcaagctgaactctggtgcttgcgggatattcagccctaaaaatgaatgagtcggtcgaggacaaattttgccggctctttagggtttccaggcagacgtaagaaatcctgacgcgggccatcatacagcccgcttcttgggatgcgaagccatgaccgcgttgctctaaaggttacatatgctacccatgccgctcagtgcctgggcagcagcatggaacacacagctcttcaaatattgcaaatgttttctgtctttgcttgttacaaatcttcctggatgtgtaggccgcactgggaatgagcagagtttcataggacagaaaattcatgccacgggtaatgattctcacactcatgagagtgtgaaccactctcacaagaggaacatcaatctcgggtgtgggcctgcactcccagggcattccaggaagaagactcacatgaccatggaacaggagtcaccccctttctgtcacttgtcaacaaatgcggattcttttttcacatgtaggtagcatgcaccagggggtgcttctgccccttcctagggacaaagggagaagaaaagaatgcaggaagatttggactgtgtctttggggtggcattgcgactctgagtgtcagaggacctcgtttttaacttttaactcccatcacgcttcaactttttcccatcttcatctgtgcttccatagttcctcagacaaatacacgtatccccacgcacactcacaagtgtctggccagacaccttcattcacctccgggtacagtcgtctaggcaattctcagggggcagtttttcagctttccctttccttcttgtttacctttcttgttgtttcctgtctggcttcccaatatttgctgatggtgtgtgcgggatggggttggggttggggcagtagagagcagggcagcctcctgaaccaacaggcctctatgcagtcgcggtgcagactcgggcttaaggggctgacactttcttcttgctggtggctctttttctgtgaggacacaagaagtcactcacagggctgccagctattcatttggtgcactctgcattccagttccctctcaacctcattgatttctctgattctttgtgtacttttggagattccctcctttcacttttttctccttcactgtctttacattttgtccacttctgtttggggaggtcaggagcagcctggaagacagggttgactggttgcggggacaccctcagggaaaacaggcttacttttcctaaggaaattagaaggactctagctgaccccgtgaggaaaaattggcatttccctcccctttctgccctctctccatattgccatgggtggctgattccctcttttctctggtgtctgattcatccctgtttattatctttttttttggaggtggggtagggggtccttccctgctttggccttgtagacttggtgctgggtggccccttgtagtcggctgatgacatcctcagggcaaggttcagcctgcacctgtgtcctctgtagcttctgcaggcccatatgtggatcaaagttttgatcccactcaggagagatcccattgacaagaagcttcctagttgtttgtcctttaaagggctgtgactatggctctttgtcctttgttgtgtacatcaccatgcattgaggtcttcctgaactagatccttcaggacagctacagtggcgtgaacctcccactttctgttctttttctgcttctggttcttcttcatcttcctccttctaatcctcatctttaattcttcttctcctcttttttatcctcttgctccttctcttccaacatcctcttcttctccttctcctcctccttctcctccatcatctcctccctcctccttcttctttctcctccttctccttctttctgcttcttctttttcttcttcttcttcttcttgtgcctctgcctcctcctcctttgcctcttctttttttgcttttgcttctgcttcagctttttttccccccttcactgtcggatctgggcgggcaattgttctaggagactgcttcttcttttgctcttttgtgatgtgtgatgttcctctgcaacattaggcctggagaaagcttcactttcattcttaaaggagcacagattgaggtcaccagtttagtccttctggtccaccaaaaagctgccaacatgttacttttaaatgaaatgtcgtggtgaatgaatgcccccttcacccagtacctcatggctcactattatttcccgttctccttctggatgctctaagtgtgtaattctgagtcattatgagatttgtcaagttgtcatctctctccttttttccagtccagccatgtgaacacattgatccggatttcagtgtgtgcaggcagggtgtctctgcacgtccatttgctgactctcactaacaaaggtaggcacccacagaccacagacacagacacaatgcacgcactcacaagggaacatgaaccagaaatgaaatcacaaacacacatgcacacagacacatgcacacacagacacaaacacacacgttaaacaagcccaagcagacacacgcacacacacacacaaacacacagaagtaagctcacactagcaaaggggcgtgggcttaagcattgttgtacacagacacacaccaccacaggcctgaagctacccacaatctcttccacatgggctctaaatgtgcaaaggggaacgggggacaaacaagcattcctggctgcaggtgtgggtcatcatgccatttattgggcaactaaggccttcttctgaacataaatgcaggaagtctgttatcagattggcccaagcagcaggtgtgaaactggagcatcctgggtcaagctgcttaaaaagggaccccactttggggtaggggtagataaagtccccttgggatccttgtccttgtgtgatgccatgagaatctggtgtgtggtggccttccccagccaacctgtgccaccctcctctcacccttgcctgtgtgaaagcagagtcagacttgagtgaggtgttgagtgtcccctgtgaggagactctggcctcaggccctgtagctgcctgttgagtgggtggccccagtggcccattctggtgacctccatttatgatcccaagttggcaaactctacctgcagttccaggccttgggaagtctcctagtctgggggcaaatccttgtataagacagccgagtggccagcgcctcgtcctggagctgcagccctatgatcccagtcctcctgtggtttcccagaggccatgataatgtgttctttgtcttttactttctgcacctgcgggagccatgaaacctagagaggaccaaaggaagggcaaaggctggctgcctccatagcattcccgcagggtctccaggctactggtccttggtgctagagtcccctgagtttggttgtcagcctgggaccaggtggcttgttcctttctcttctccttatcttttttatttttttctccttcctctttattcacatgggagaaggcagagaccatcagcttagagaagcaaggttatggttgtagttggcatttgtggagccatactgccatcaagtggaaactgtttctggaaatgggagggagctgggcacaagtgctggggaaagcccaggggcacaaaacagatggtggcatggggcccccagactgaagcaggatgagagaggagctcctcactggcccttggcctgggctcattcccaggatggtgccctggctccacagctgcatgtaagaaagggcagttggggcagcccaccatggcttcccctggcagtttccaggaactgccgggcatgagtcgccccacactcagcaccccgtagctcctttttttttttttttaccaggaagataggggccttctggccttactgtggccccagccaaggagggcaagctgtaactgcccacagaagaaaccagagtaaaccacttcattctctggctgtcagtggccagtggcttcccttatgcgtatctcaaaatggctggggggcagcttcactgtgtggactgactcgtcttggggctgcctggctgccctgtgtcagggcctctagagtaactgcttctccaaggggtcccagtggcaggcactctttgttctagggctctaaaccccagttggggaaaccctggcttaagcagagtccacccagccccgcacattttcactgatctctgtgcctggcagaaggcgagtgtccctgcagcctgttgtcatgttcagaaacatcttcctctgggtggcactgtggctccgcaaatggcagtcacgtcttttccttcccccaccttgccttgtctttctccatttgctgccaacggaataaaacaaatgccaaaaacaaaaagcaaagaaacaacgaagaaactggccaaggatcacccacctcacctacagcagggatccccacctacgtggtcactttgggggaacctgcaacagtaggaggttctttgcctccctccttccctctggattcttctctgggcagggtacccagtgaaccagaggagtctgttctcatgaaatcccacccttagggctgtgtcatggtgggggtaggttgtactgggggcagtatgatggggtacaggagagggatgtgtgagtgtgtgggcctgcatgcaggccactgcagattcctctaggaattggcccaggtccccaaagcaagagaccaggcctcatgatggcatgcaccacacttgtccctaggtagcactcttcctcttggggaagggacaaaatcttggatggaaagcagccaggtccaacaggcatccacacattgttgagccatggagcagcagggagttgggtcggatgtttgttgagatgggactgcatgggactgactcctgttcgaggccttcagctacctctctctctggagcccaggcactcataggggtccaggggttggagggattttccaggttttttcacaggtggctctcctggagagagagccacttgtcatgtcttactgagcgtgcatgctcactggaacgtggtggttcaccagttatttgccttggcatcttggtcattcttcccatgtgcatgggtagccagagcccagacagtgcttgccttctcctgggccctatctttgttcctgttctgcgtgtcgaaatggaggttgagcctggagtgtgttggtggggggtgtggtggagtgtctgtgcctttgtttgatacagagctctctgaggtcctcaagctaaactctggtgcttgccggatattcatccagaaaaatgaatgagacagtcgaggacaaattatgctgcccctttagggtctccaggaagacataagaaagcctcacttgggccatcatacagagcccattttgggatgcgaagccatgaccgcgttgctctaaaggttacatatgctacccatgctgcttgatgcctgggcagcagtatggaacacacagctcttcgaatattgcaaatgttttctttctttgcttgttacaaatcttcctggatgtgtagaccacactgtgaacaagcagagcttcataggacagaaaattcaccccatgggtattgattcccacactcaggggtgtgtgaaccactctcacatcacaagagcagtgtcaatctcgtgtgtgggcctctactctcagggcattctgggaagaagacccacatgactatggaacaggagtcacccccttttggtcacttgtcaacaaatgcagattcttttctcataagtaggtagcatgcaccacggggcacctccggccctgcctaggtacaatgggagaagaaaagaatgcaggaagatctgactgcgtctttaggagtgacatggcaactctgagtttcagaggtcctcgtttttaacttttaactcccattacgtctcaacattttcctgtcttcatctgtgcttccaaaggtcctcagatacatacacatctcaccatgcatactaacaagcacctgcccagacaccattcactcccagatctggttgtctaggcaactcttaaggggcagtttctcagctttcaggttccctcttgttcacctttcttgtcgctttctgcctcacttcccaatatttgctggcagatcgtgcggatggggttggggtgggcgcagtggggagcatggcagcctcctggcccaacaggcctctgtgcagatgtggtgcaaacccagtcttaaggggctgacgctttctcttggctggtggctcttcttctgtgaagccacggaaggccactcacaaggctgccagctgtccacctgaggcactctgcattccagtttgctctcaacctcattgctcactctgtttctccgtgtacatttggagttttcctcccttcacttttttcttcttcactgtctttacgttttgtccacttttgtttggcaaggtcaggagcagcctggaagtcatggtctactgggggaggggtcacccttagggaaaacaggcttacttttcctaaggaaattaggataactctagctgacccctgtggggagaaattggcatttccctcccatttctgctctgtctccgtattgccattggtgggtgactacctcttttccctggtgtccgattcatccccatttattatcttcctcttttttggggggtccttccctgccttggccttgtagacttggggcagggtagctctttgcagttggctgatgacattctcagggcaatgttcaacctgcacctgtgtcctctgtagcttctgtaggcctatttgtggatcaaagttttgattccactcaggaaagatcccaacgaaaagaagcttcctgattatttgtcctttaagcggaacatgaccagtggctccttgttcctcattatgtatgtcaccatgcattgacgtcttcctgaactggatacttcaggactactacagtggcatggacctttctgttcttgttctccttctgatttttcttcctcttcctcctcctactttttttctttaattttcctttttttatcctcttgctcctcctcttccagttcatcttctcctccatcttcttctactcctatttttcctcctcctcctccttcttcttcttattgttgttgttgttcttcttcttcttcctcttcctcttcctttctttctccttcttcttcgtcctcctcctcctctgtctctttttttttctttttaatttttttttctttgcttttgcctcttcttatgcttctctttttcacttcacttttggatttgggtgggcaagtgttctaggagactgcttcttcttttgctccttggttatgctggatgtctgtctgcagcactaggcctggagaaagcttcactttctttcttacaggagcacagatgaaggtcatcagtttagtccctctggtccaccaaaaagctgcccacatgttatatttaagtaaaatgtcgtggtgaacgcacccttacctcgtacctcatgggttgccattatttcccattctccttaaggatgttggaagtgtgtaatcctgagccattaggagctttggcaacttgtcctctgtctcttttttttccagtcaagccatgtgaacacattgatctggatatcagggtgtgcaggcagggtgtctctgccacgtgttcatttgcctactctcactcacacaggcaggcacccacagaccacagacacaatgcacttactcacaagggaccctgcaaccagaaataaaatcacaaacacatgcacacaaagagacacatgcacgtgcagacacaaacattcatgtcaaatacgcccaagcagacacacacacacacaaacacacacaagttaactcacactagcaaaggggtgtgagctcaagcattattggacacagacacacacaccccaccacaggcccaaaactgcccacaatctcttccacactggttctaaatgtgcaaagcagaatgtgagacaggcgagcattcctggctccaggcctgggtcatcatgccatttattgggcaactagggccttctcctgagaatgaatgtgggaagtctgttatcagataggcccaagcagcaggtgtgaaactggagcatcctgggtcaagctgcttaaaaacggaccctgcaaccagggtaggggcagagaaagtcccctcaggagccttgtccctatgggatgccatgagaatctgtggcacgtggtggccttcctcagcctccctgagccaccatcctcccaccccgcctgtgtaaaagccaagacagcctgagcagagtcagacttgagtgagttgctgagtgtcccccgtgagggagactccgggattctggtgacctccatgtgccatcccaaggtggtaaactctacctgcagctccaggctttggaggaccctcagttctggggaaaattgttttgtaatccagctgagtggccagcgccttgtcctggggtggcagccctgtgatcccagtcctcctgtggtttcccagaggccatgattatgtgtcctttgtcttttactttctgcactggtgggagccataatacctggagaggaccaaaggaagggcaaaggctggctgcctctacagcattctgcaggatctccagtctacaggtccttggtcctagggtcccctaaatttggtggtcaacctgggaccaggtggctggttcctttgtcttctccttgtcttttttttctccttcctctttacttttttcacatgggaaagcatggagggcctcagcttggaggggcagttgaggtagtagttggcatttgtggagccatactgccatcaagcggaaactatttctggaaacgggaggcagctgggcacaactgctggggaaatccgaggggcacaaaagagatggtggcgtgtggcccccagactgaagctggatgagagaggaaccccttgctggcccttcgcctgggctcattcttaggatggcaccctggctccacagctgtctttaggaaagggcagtcaggccggctgtgagcaagcagagcttcataggacagaaaatggcttcccctggcagtctccaggaactgccaggcatgagtcaccccacactcagcatcctgaagctccttttcctcccgggagggtaggggctccctgttccccctgtggccccccaagggcacctcggagctgcccacaaaagagaccagggtaaacagccccattctcatccatcagttgccagtggcttcccttatgcacatctcaaaatggctgctggggcagctccaccctgtgggttgactggtctgcaggctgcatggctgctctgtctctgggcctctagagtagctgcttctccaaggggtcccaacggcaggtacgctttgttctagggctctaaaccctggtcggggaaaccctggctcaggcagagtccacccagccccgcatatttttgctgacctcggtgcctagcagaaggcaagtgtttccgcagcctgttgtcatgttcagaaacaccttctgctggatggcactgcgactccacaaatggcagtcatgtcttcttcttcccccactgtgccttcgtctttctccatttcctgccaactgaacaaaaccaacacaaaaaaacaaaagcaaagaaacaaagaaagaaactgtccaaggagtacccacctcacctatagcaggtctccccacctacgaggtcactttgcggaaacctgcaacagtaggagggttctctgccttcccccttccctctagattcttctctgggcaggggtcccagtgaattagaggatcctatcctcaatacatcccacccttaggcggtggcatggtgggggtaggttgcactgggggcagtgtgagggggtacagggggaggggtgtgtgggtgagtgggcctgcgtgtgggcccctgccgattcctctatgaatctgcacaggtctcctaagaagagaccaggccgaatgctggtgcacaccacacttgtctctaggcagcagtctttttcttgctgaaaggttaaaagcttggatggaaagcagccagttcaaacaggtatccatacattgttgacccatccagctgcagggattcgggccagatatttcttgtgatgggactggatgggagggactcttgtctgagaccttcagcgacctctctcactggagcccaggcactcattcgtgcccagaagtgggaggggtatttctgggtgaatttcacagttggctcttctggagagagagccacttggcatgtctgatagagcatgcatgcttactggaacgtggtggttcaccagttagttgttctggcatcttggtcattctgccaaagtgcatgggtagctcgctttcacctgggcctgtctgtgttgctgtgctgcgtgtgaaaggagagattttatgtggagtgttttaatttgtggttgggcaattgtgccttggtttgatacagagctctctggggtcctcaaggtaaactctggtgcttgctggatattcatcccagaaaatgaatgagatggtcgaggacaaattatgccggccctttagggtctccaggcagacataagaaagcctgacgtggtccatcatacaaagcccatgttgggatgcgaagccatgaccgtgttgctctaaaggttacatatgctacccatgctgctcagtgcctgggcagcagcttggaacacaatgctctctgaatattgcaactgttctctgtctttgcttgttacaagtctttcttgatgtgtaggctgcactgggaacaggcagagtttcacaggacagaaaatttaccccatgggtaatgattcccacaatcaggggtgcgtgaaccactctcacaagaggaacgtcaatctcgtgtatgggcctgcactctctgggcattccgtggagaagacccacatgaccatggaacaggcttcacccgatttcttttaattgtcaacaaatgcaggtccttttttcatatgtaggtagcatccaccacgggcgcacctctggccctgcctagggaaaacgcgagaataaaagaatgcaggaagatctggactgtgtctttaggggtggcattgtgactctgagtttcagaggttctcgtttttaacttttaacccccattatgtctcaactttttcctgtcttcatctgtgcttgcataggtcctcaggcacatccatgtatccccacccatgctcataagtgtctgcccagacaccttcattcacacctgtgtctggtcctctaggccgctctcagtgggcagtttttcaggtttccggttccctcttcatctttcttgtccctttctgtctgacttcccagtatttgttggcataatgttcaggatggggttggggtgggggcagcggggagcagggcagccccctggcctaacaggcctctgtgcggatgtggtggagatctgggattatgggactgactctttctcctggctgatggctccctctctgtgagcccacaggaggccacttgggctgccagctgcccacctggagcactctgcattccagttcactctcaacttcattgctcactctgattctttgtgtagttttggaggttttctcccttcacttttttcttctttactctttttacttttcattcacttttgtttggggaggtcaggatcagcctggaagtcagggtcaactgggctagggaacacccttagggaaaacaaacttatttttcctaaggaaattagaaggaccccagctgatccctgcaaggagtgattggcatttccctttcctttctgccctctctccatattgccatttgtggctgattatctcttttccctgatatatatttcctccccgtttttcatcttcctctctttttgggggtccttccctgccttggccttgtaggcttggggctcagtggttccttgcagtctgctgatgacatcctcagggcactgttcagcctacacctgtgtcttctgtagctcctgcaggactatttgtggatcaaagcttttgatcccactcaggaaagatctcattgacaagaagcttctcggttgtgtgtcctttaagtgggacatgaccggtggctccctgccactcgttgtgtatgtcatcacacattcaggtccccctgaactagatccttcaggagagctacagtgtcatggacctcccacttcctattctttttctccttctgtttcttcttccttttcctactcctgctcctcttctttattgttcttttcctcctttcctcctcctcctcctccaactccctctccttcttcttctttttctttccctcttcttctttcttcttcttcttcctcttcttccccttccctccttctccttcttcttcttcctcttcctcttcttctctccttctttccttttcctcctccttctccttcttcttttcttctttgacttctctttttgccttctttttctttctctccttcttttctatttctccttctacatctttttttctacttttcttctccttcttcttctacttgttcttctttctttcctttttttttcacttttggatttctgcatgcaaatgttctagcagattgcttcttcttctccttggtgatggggaatgtccttctgcagctctaggcctcaagaaatgcttcacttttcttcttaaaagaacagcgatgaaggtcaccagttcagtccttcttttccaccaaaaagctgtcctcgtgttacttttaagtgaaatgtcatggtaaacacaccctgtacctagtaccttatagcccaccattctttcctgttctccttgtggactctctaaatgtgtaaacctgagtcagtaggagcctcagcaatttgttacattgttcccctattgcctttccttccagtcaggccaggtgaacaaaacgatacggatttcagtgtgtacagtcaggctgtctctgccatgtgccaatttgcccactctcactcacacaagcaggaactcacagaccacagacacagaacacatgcacacactcacaagaaaccccacaaccagaaatgaaattacaaaacccatacacacatggagatacatgcagatgcagacacaaacacacatgcagacacacacacgcaggcacactgacacataaagtcacacatacacaaccagaccaataaacaggtaacctcacatgggcacaggggttggggctcaagcattctcacacttagaggtaaacaaacacacaaagccacaggcatgagactgcccacactgtctcatacgggctcttaatctctgacaagcaatgggctatgggcaagcattcctggcttcaggcctgggtcctcatgccattgattgggcaacttggctttctcccaaaaatgaatgcgggcaatcttttatcagaaaggccacagcagcagatgtgaaactggagcatcctgggtcaacccgcttaaaaacagactcccctttcagatagaggcagagagagtcctgttgggatccttagccctttgtgatgtcatgggaatctgtggcaacgtggtggcctttttgagtccccctaagccacatcctcccacccctgcctgtgtgaaagccaggacagcctgtgcagagtcagacttgcacgagttgctgagtgtgctttctaagggatacacctgcctcaggtcctgtggctccctgttgagcagtctgcccgttctggtgacctccatctgccagcccaaggcggtaaactacctagagcctttgggaggactcctagtcctgcagtaaaaccttgtgtaagccagctgagtgaccagcaccttgtcttggaacggcagccctttaatcccaagcctcttgtgtcccagtgcccatgattatctgtcatttgtcttttactttctgcaggagcaggagacatgaaacctggagaaggccaaagaagggcaaagactggctgcctaaacagtattcctgcagggtctccagcctactggtccttggtcattgggacctgtgagttttggtggtcaacctgggaccagttggctcgttcctttctctccctcctgtctttttctcgttctccttcctatttgcttttttcacattggaaaaggtggaggccctcagggtggaggagcagggttacaactgtacttggcgtttgtggagccatagtgccatcaagtggaaattgtttctggaaatgggaggcacctgagctcatgtgctgaggaacgctcgggagtgccagacagatggtggtgtggagcccccaggctgaagctgggagaggaactcctgtctggcccatggtctatgctcattcccaggatagcgccctggctccacagctctctttgtaagaatggacaggcaggggcggcccaccatgggttcccctggcagcccccagagactgcttggcatgagttgccccaccccagcatcccaaaacttctttgttcccagggaggatagggtgcccctgtccctgcgtggccccagccaagggcacccctgaactctccacaaaagagaccagagcaaatggccccagtctcggcagtcagtgaacagtggtttctcttaaacccatttcaagatggggaagctccgcccactgggctgactggtcttggggctgccagactgttctgtccccgggcctctagcttagctgcttcttcatggagttccaatggcaggtacacttccttaagggctctgaaccccagtgggggaaaccctggcttgggcctagtctacccagcctggcacatcctcgctgatatctgtgactggaagaaggcaagtgtccttgtagtctgttgtcaagaaacaccttccgccggatggcactgtgactccacaaatggcaatcaccccttttccttcctccactttgcctttctctccttccttttgctgccaaccaaacaaaacaaacacacacaaaaaaaacaaagaaacaaagaaactgcccaagcagcacccacctcatcttcaacagggctccccacctatgtggttactttggggaaacttgcaacagtaggagtgatgtctgcctctcctaccctctggattcttctctgggcagggggtcccagtaatccagaggagcctatcctcaagaaatgctatgcttttgctgtggatttgtagcaccgggggcagtgtgagggggtaaagggggaggggtgtgtgggtgtttaggcctgtgtgtgggccgctgcagattcttctatgaatctgcacaggtctcctcagaaggagactggtgcctgcctagggaaaacataggaagaaaagaatgcaggaagatctggactgtgtccttaggggtggcaaggtgactttgagtgtcagaaatcctcatttgtaatatttaactcccatctcatctaacttttttcctgtcttcatctgtgcttctatatgttctcaggcacatacatgcatccccaccaatactcactaaaaggtgtctgcccaggcacctgtgctcacactcagatccccacatctaggtaactctcaatgggaagggttcttcagcttcccggttttctcttattcatttttgttctccctttctgtctggcttcccagtatttgctggtggagtgtgtgggatggtgtgggggtgggggcagtgtggagcagcgcagtctcttggctccactggcctctgtgtggacccagtacaaaccctggcctaagggtctgatgcttttctctggtaggtgactcttcttgtacgaaggcacaagaggccatttgggcagccacctttccacctgggatatcctgcatttcagttcactctcaacctcattgctcaccctgattctttgtgtacttttggagtttttcttccttcacttttttcttcttcactctttacttttcatcaatttctggtttagggagttcaggatcagcctgcaaaagcagggtcgggtgggcacaggaatgtccttagggagagtaagcctacttttcctaaggaaatcagaaggacccgggctgaaccctgggggtgtaagcagcatccccctcccctatctgccttctgtcagtgttgccataggtggctcattacctcctttctctggtatccatttcctccccgttttacatctctcctcccacccatttccggggtacttccctacccaggccttgtagattagaagcccgtggccccttgcagtgcgctgatgacatctggagggcatggctcagcctgcacctctgtcctctgtagcttctctaggcctacttgtagatcaaagcccttgataccactcggaaaagaacccatcaacaagaagcttcttggtgttgtgtcctttcaccgggacatcacaggtttctctttgcctcttgttgtgtatgccaccatgcagtgaggcacccctgaactaggtccttcaggacagctgctgtggcgtgaagctgccacttcttgttcttattgtctttctggttcttcttcctcttcctcctcctcctcttttttctttttctttttcttctactccttctccttctccttctcatttttctcttctttcttctctttttcctttcacttttggctcttggcgggtcaagcattatactgagactgcttcttcctctgctcctggtgatgcaggatgcccctttgcagaacaaaagtgagaaaggcctcatttgttcttaaaggagcagatatgaaggtcaccagttcagtccctctggtgttccacaaaggcgccaatgtgttacttttcatgaaatgtcaccatgaacccaccccttaacctgttcctcatggctcaccattctttcccattctctttgtggatgctctaaatgtgtaatcctgagccagcaggagccttggcaagttgtccccctttgtcttttctttcaatccagccatgtgaacacaacgatccagatttcagtgtgtataggcaggctgtctctcccacgtgcccatttgcccactctcactcacacaggcaggcacccagagaccacagacacagacacaaccacatggactcacagggaaaccccgacaaccacaaatataatcacaaacacacatgcacagggagatacacacacagacacaaagacatacactaacacatgcacactcacaaactcatagacacacacacacacacacacacacacacacacacacacaaatcctcacacaggcccaggggtgcgggctcaagcattcacccacacagacgcacacacacatgtgtcgccatagccaccagactgcccacgaactctcccataaaggctctcagtcggccacaggcaatgggctatgggtgaggattcctggctccaggcctgggtcattatgctgttgattgggcacctaaggccttctcctgagaatgaatgcgggaagtctgttatcagataagccccagcagccagtgtgaaactggagcctcctgggtcaacctgcttaaaaagggaccacaccttgggtagaggcagacagtccccttgggacccttggccctctgtgatgccatgggaatctgtgttgcgtggtggccttccccagttcccctaagccaccctcatgtcacccctcccccccaccccatgtgaaagccaggacagcctgcacagagtcagacttcagtcagttgctgagtatcccctctgagggagattcctgccacacgccctgtgactgcctgttgagctgttcgctcattttggtgacctccatgtgccagcccaaggtggtaaactctatctggagctccaggctttgggagaaccaccagtcctgcagcaaaaccttgggtaattcagctgggtgaccagcaccttgtcctggggcggcagccccatgatcccagtcttcctgtggtttcccagtggccatgattatgtatcatttgtcttctatttttctgcatgagcatgagccatgaaacctggagagggccaaaggaaaagcaaaggctggcggcataaagaggatttccgcagtgtctcctgcctactggtcctaggtcgtagggtcccttaagtttggtggtcaacctgagaccaggtggctggctcctttttatcctccctgtcttttttttgtttctctttcccttttctttttttcacattggaaagggtggaggccgtcggattggaggggcagggttaagcttgtagttggcctttgtagagccatagtgccatcgagcggaatctgtttctggaaactggaggcagctgggcatgagtgctggagaaatcccaggagcacgaaagagatggtggcggtgtggggcccccaggctgaagctggacgagagaggaactcctggctggccctttgcccttgctcattaccaggatggcacccgggctccacagccctctccgaaaaaagggcaggaaggggcggccctccatgggttcccctggccatctccaggaattgccgggcaggagtcgtcccgcccacagcaccccacagctccttggttcactgggaggataggggacctctggccccagcgtgattccaggcaagggcaccccagaactccccacaaaagagaccagtgtaaacgaccccagtctcggccgtcagtagtcagtggcttcccttaagcccacctcaagatggctgccagggcacctccgcactctggactgactggtcttggggctgcctggctgctctgtccctgggcctctagattagctgcttctccgtggggtccaaatggcaggcacacttccttcaaaggtttaaaaccgcgatgggggaaactctggcttagtcagagtccacccagcccgacatattctcgctgaagtctgtgcctgtcagaaggcaagtatccctgcagccggtcgtgttcagaaacaactgccgctggatggcagtgtggctccagaaatggcagtcacttatttcccttgcttttctctttctccttttgcttccaacaaaacaaaacaaaacaaaaagaaaagaaagaaagaaagaaaccggccaaggagcgctcacctcatctacagcaggactccccacctacatggtctctttggggaaacctgcaacatgcgaaaggctctctgcctccctccttccctctggattcctctctgggcaggggtcccagtgagccagaggagcctatcctcaagaaatcccacccttggggctgtggcatggtggggataggtcgcactgggggcaatgtgaaggggtatgggggaggggtgtgtgagtgcatgggcctgcttgtaggccactgctgattacttctctgaatttgcacaagcctcctaaggagaccaggctgcctgcttgtgagcactacgcttgtaaatagggaacacactgtttcttggggaagggacaaaagcttggatcaaaagcacccaggtccaacaggcatccatagattgttgacccttctagcagaagaaggtcgggccaggtgtctgtcaggatgagactcgacagattggacacctgtcccaggccttcagctacttttctcactggagcccaggcactcatccatgcccaagagtaggaggggtattctgggtggcttccacaggcggctctcctagagaaagccacttggcatagctgatggagcatgtgtgctcactgaatgtgatggctcaccagttaattccccgggcatcttagtcattctgccaaatacatgggtagccaggccccagccatgctcactttcgcctgggcctcctctgtgttcctgtgctgggcatggaagtgaaggttgaggctggcgtgtctttgcagatggtgaggtggctgttccttggtttgataccgagcactctgggctcctcaagctgaattctattgcttgtcagattattcagcctggaaaatggatgagacagtggaggacaaattgtgccaccccttttgggtctccaggcagaaatgggaaagccatgcatgggtccttcatacagaacacttgttgagatgcaaagctgtggcctcattgctctaaaggttgcatgtcttacccatgcctctcagtgactggagagcagcatggaacacaaccatctcagaatattgcaaatgttttctttcttcgcttgttacaagtcttcctggatgtgtaggctgcactgggaacgtgcagagctttagaggagagaaaattcaccctacaggttatgattcccacactcagaggggtatgacctactctcacgaacgtcagtttcatgcatgggcttgcactctcagggcattccaggaagaagggcaacagtaccatggaacaggaatcactccctttctgtcacttgtcaacaaatgtggatccttttctcatgtgtagtaatcaccatgggggcacctccagtgcctgcataaggaaaatgcaagaagaaaggaatgcaggaagatctggacagagttcttcggggtggcattgggagtctgaatgtcagaggtcctcatttttaacatttaactcccatcacatctcacctttttcctgtctttatctgtgcttccatacatcctcaggcacatacatgtatcctcacccatagtcactcaaaagtgtaggcccaggcacctcccgtaaaacctggatcccattgtctagacaactctaactgggcagggttcctcagcttccaggttctcttttgttcatctttcttgtccctatctgtgtggctttccaatatttgctggcagaggatgcaggatggggtggtggtgggggcagtggggaccagggcagcctccaggcttgccaggcctctgtgccaatgtggtgcagacctgggactaaggggctgactctcttggctgatggctcttcctcctctgtgaggccacaggaggccacttgggctactacctgtctacttggtacactctgcattccaattcactctcatcctcattgctcactctaattctttgtgtacttttggagtttttctcccttcactttttttttattatacttaaagttctggggtacatgtgcagaacacgcaggtttgttacatagatatagacgtgccatggtggtttgctgaacccatcaactcgtcacctacattaggtatttctcttaatgctatccctcccctagctccccaccccatgacaggccccggtgtgtgatgttcccctccctgtgtccatgtgttctcattgttcaactcccacttatgagtgagaacatgtggtgtttggttttctgttcttctgttagtttgctgagaatgatggtatccagcttcatccatgtctctgcaaaggacatgaactcatccattttatggctgcatagtattccatgatgtatatgggccacattttctttatccatcttatcattgatgggcatttgggttggttccaagtctttgcttttgtgaacagtcccgcagtaaacatatgtgtgcatgtctctttagagtagaatgatttataatcctttgggtatgtacccagtaataagattgatgagtcaaatggtatttttagttctagatgcttgaagaattgccacactgtcttccagagtggttgaactaattgacactcccaccaacagtgtaaaagcattcttatttctccacatcctcttcagcatctgttattttctgactttttaatgatcaccattgtaacgggcatgaaatggtatctcattctggttttgatttgcatttctctaaagcccagtgatgatgagcttttttatatgttcattggctgcataaatgtcttctcttgagaagtctctgctcatatctttcgcccactttttgatggggttgtttttttcttgtaaattggtttaagttctttgtagattctggatattagccctttgtcagatgggtagattgcaaagagtttctcccattctgtaggttgccttttcactctgatgatagtttcttttgctgtacagaagctctttagtttaattatatcccatttgtctattttggcttttgttgccattgcttttggtgttttagtcatgaagtctttgcccacgcctgtattctgaatggtattgcctaggttttcttctaggttttttatggttttaggttttaggtttaagtctttaatccatcttgagttaatttttgtataaagtgtaaggaagggttccagtttcacctttctgcatatggctagccagttttcccagcaccatttattaaatagaaaatccttccccatggcttgttattgccaggttcatcaaatattaggtggctgtagatgtgtggtgttatttctgaggcctccattctgttccattggtttatatatctgttttggtaccagtatcatgctgttttggttactgtagccttgtagtgtagtttgaagttaggcagcgtgatgcttccagctttgttctctttgcttaggattgtcttggctatttgggctcttttttggttccatttgaactttaaagtagtttttttctaattctgtgaagagagtcaggggtagcttgatggggatagcattgaatctataaattaccctgggcagtatggccattttcatgatattgattcttcccatccatgagcatggaatgtccttccatttgtttgtgtcctcttttatttcattgagcagtagtttgtagttatccttaaagaggtccttcacatcccttataagttggattcctagggattttattctctttgtagtaattgtgaatgggagttcactcatgatttggctctgtgtttgtctgttcttggggtataggaatgcttgtgatgtttggacattgattttgtatcctgagactttgctgaagtagcttatcagcctaaggagattttgggctgagacgatggggttttctaaatatacaatcatgttatctgcaaacagagacaatttgacttcctctttttctaattgaataccctttatttctttctcttgcctgattgccctggccagaacttccaatactgtgttgaataggagtggtgagagagggcattcttgtcttgtgccagttttcaaagggagtacttccagttttttcccattcagtatgatattggctgtgggtttgtcatgaatagctcttattgttttgagatacattccatcaatacctagtttattgaaagtttttagcatgaaggctgttgtatttgtcggaggccttttctgcatctattgagataagtgtgtggttttttgtcattagttctgtttatgtgatggattaagtttattgatttgaatatgttgaaccagccttgcatcccagggatgaagccgacttgatcgtggtggataagctttttcaaatgctgcctaaaatcctctttctttgttgtgtctctgtcaggctttggtatcaggatgatgctggcctcataaaagttggggagttagggaggattccctctttttctattgtttggaatagtttcagaaggaatggtaccagctcctctttgtacctctggtagaattcgtctgtgaatccgtctggtcctggactcttttttggtcagtaggctattaattgctccctcaatttcagagcctgttattggtctattcagggattcaacttcttcctggttttgtcttgggagaaggtacatgtccaggaacttatccatttcttcaagattttctagtttatttgcatagaagtatttatagtattctctgatggtagtttgtatttctgtgggatcagtggtgatatcccctttatcattttttatcacatctatttgattcttctctcttttcttctttattaggctggctagaggtctatctattttgttgatcttttcaaaaaacgagctcctggattcattgatttttttgatgggtttttcttgtctctgtattcttcagttctgatttgatcctagttatttcttgccttctgctagattttgaatttgtttgcttctgcttctctatttcttttaaatgtgatattaggttgttgattttagatctctcctgctttctcttgtgggcatttagtgctataagtttccctctccacactgctttaaacgcatccctgagattctggtacgttgtgtctttgttctcattcattcaaggaacatatttatttctgcctttatttcgttatttacgcagtagtcattcagatgcaggctgttcagttttcatgtagctgtgcggttttgagtgagattcttaatcctgagttgtaatttgattgcactgtggtcttagagactgttataatttccgttcttttgcatttgctgaggagtgttttacttccaattatttggtcagttttagaataagtgcaatgtgctgctgagaagaatgtatattttgttgatttggggtggagagttctgtagatgtctattaggttcacttggtccagagctgagttcaagtcctggatatccttgttaattttctttctcgttgatctatctaatattgacagtggggtgttaaagtctcccactgtttttgtgtgggaatgtaagtctctttgtaggtctctaagaacttgctttatgaatctgtgtgctcctgtattgagtgcatatatattgaggatagttagctcttcttgttgcattgatttatttaccattatgtaatgtccttctttgtctcttttgatctttgttcatgtaaactctgttttatcagagactaggattgcaacccctgctttttttggctttccatttgcttggtaagtattcctccatctcttttgttgagcctgtgtgtgtctttgcatgtgggatgggtctcctgaatacagcacaccaatgggtcctaactctttatccaatttgccagtctgtgcttttaattggggcatttagcccatttacatttaaggttaatattgttatgtgtgcatttaatcctgtcgttatgatgctagctggtttttttgcctgttagttgatgcagtttcttcatcatgttgacagtctttacaatttagtatgtttttgcagtggctggtactggttgatccttccatgtttagtgcttccttcaggagctcttgtaaggcaggcctggtggtgacaaaacctctcagcatttgcttgtctgtaaaggattttatttctcctttgcctatgaaacttagtttggctgaatatgaaattctgggttgaagattcttttctttaagaatgttgaatattggcccccactcttttctggcttgtagggtttctcccgagagacctgctgttagtctgattggcttcccttgtaacccaacctttctctctgtctgcccttaatattttttccttcatttcaaccttggtgaatctgacaattatgtgtcttggggttgctcttctcgaggagtatgtttgtggtgttttctgtatttcctgaatttcaatgttggcctgccttgctagattggggaagttctcctggataatatcatgaagagtcttttccaacttggttccattctccctgtcactttcacgtacaccaatcaaatgtagttttggtctttccacatagtcccatatttcttggaggttttgctcatttcttgttactcttttttctctaatcttgtcttcttgctttattttattgagttgatcttcaatctctgatatcctttcttctgcttgatccattcagctattgatacctgtgtatgcttcacgaagttcttgtgctgtgtttttcagctccatcaggtcatttatcttcctctctaaactggttattctagttagcaattcatctaaccttttttcaaggttcttagcttccttgcattgggttagaacatgttcctttagcttggaggagtttgttattactcaccttttcaaggctacttctgttaatttttccaactcattctctgtccagttttgttcctttgctggtgaggagttatgatcctttggaggagaaaaagtgttcggtttttggaattttcaacctttttgtgctggtttctccccatcttcatggatttatctacctttggtctttgaagttggtgaccatcagctgaggtctctgattggatgttctttctgttgatgttgatactattcctttctgtttgttagtttttcttctaacagtctggctcctctgctgcaggtctgctggagttttgctggaggtccactccagaccctgtttgcctgggtatcactagcggaggctgcagaccagcaaagattgctgcctgttctttcctctggaacctttgtcccagagagacacctgccagatgccagccagagctcttctgtatgaggtatctgtcagttcctactgggaggtgtctcccagtcaggatacatgagtgtcagggattcacttgaggaggcagtctgtcccttatcagagctcaaacgctgtggtgggagatctgctgctctattcagaggtaccaggcagggacgtttaaatctgctgaagctgcacccccaactgttccttcccccaggtgctctgtcacaaggaggtgggggttttatctataagtccctgactggaactgctgcctttttttcagagatgccctgtgcagagaggaggggatctggagaggcaggttggccacagtggccttgctgagctgcggtgggctccacccagttcgaactttccagcagctttgtttacactgtaagggtaaaactgcctacttaagcctcagcaatggcatatgccactccccccaccaagctccagggtcccaggtcaagctcagagtggtgtgctagcagcaagaatttcaagccagtagatcttagcttgctgggctccatggggttgggacccgccgagccagaccggttggccccctggcttcagcctcctttccaagggagtgaatggttttgtctggctggacttctgagtgccactgaggcatgaaaaaaaaacaacttttgtggctagcttggtgtctgcccaaacggccacccagttttgtgctagaaacccagggccctggtggcatgggcactggagtgaatctcctggtctgcgggttgtgaagaccatgggaaaagtgcagtgtctgtgctggagtgcatggtatagtccctaatggcttcccttggctaggagagggagttccctgacaccttgcactttcttggtgaggtgacacccctaccctgctttggctgaccctccttgggctgcacccactatccaaccagtcccagtgagatgaacctggtacctcagtttgaaatgcagaaatcacccatcttctgcatcgatctcgctgggagctgcagactggaactgctcctattccaccatcttgccagcttcccacttttttttatcttcactgtctttacttttagtccacttgtggtttggggagggtcgggtgggcacaggcacatcattagggagaacatgcttacttttcctaagaaaattagatggatcctggctgacccctgaagtgcataatcagaatccccctcctctttctgccctccctattgccataggtggctgattacctctttttcttggtgtccggtttctccccatttttcatctctcctcccatttccagagtccttccctcccttggccttatgtactagggacttgatggccccttgaagtgtgctgatgatattcagagggcaagattttgcctgtacctttgttctcttttgctcctgcaaggctacttgtggatcagagcccttgatcccactcagaaaggaccccatcaatgagaagcttttcagtggtgtgtcctttcacccggacgtcactcatatctctttgtcacttgttgtgtatgtcaccacgcagtgatacacccctgaactagatctttcaggacagctttggtgacacgaagctgccacttgttgttgttctttttctcctctttctttcttcttcttcttcctttttcctttcactttcagctctctgcgggacaaatgttctatcgagactgcttcttctgctcattggtgatgggtgtgtccccttgcagcaccaggcctggaaggaggcttcactttcatttttaaagaagcagagatgaaagtcaccagttcagtttctctggtgaacaatgagaacacttggacacagggtggggaacatcacacaccggggcctgtcttgctgtgaggggagggggagggatagcattagagatatacctaatgtgaatgatgagttaatgggtgcagaacaccaacatggcacatgtatacatatgtaacaaacctgcacattgtgcacatgtaccctagaacttaaagtatatatataaaacaccacccaggagttacttttaagtgaaatgtcatcgtgaattcatggatttcccagtacctcttggctcgctgtttgtccccattctttttgtggactctgtaaatgtccaatcctgagccagtgggagccttggcaagttgtgtcctgttgcctttctttccagcccagccatgtgaacacaacagcgatccacatttcagtgtgtacaggcaggctgtctctgccacgtgcccattttcccactctcactcacacaggcagatgcccacagaccacagacacacccacacacgcactcagaagggactccacaccccaaaacataatcacaaacacacaagcagagaaacacacaagaaacttgacacgggcacaagggtgtgggcccaagtgttcccccacacagacatgtacgcacatgcacccccacaggcataacactgcccacaaactctcccatacaggctctgaatcaccacttgcgatgggcatgcttttttgtctccaggcctgggtcatcatgccattgattgggtaacttgggcgttcctttgagaatgaatgcaggaagtctgttatcagataggccccagcagttggtgtgaaactggagctttcttggtcaaactgcttaaaaacttacactcggaaaggatcccatcatcacaaagcttcttggttgtgtgttttttcacggggatgtcactggtgtctctttgccactcccgttcattgtcattgcttcttctcagtctgattcttttgtctttttttttgtttttcattttttattttcactgctttacattatttttaacataattggtatcagtttcagtttttttcttttgtgtttttcaatttgttcttttacttttttatttagtactttcagattgtaattgatttttgcattttctttctatcaatttttctggaccgaaggtagtcattttaggtggtgaatttttcttcttcccagtggtggattcatagtgatatcttatcttcttttaatttcatggtttttgagtctttttttattgagttgtttttgagtggttattgaatggctttattgaatgttatatgaaatattttttctccatttattttactctgtaacttttttttttcgtggcttatcagggcatttaagaaacagttttattaaagttgattatatatcaattagggattattaagtcattattttaagaagatcatttctcttttgcatcatatgttttaattttcttttgcttattgtttaagtgacccaagttatgaaccacatttttttttttttttctgagagggagtctcgctctgttgtctaggctggtgtgcagtggtgtgaccttgactcattgcaacctccacctcccaggttcaaccgattcttctgcctcaggctcctgagcagctaggactacaggtgcatgccaccatgcccagctgattttttggtacttttagtagagatggtgtttcaccatgttggcccggatggcctccatctcttgacctcgtgatctgctcacctcggcctcccaaagtgctgggattacagacctgagccaccatacctggtgaaccacatcttctcttccgctgttcaccttagactcttgatcatattttggggtatttctttttttttttaatttgatcaaatgtgatagtaagaaatgtcatattttatgtgtcattaatagctaatagagaatatatttttggaatatatatttaacctttacttcattctataatgctttttacatttctgtcatatcttatacacaatttttactacactgagaaatttattcttaaagtagtgataaatcaactcattttaatataaattcatgattttatagactatatgacttggcttaaatagatctttctgagaaatcaggaaaatttgaaagccatcaataaattatttactctttgataatgaaaatattttaataaaaatgctaaaaacacttaattttaaaccaaaatacagtatagtatctggtaaagagatttaaacctatgttgcaaagatgattaaaatgattcatacgcaatgaccctttatagagattcatttaaattaaaatttatttttctacatcaaaatgaggagatcatcatgactaagaaattttggattactaaattcttaaaaaattgtccacttttaaaattctattaaggtacaataaatcaaacatatactatgttttctttatcatttatagaaatttaaagtatgataacaggtatttcttgttgaggtgattagcttgtctctcatacattggtgtttggagaattgtttactgaaacatttgaaatggtaatccacaaattgtttaacttttttattataccatctgagaatatgtttgcatatttgtgaaaacaattggaaactgtctcagttatgttcattttgagaattactatgttttggtggacacatttgctggaattttgtgcagatatttttaaaatatttaagtttatgtggttactatgagatattattaaataaataaaacatgttcggagtaatgtgtataatacaaactcattttttgtaacaacaaacagaaagagttacatgttggtaagtatatgtgtctttgattggttatggaaaaaattattaggcatttattccatacttttaacatcttttaacctccacagatttagaattgtttttctggaagaaattgttaatcttctcttttatacatttcatgttgttttcctcattttaatgccttcgtattatatttctaaatataattttcttttataaaacatgcaaattttatacgaagaaaaacagcataagtaaacttaaagactatttatatacaatgtggttccatttaaaagatagataatggatgccattaattcatagaatatataatacatttctttatgttaatacagaaacaaagcctgatagaaatatagtcaaagaacaggcaattcataggagacaaaaatatatggccaataataataataaatatagttgactttaatattaggtcatcatatttgccacaatcaaaaaagtctccagaattctcagttttagaaaggatttggttaaatatctactgtctataaaattgtacgtttctaaagtattttatctctatcgtaattttaatgtttgtaagttttgacttgtgttttatttgtagaatatatggaaataattctacatatcaataaattggcttgcttgtagtaaaaatgttgcaagcatattaaatatctttcaacagaatttgaacatctttcaacagttaaaattatactgtaacacgatgcaatattttgaagccattgaaatattgagactgatctatttttatattaaaaattattaagacatttataagtgaataaaaacaaattgccgaagtgtatgctaggatgatctaatttatattataaactccaaatctaaattattatattattataaatactatatatgtgtacatttaaatagaaataaaaaggtctagacagaattgataactatgttttcttctgtaaataggagaaagactgaggaatggtaaaagtttagcagtaagaagaattatgtctatgttgtttgaattatatacagttagattgtattcatgtatttattcatgtattatttgtgtaaataaataaataaatataaaatttccaaggaatataggagtttgtcaaggggctatgagggaacaatgaggctgattgattagttttggaagcctaataaaacaagagtaatagcggtagacatccctgtactttttgggggagaaatatgcctaagataatagaaacatctggtccacctaacagataaattattttgcattcaaatacattagataccaaaaagatgcaggttattgacattgtatgcctttgatttaatatttattaagcactcatctaataattttgcattctctttaacttgcttaatagggaaattggggtgttttctgctcaacagacatatctgacctgtatgataatggaatttctcattataagtcaataaacttttgttctttctgtatctttcagtcttatgatgtaatcagcgcgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaagcgctgtgttagatctatatgactacatctagtaaattgtgaattttaagtaaat

SEQ ID NO: 4635 - DNA, 88003 bp, human
ctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccaggtcagattctttctcatctaggacatctaggctctttgaaacttatttatgcattctcacaaatttccttccccttttccctgttctttccatgatttcaaaatagaaaaaataacatgcagggattaagcagctctttcacaaaatatgcttgaatgaaatgatggatatttaacgacattaaataattatttgtaatattttagatgaaataattgtagttatattttctaagaaatagacttgaatcttttgatttgcttgaaagtaagtcattggtgccaaggtggagggaaagtgtaataaaaatgctcatgagttgataatttaaagctgggtgatgtatatgtagggatttattatattattctctctacttttgcgtgcattggaaaatttttttgttaaaaaaaaaaaggctggttcaaggccaataaaaagcatctgttgaaggccagccttcagaagtgtatgtctttctctgtgtaaggcaggagagttgaatttttttttttaaagctacaatgtgatagtcaaatccaagtgccataatgtttgcttgttcaaggtattcaggaagggtggaggatggaccaagtcactgcctggtagtaatcatgagccatcaaaaaggaggagtaggggggcggacgcggtggctcacgcctattatcctagcactttgggatgccgaggtgagcagatcaggtcaggagttcgagaccagcgtggccaacacggtgaaaccccgtctctactaaagttacaaaaattagccaggcgtgatggtggacgcctgtaatctcagcaactcgggaggctaaggcaggacaatcatttgaacctggaaggcagaggttgcagtgagccgagatcgcgccattgctctccagcctgggcgacaatagcaaaaaactacgtctcaaaaaaaaaaaaaaaaaaaaaaaaaaaaaaaaaggaaggaggaactttgggtgggccttaaaggttgagtgacatctgccatgtggaggggcagggaatgcttttcaggccgagggtttccagagaaaaggcagaattcttctggaaacagcttggctataattttgaatctacaagaaggactaggaggtgaagataaagtgcttcagggccttaaatgttatgctgagcatatacttcattccaatatccatcaagtgctactatttgtattttaagattcctattcttactatcagaaaaggaatctctgatatttagatgaactttatagaatgcaaattataaaactgaatctgacccaagttttatagatccttttaattcaaaggagagaagcatcttttcttcattcgtgcagtaaacctttatgaagcccttgcaatgggtaggaattattctgagagctgtaggggatggatggccaaggcatagtgcctagtacataataggagtgaaacagatatttcaataaataaatcaatgaatgatgggacaactttggcgaccaaaaaagttttagacattgggtttggtggtaatgcatagaaaaaaaaaaatagaaatctattttacttgaaagcatctccctgtcattccatacagttttacttctcacatgtttacctctattcaaaggggtagtggagtggaaggttgcagggagtagggagaaaattgctcagatagaaaacaaaagagcagccgggcgcagtggctcacgcctgtaatcccagcactttgtgccgctgaggtgggcagatcacctaaggtcaggagttcgagaccagcctggccaatatggcgaaaccccatctctactaaaagtaaaaaaaaaaaaaaaaaaaatagccggtcatggtgttgtgtgcctataatcccagctactcgggacgctgaattaggagaatcgcttgaatccaggaggcagagattgcagtgagccgagatcatgccactgcactccagcctgggcgacagaccgggactcggtgtaaaaaataaataaataaataattttaaaaaataaaaaggaaaaagaaaagaaaacaaaagaacaaaacaataagtgcagtagctacataatttcccctccaagtgattcaaatcactgataattgtaataatagccaatatttactgaagatttatgtgccaattttctaaagggctttgcatgttataatttatttaatcacaactctactagagaagtttgtatagaccaagggaagttgtatgacttgccacaagttacacagcaagaagtagctgagctgagctttgaacccagaacacctgattccagagtttatgctctaaacttctatataatacatcccttctaatactatgtatacaactgttttataggaataaatcattgaaatagaggtatgggaaggataatgatttgaggagaccaagggacaaagagatggacaaaaacagaaaaaatgatgccacaatattttttactatttttcagtctttgagtgattgcagtatgactccatttccctggtgcattcatataatagttcacctggtgaaaacaatgaagattatttacaatgctaccctgctttttctggtgtcctgaacctggaagttgtgctttttaaggtaatctctttaccaaaaattattaagaggaggaagagaaaaaaaagagttggttttgacacattaaaaagtagccaaacaaaactcaaaaagatagcagcaaatgataaaattgaaactatattctacattatatgaaaacatattcataataatagtgtaatctgaagaaatgttttgttagattcacttgtacttatagtttctattattactgtgaaatatatcatctttttaactacattttctaattgtttctagtaaatgggaacatgattgatatttttgtatatttattttatatgctggagccttcttaaattctgtttattctaataatgtatagattttcttggattatctgttaattaattatattttgaataatgacagtttctttacaatatttctttaccttatattactgtgctagctaggatcttcagtacaaagaggaacaacagcattggtagaggatttccttattttgttcctaaattctacaaaagtttcaccttttttagtagattgtctttctcaagttaaggaactttcttaatgttcctagtttgctgagaggttttattacaaatattatgaagttttttcccgtctatatgtactgccactttcatatcctttcttcaccattaatatcacagtgtgaccatgtgataaattacaataatcaattttctaatgtatttcttgcttttgctttcatcgagcctcgtcattggatatttggttcctattttaatcattttgacttttatttttatattgaactttcttctactttccttttattgttctttttctaatttattgagttgaatctttagcatcttaattttcaatgttcttctgtaaaataagaatttagaactataaattttcttctaccactttagaaatatttcacagacttttatatatagtatttttatcattcaatatttattatttttaaatttctcttatgatttttttgacccatggtttgttttttttcaatttctaatcatatgggattccttttttaaaaaatatattatgaaatcattacattattcccattctagtttaactttatcttatttttcttttttaattttttttacatctatagactttattagatgttctttatacagtcatctggtatgtataaagagtgaacaatcatataaaaggaaatatggtcataactgattgaattaataaaatcctgaaactaaataactcataattcattgcacaacatatattaggtttcattagatcagtatatagcttagtagtaaactctcctgatggccataaacctctaaggtgttgtcatcctgaaaaatgaaggaggggagggagctggtggggtgcagaatggagaaaccttccatagtgctggtgtgatgtaccctaagttgtaaagttatagggcatcgccacctagtggcagaatttcatgccttgttctaattaagggactttccttgttttccaaagagcaatgtgtcttgttcactttctaaccatccctctctgatgctgtccttcctaaaatccatgcctcctcccatacagtgtaaacccatctgcttttcatccatcaagctgtcaaggatttggttatgacaatttttatgttcacctaactttttagttccaagtacttcggttattttcaaagctacacacaggatgcccatatttttataactccatcttatttgtgaaggattattactttgtgctttggcctagtttttattcttactgctgaatcttttcataagttaaagttattgcagagttaatgctttaaaaggcagtccttagagtaaatagctaaatgaaatcattaccaaaatgtacactttggatttattaagattctagaatttaaaaacaggaaaaggtgccattagtgaaaattccatcactaacattttggtaccactcgtagagcatcacataaatattcagaccgtgataactcagtgcaggaatgttatcaaatatgtccatgcaatctggaactaggaccagagttggcaattgggggtctgaaggcccaacatcccttacactgcttcctacaccttgacaacaggaaggctgagtgatactaggtagtgcactacaacagtgaacataagccagccatctgttttttgcaaagtataataaaatagaaaaacagaacatagaccacttcagagcaaacaaacatatccttcttcaagatgtaggaaaaccatatattcaaaaccaatctcaaactttaaacaataaaagatatcaaacattttaaactgtacaaagcaaattagcaagattttaatgttggcagttttaaaatgtcacccatccaaaacacaaaacagggagataaccaagtcttagctccatcctaatcaaagctgtcatgcagatccagttccactcttctcatctccagcaggtacttcactcaaggaggtaacacccaaggggagtagatggaccaaaaacaagagtgccacatagaaggaagagaggggaccttggactttagctactggttagctattcaactttgatgatattcagtgttttcccaagttattttttctcgcttctcatcacataatttacattatgcatactatgtgccagagactgtttgacatgtagtcagttaattttcacaactgtgtaaagttggtttctatcattagctctatcttagggccaaagaaactgaagcacggagaggttaaattgtattcctaaagcactacacagtgagcaaatagattcagacctgtgcagtctaacccagaattagctctgaatcactctaccattctgtctacaggacaacaagcctgtgtgtttcaggtactttcatggtgatttttcacacaggacagcttttgataatagaaaggccctctctttcaaatgaaaggacttcactgatggattaacaaattctcaccttttcacctatgtgagccaaatactagatctactttcttagtcttcataacaagcaggacgataaccataatttataatgaacacaaaacattgatatagtgttcaaagaacttttgcacacttggtctcgtttggaagaatgaagtaatctggaaacatagaataggcatacactgtgactttaggaagaactctcacaaaatcagaggttgccctatgtaatatcacactttttaccttgagcaggtggatagcctgggagttcttgttatacctcaatcttggtccattctatttgttcccctgtccttcagcagtgcccttaggcttgctttaaacattaacagcattcataagcatggtttctagggtcagagcccagcctccctccacccacccggctccctacacaccttgacagtgctctttgagatgcctcagttctagtctccttgtaattgtgcacagtagatgtctgaacaaatagaccagagtcctgcaaaagtgatcttgaaatcacaattaaaagagactttggagagatctactcaggaaaattttctgaatagacaaatgcttttaaagggggttctagacagtccgtcttttctgcctccttctgcgaagtagggctacactaaaaccttgtcacaatgtgacctgagcaaaaccattatcaagtgatttagttgtcttgaaccagacaaaagaaaattgacatgatttcaagataggtttagaaaaataatctgactagcaaaaaaaaaaaaaaaaatggggggtggttcctagggaatatgagacttgatattttagcaaaaatttaaatatgctctttatgatacacacatttctcgttgctttacaaattttaaatgtaacacaaatttgtttttcacactgttttgttagttgaggtaaggcattcctgccgcacgcagcaatgactcgtcctggaaaaccagggaggctgcatatcctactgttccttctctactagctgtggctccacactctcacctccaccaaagaaagcatttcagaatttaggggtggaaatgatgacaacattgaataattctatttttttcttttttttgagacagagccactgtcgctcaggctgaagtgcagtggcgcaatctaggcccactgcagcctccgccccccggggtcaagcaattctcctgccgcagcctcccaaacagctgggaccaccggtgcccgccaccatgcccggccaattttccgcatccctagtagagacggggtttcaccatgttggtcaggctgatctcaaattcctgacctcaggagatctgcctgcctcggcctcccaaagtgctgggaccacaggcgtgagccaccacgcccggccaatgattctaatttatatttttaaaaattaccttataatcttaaaacttttaactgatgagtatccaacccttaaactttataacaatcatttccaaagtggaaaagtcactgggatatggggaaaagtatgatttgtttttgtacttctatttttctaatgtctactttttgttttctagtctacatgttagcacaggagtatatatattacttaagtatacctatgttggagtgcatacagaatttctttttaaatgataggatgcaaaatcaaatctatttggatagcagtgaagaggctgtttttcaatcctggcaaactagggggtgcatacccccttttttatttagtagcttccataaggctataactcatggaagttacatccttacataaactgatgggctatccaaccagtgaggaaaactgataaagtggcctctgagctccaggaagtagttaaacactactaaaaacatcttgaaaatttggaaaaaaatttaacagtaaatggattcagtagttattcagtataaggtttggaataactccagccattacaatagacatttatttaaagtaaaacatctgcagaccaaataattcttaaaattgtttgtttcaagtttaaccatcttcataacagctgcatccacagacttcaactacatgattacttctttgcccattcttctctttcttttctttcccgaataacctcttgcacatacagttcaaggtagaaattttcctcttcatatttggtccactgctctttaggcaagatctgatgcttcatggtcaggtccaatgcactcttaatgtgacacatcctgtcattataaaggttctcaggaagccttcttatggcttcttttatgtcttcatcctcatatattgtatcatctctcattaaccccagtttattgaatcctgcagtattgtaataccattttcgaataccatccagccacttgcctgatgctgaaatggcctgcttgccagccattttgacctgctttaattttttttaatccttcttataacaagatacaaaaattatacactggctgctcatcccaacagaatttggcaatataaaacattttctttcattaaatacatagaaaaagtgtggttattgatatttattgatgtagttattattgaattttatatttgtgtttttaaaatttttatttttatttaatttcacacttgaaaaaccaggaatattacaaagaactcccagaatgtcctttacccagattcaccaattaacattttatcacgtttgccttatcattctgtttttctcttcctctcctccttctcctatttgacagtagtttgcaaatatcattctcctttacctcttaatatgtcagtgtgtatttcctcagaatgatgatttcctcttatacatcctcagtaaatgtgtcacaatcaagaaatttgacattgtttcaatatcataatctacgccatattccaatgttatcagttgtcccaataatgtcttttgtggttattttctttccttggtcaaagtgctaatccaagatgatgcattacatttacttgtcatgtctcttcagtttttaatatggaacaattccttgacctttctttgtcttttatgtttatagaaaaacaaacttagtttctctcattatattctcacaaccccacttctgacactgattgtgtggaaaaaaagtttttctttggctcttgtaccacagcaaccaacacagaaagcttgtgaacaaatgtattgggattttttctcaccgacaggcaagtaaacaattctgcagtggacaccagctgggtgttctccaatccaattcaattctgaagctatctccctacagaaagtatcagatcccacagattgagggcttagtcccacgagactgcctcaactttagacatcagtttcaaatctgggcctctggaacttttaactgaccagcttcaagttagggttcccgcaacctctctctttaggctcaaataatttgctagaacaacacacagaactcagggaaacacttacttacatttacccattaacagccagatgaagagatacatagagtgaggtctggaaggctactgagcacaggagcttccattcctgtggagttagggtgtgccaccctcctggcatgtggatgagttatttgtcacctttctgaaatcctccacaaattcagctgtactttgtcctcttgtgctttttatgaagactttatctgataggcactaatgaagcatgaacaaccatgtagaaatgtgactggactaaagggtatgatctaataccaatagacttggtggagaaacccagcaaggcttgtctgttcagattcttcttggtttctctgtgcagcattccttcctcctgggtatggggcaggactctttctgaaatgggagtcttatgacccacagtcaaactaggtaggtcagagaatttctttacgaccagctccaagccagaaagctgggtgaagattagagtatatttttagtttctatggcttgcctttgggagaaaaaaaaagcaggtaaaaggagggcaggagaaagtcagagagagattctgttttgtgaagcctaaagtgccccaacattatacatatatatgtgtgtttgtgtgtgtatatatatatatatatatatatatgtatgtatatatatatatttttatatatatatatatagagagagagagagagagagaaactgtctctcacttttatttctctgaagctgtttcaaagctgcttcaggaaccaaagacaaaagaccaaatactttaacaagagatatgcttatttctttagtcacttaggaaataacaagagatttgggagttataagccaggaaccatggacaaaaaccaatatatatatatcacaatatcacacatcgacaattgacacttgggtaaatacaggacacttatttcatagattgtcctttaatttaaatttgtgtgccatttccccattattcagagtacgcatattagcaaaagcaccacagaagtaatgtattgttctcagggcatcataatggtggtacatgatgctggtttgaccctttagtagtaaagttaactttgattacttggttaatgtggtgaatagttgctagattaatccactttacagttatcattttcctctttataattaatgattttgctggggatactttgagactatgtaaatatcctgttcctcattaaattatcatccactggttttcaaatccattgataattcttgactgaatcagatattgctatgatgaatgcaaaatggtaattttcaaactccatcatttttagtacatttattagtttatattctacatcaaggtagagctttttctccatttatttgtttattaattactttggacacatagatttttactttattttaaaaataccctattgttattatttattttaatacccaaattgtctcagatttagtgactggctgcccattcaagttggctcccctgtcttttgacatgtgtcatcattcttaaacacactttttacttactttaaaatttttttacttccttactttcaagcttgtcttgtacttcctaccccattaatcatttctctatagacctctgttatcttttatggagacagtatttagaaactaagtcattgtatatagctgttttttagcttaacattttgtcattgttttccatttaaaagacaatattgcttatgtgataatgattatttagtgtttgttgaaacttgctttatgtcctagagaacatgatcaactagtgttttatgtgtgcctggaaagattgtgtatctaatttttgcgtgtagtgttctgttcattaaatttaactgtgttgtttaaatcttctctattcctaagttttttgtttgctggacctatcagttaccaagagagttaaaatctcccactgtatttgtgtatttgtcaaattcttacacttttgacaatttttgctttgtatacttgaggcattgttagtatgtacatacaagtctagaatagatacatattttacaattttaggaactctttttatctttttgaatgtaaattttttttgtttgctgggtctttttaattttgtaaaatctttctgggtacctagtagttgtatacatttatggggtatatgagatgttttgatacatgcaaagtgtaataatcacatcatgtacaatggggtatccatcatttcaagcatttatcctttgtgttacagacaatttaattatacagttatattattattgactatagtcaccctgctgtcctatcaaataataggtcttattcattctttttgtatacccgttaaccatccccactctcccccaccacccattacccttcccagcctctggtaaccatctttctactctccatctccatgagttcaattgttttgatttttagattccacaaataagtgagaacatgtgatgtttgtctttctgtgcctggcccatttcacttaacataatgatatccagttccatccatgctgttgtaaataactagatctcattcttttttatgactgattagtactccactatgtatatataccacattttcttcgttcatgtatctgttgatgaacccttaggttgcttctaaatcttagctgttgtaagcagtgctgcaacaaacatgggagtgcagatatctctttgataatactgatttcctttgtttggggtatatacccagcagtgggattgctgggtcatatggtagctcaatttttagttttttgaggaatcttcaaatcgttctccattgtggttgtactaatttacattcccatcaacagtgtacaagcattccctcttctccgcattcttgccagcatttgttattgcctgtcacttggatataagccattttaattgaagtgagataatatcccattgtagttttgatttgcatttccctgatgatcaactacaatgagtactttttcacatgcctgtttgccatttgtatatcttcttttgagaaaggtctattcaaatctttgtcacaattttgatcaaattattagattttttcctattgagttgtttgagctccttatatattttggttattaatttcttgtcaaaagtgtagtttgcaaatattttctcccattgcacctatactttatagactgtttgctttgctgtgcagaagctttttacttgatgtgatcccatttgttcatatttgctttgattgcctttgcttgtggggtattaattaagaaatttttgcccagatcaatgtcctggagatttttcccatattttcttgttgtagtttcatagtttgaggtctttgacttaagtctttaatacattttgatttgatttttgtgtatggcaaaagatagctatctagtttcattcttctgcatatggatatccagttttcccagcaccaattattgaagagactgtcttttccatagtgtatgttcttggcacctttgtggaaaatgagtttgttaggtgtgtggatttgtttctgggttctcagttatctttcattggtctatgtgtctgtttttgtgacaataccatgctgttttgattactgtagttctgtagtataatttgaagtcaggtaatatgattcctccagttttgttctttttgcttaggatagctttggttattctgggtcttttgtggctccatataaattttaggattgttttttctatttctgtgaagaatgttttttgtatttttataagtattgcattgaacctgtagattgctttttgtggcatggacgttttaacaatattgattctttcaattcatgaacatggactatctttccattttttggtgtcctcttcaatttctttcatcagtgttctacagtttttattaaagagatctcccacttctttggttgagttaattgctaggtatttaattttatgtttggccattgtaagtggaattacttttaaatttctttttcagattgcccaatgttggcatgtggaaatgctactgattttcgtatgttgattttgtatcctgcaactttactgaatttatcagttcttatagtttttgtggaatctttatgcttttccaaacacaagatcaaatcctctgcaaacaacggtaatttgacttcttcctttccaatttggatgcccttaatttctttctcttgtctgattgctctaactaggacttgcagtactatgttgaataacagtggtgacaatgggcgtccttgtcatgtttcagatcttagaggaaaagctttcagtttttccctatttggtatgatactagctgtgggtctgttatatatgggttttattatgttgaggtatgttccttctatacccatttttgaaggtttttatcatgacggcatgttgaactttatccaatgctttttcagcatcaagtgaaatgaccatatggtttttgtcctccattgtgttgatactatgtatcaccactgttgaaccatccttccatcccagggataaatcccacttggtcatgatgaataatctttttaatgtattgttgaatttgatttgctagtagtgtgttgaagatgtttgcatcaatatttatcagagatattggcctgtttttttttaatttgtttctgtctgattttggtatcaggcctcatggaattagtttggaagtatcccttcctcctgtatttttcagaatagttcaggtaggattgatattagttcttctttaaatatttggtagaattcagcagtgatgccatcaggtcccaggcttttctttactgggagactttttattatggctttttattggtcttttcaggttttggattatcttcatggttcagtcttgatatgtcatatgtgtagaggagtttctctatttagtctagattttccactttattggcatatagttgctcatagttgccattaatgatcctttgaatttctgcagtatcagttgtaatgtgtcctttttcatctctggttttatttatttggatcttccctctttttttcttagtctgggtaaaggtttgccaaatttgtttcacatttcaaaacaccaactttttatttcatttacttatttattttgtattgttttcttcattccaatttcatttatttcggctctggtgtttattatttcttttcttcctctaattttgagtttagttttctcttgcttttctagttctttaagattcattattggtttctttattttaagttttactttttttttatttaggcactaaataactaaacttatatataactaaactttatagctataaacttccctcttagtactgcttttgctttatcccgtaggtttttgtatgttgtgtttccattatcatttgtttcaagaaatttttcaattttcttcttggtttcttcattgacccactgcttattcaggaacatactgtttaatttccaggtatttgtatagtttccaaaattcttcttgttattgatttctatttttattccattgtggtcaaagatgcttcatattatttcaatttttttgaatgttttaagacttgtattgtgacctaacatatggtcatgtgacctaacatggtggctttagagaatgatccatgtgctgaggaaaagaatgtatattctgcagccgttggatgaaatgttctgtaaatatctgttaggtccatttggtctacagtacagattaagtgtgatgtttctttgttgattttctgttcggaagacctgtccaatgtttccttgctgttaacatagctactccacctttccttttttggtggtatttctttttccattgttttactcattcacttttttctttcttttatcttttacaaaatgttctgccaaaaaatcaatgcattgatttgtttgtttctgaatttaccaatagaatttataattagtattaaggataagctttatatatccaaacattatctttctttactaattttttattttatagaatttaaactctacagaaaagtcaaaagatatctttcatgtattgtagtgccattcttttccaagggagatacattccaaaatccccagtggatgcctggtaacatgaagagtaattaatcctatataaactatgtttttttcctatacatacatatgtatgataaagttaaatttataagttaggcacaatacaagattaacaacaacagtaataaaatagaacaattattacaatattcatagtttcatggatagaagactcattcttaccataggtcttagcaacttcaacacatgatttttttcttcccttattaagttgaaaacttcctccttttcacttaaaggaagcattttacagcttctctttagcatatgtgaactgccagcattatcattcttgcactttggggttactattaagtaaaataaggattacgtgaacataagcactgtgatactgcaacagtttattggataaccaagatggctagcaagtgactgatgggcgggtaaggaatacagcgttgatgtgctggacaaagggatgattcacatctggagcaaacatgagatttcatcacactactcacagtggtgtgaaatttaaaacttatgagtcgtttatggaattttccatttactgttttcagactgcagttaatcatgggtaactgaaactgtggatgaggggggaccactttagattcatcagggcatcaatttggctacatatggcttatctctttttctaaatactatatacatatatgtatatatacatacacagatttttttgctgagccattgggaagtaacttgcagatatcatgacacttcaaccctaaacactaaatcatatatctcttaagaacaattaaattactattacacccagagaaatttaacattgatacaatactattatctaatatactatccatatcaagttctcacaattttcctaacaatatcctttatagctttttatttgttttggtccaggatccagtcaggggtcatgcattgtatttagttgtcatgctcctttttagtctttttaaatctagaatagcaccctccctttttttttcttgtcctttttttgtgacgttgccatttttgatgagtccaggtagttttcctctatatgtctcacagtatgaaatgtgtctgattgttttcccatgattagtttaagcgtttttagcaagaagactacatgggcgatgttctgtccttcttaggcacaaaattctagtttatcccaagagcatagatacctttggggattttacagatagctaggtgggtattttttacttcccccttaagaaagttacttttctggacacgggtcaaattatggtttataatttgcaccatattccatgtctaggttacctgtttacagaaatgctcagcatgaagaggagtttctatatctgttctgccatcacattttcctacttcagagcatttacttagtccggttggttgtctgtctgtgtattcacaaactttcacaatcaactcaatagggaataaagttttttttttcagcagcttcatgtgcagtctccttaagtactttttcctatgacttggtcacttttctccctctcattgtataaagactttctcatactactctatattgatcatttttaagaggcaaatatgatatgatcgagttcctctcctgttattcttacctcctgacatgttatcatagcatctgggtcttctgtctctgggaagataagccagattttattgcatggattctgtattagttttatatttctaccataacaaaatgatcacaaatttagaaatttaaaagaacatatttattatagttctggaggccagaagcctgctatgggtctcatcagacctgatgagaagtcaagctgttggctggctgcattcctttctagaggctctggggggatatgtcctgctcatttggttattggcagaattccgttccttgccactgtagatctgagatctgtagatctcagttccttgccactgtagatctgtagatctgagatccctttcttgctggctatgagctaagagctgttcctagcttctagaggccacccaaattccttagattgtcatctcttttctccatcttcaaagccaaccatggcaaattgagtccctctcatacttagaatttctccattttcttttgtcattacatctttcactgactcagatgatatgcttttaaagatatatgcaattagagtatgcccacccaaataattcagaatattctcccccatctcaagatccttaacttaatcacatcagtaaagttccttttgccttgtaaaataacatagtcatggattcttgtaattgtggtgtggacatctttgggtggccatcattttgcctaccacagattttattatagcagcaagccataacctgacaccgagtgtgtgattcatccattcttttattcaaccaacacaaatattaaagaatgcctattaaattgagcatgtattaaattccaggcattgttttatgtgccagggttacaaaaatataacatctaactcaccaaggagttcataaactggtttggtaagttctgtagatagagattggcacagagttctataagagaatacaagaaggcacatgagcaagactagaagagccaggaatggcctcctgtattgatcaatatctaagctcagtctttgaaatgaaatgaggtactaagtaaggatggatgattgtagatgggtaaagaacttcaagcagtgagaaaataatgaccaaagttacagaactcgaggtaggctggtttttggaggaggtgagatgtatggtaggtagttttcctggagtggagagatggagctagatcagcaagctgaagcataaacatgaagactttgtgcactacaaaggctcaagatagatctgtaggaaatgggatgtgactgacaatcttgaaagagagtgctgtgttcacatttatattttatataggtcatactagtggccatgtggaggatagtatagtagagcaagattggggtaagaagatcatttaagatgcttgtatgaaaatcccgacaaaaagtgatgaaggcttgaactcagccaatggtagttgggatggagcacagatcagtgaatttgagaaagttttatgaagtattattgattagatggtgtatcaatcagggttcaaccagagaaatagaaccagtaggagatatatattaagaaatgtattataaagaattggcttgtgggggctgtgtaggcaagcctgaaatctgtggagtgggctttcaggaaggacagactggaactcctggacatgggctgaagctgatgtcctcaggttaaatttattcagggagaccttagctctggtcttaaggtccatcagctgattgaatcaggtctacccaaattatttaggataatctcctttacttaaagttaactgattatagacagtaatcacatctacaaaatagcttcacagcaaaacctagttaaattgaataactgaggactctagcctagccaaattaacacatcaaaagacaatcacagatgggatgtcaagggaaacagaataatagagggtagttctcaagtatgtggcttgagtattacatgaaatcactaactgagttatagaatacaagaaaaagagcaggttttcaacattttcagtaagatacctagatggaggttcctggcaagcaggtaaagatctgagattgcaagagaagtgttgtccatataaatatatttagataaccatcagcataaaggtgatagataaaaccaggagagtaaattaaataatctagaagaaggtatatatagagaaaagttatggattgagaaggaaattctggggaccactaacatttaaggattatctagagaaagatgaacagataaaggagtaataggatgagggggaaacctgaaaaagtctgatgccgattaagaaaaatgtagtgaacagcaacataatatacattagagggttcagtactgaaaaatatttattaatttgtaaattaagtttattggtgaatttagcattaacggtttccgtgttgtgagagcagaggccagattacagtgggttgaagagttactaggaagtgccaagttgagggtagctggcatacgagatgggatgagaatggaggataaaaattggacaatattttataattaaatgataactgtaagaagattaagagccaagggagtattaaaaaataatggtaggaacttgcagttttattgacttaaagtaacaagaaaaggggtagagactgaagatataggacataagagaattcaaagttactgagaaataaaagaaataggcctggttgttagagagggtgcagtgacaagagaaggacttgttttattctttggataagactagggtattggtactcaatggaggtagtataatcctgagagggtgattggaaagtttgtgaaaggcatttaagataatcattattgaagtgcttcctgacatattgtgggcagggtcagtattgctaaataacctgcaatatgcaagacagcctgcacaatgaaattttctatatcccatacaacttttaaatatatcatcagattaaacacttatttttgttaatctagaccttgaattgaactccattctatatatatataagcaagtttttaatacacactaacttttccaggaatgtaactaccatgtaatccaaggtaaaaacctttgttttgttcagaatcttatcaagaatgtttatcattttggaaaatcgtgatacctacaaaaacgctgctcttggatatttgaaatccagataacaacacacatgcatcagtcagtaattatagctgccacctttacaggcattctctgtatattttttgcatacttcattgtcttctagtgttgtcatgtccccacatttgcatcctttttttttttttttgagacagggtctcactctgacacccaggctcgagtagagtgtcacagtcccatctcactgcagcctcgacctcccgggttcaagcgatcctcctgcctcaaccccccaagtagctgggaccacaggcacatgccgtcatgcccagctaatttttgcgtttgttgtagaaacggggttttgccatgttacccaggctggtctcaaactcctgagcttaagtgattgtccgattcagcctcccaaagtgctaggattacaggcatgaacctccatgcctggctgcacatttacgtcttaaaatacattatattttattataaattactttcttgttatttctatttcatattatagatgttttgaaatttttatcttaatataataaagcattaaaatatttaagaaagggagccagatagaattggaaaccattggcacaggagaaataagataagaatgagtgaaaatgccgatttttaaacaacaatgaagagatttgtgagaatggctaatgcattatgctttgtggaagaggttaccatagttctaattcccaaatccaatgactggattttgggttttatcttgatccttctgcaacgtttaaaattctctgctttcttccattctacaacattcttctcttctagttctccttttacatatctggccattgtttctaactatttttttctgagtacctcctcagcctagatccttaaattgagtggttcctgaatcttcctatttcaatcctcacttcttcttggcaatctcacccactgtcctgggttaaataaaaaaaatatatgcagacgacttccaaatctgtatttctagcacaagctttatgccaggctcaaactcatatagtcacctgcctgctctttctgtgtgattgccttatcaccttagactgaatgttaccaaaactgaactcttcatcaccccaccagcagcaccacaaacctctttattctttattgtttgtactagtacttctaaggcaaaaactagggtatatgtcatgtttcttctctcttacctccactttttaatctgtcaccaagtcataatggttatttcttcaaaatattccatgattttttcttctatctttcatttccaaaactctagtcccattccccggtttggaccctcaacatttttctcctgaatgacaataatagttttctaactgatctcctgcctccagtactgtgtactgactcttggcacagcctttagaatagcctctaaaataaatatctgatcacattgctcccctacttaaaatcctttaatgattttttgcttcctatgaaaatcctttaatgatttcttgctttctatgataatgtctaaagtcttagcatgacctaaaagattctgtatggcatacctcttaatcaagccttatctgttgccaccaattcctacacctcatcccaaactcacacaactttttttttttttggattttatgtgccactagggttttcttgaacatactattatttcatgcagatttctttgtacatttgactccctctaacatctttacacccttgtttacctagtgaacttcattcttcaaattcctgctcatttgtcatagcctcaatattttttttcctcatcctctgtcttcagcctctaaaaataattgcttcctctttactatttctgtgcctggtatttgtctattattgcacatgtcaaacaataacttggtgaatgtacattgaattctcagtgtagtacctttccatctggttgattaggaattttaaaaagaattacaatgcacaacagaagttacttcatttgtttctaggtttttgctttttatggtggtataagtcatagtaaagtacataaatcttaagtatatagctcaatgaatttgtacatatacttatatactagtgtaaacaacacctagatcaaaatataaaacacttccaataccctagaaagcacatttgtgtccttttcaagttaacattcacaaaaagtaaccactattctaacatctgtcaccattgattagtttcgcatattcttgaactttatttaagtggaatcacagaatatgtactctttttaaaattttaactattattttacttgtaggggctacatacgcaggtttattacatggatgtattgcactgacatccattccctcctgcctctagtaatctgcagtgtttattgctcccaagtttatgtccatatgtgttcaatgtttagatcccacttataagtgagaacatgtggtattaggttttctgtttctgcattaattcatttaggattatggactccagctccatccatattgctgcagaggacataatttcattgttttctgtggctgcatagtattccatggtgtacatgaaacacattttcttcatccagtctaccactaatgggcacctaggttgatttaatgtctttgctattgtgaatagtacagtagtgaacatacgagtgcttgtgtctttttggtataatgatctatttattatcagttatgtatacagtaatgggattgctggatcaattggtagctctgttttaaaaatttctttgagaaatctaaactgctttccacagtggctgaactaatttacattcacaccagcaatgtatacgtgttcccattgctccacagcctcaccagtagctattgttttttgactttttatagtagccatcctgattggtgtgagattttttttattgtggttttgatttgcacttcacaagactgtactcttttgtcagataggtttttatttgaagccttatcagtaccttagaactctgctgcaccctaatgatatctgtgaggaaagagatattgaaacagctcttgaggggatgctccaagaggaaggcaagacttcaacaactctttttatttttattttatttatttatttttttgagatggagtctcactctgttgcccactctggagtgcagtggcaagatctcagctcactgcaacctccacctcccaggttcaagtgattctcctgcctcagcctccgagtagctgggattacaggtgcacaccactatgcccagataatctcttgtatttttagtagagacgggggtttcaccatgatggccaagctggtttcgaactcctgacctcaagtgatccacctgcctcggcctcccaaagtgctaggattacaggcatgagccaccgtacccagccagcaactattgaatcataaaaatcagaaagcctatgattatttggatgggtgtcctcacagtgaaatagaatgtttatctaatgtgttatctacttgaaggcaaaatgaaatatccagaaatttgaagagactgtggaagaagagatcttaaacgtttccaagaaagaaagggtgttaatttgaaattaactcagttctattcagtcaacacttactgaacacttgctgtgttaggcactatatgagacaaaggggacacccagattactaaaccatgcacctgttcttgaagactactcagtctaatgctggagacaagatctttctgtaaggaagaagctaaagctaggaagcacaaaggatagatagtgatcccagacacagaaggcttcttggaagatatagggcttgaattaaacttacattataaataggaggcattcaggtgaagaaagttagcaaggtatttagttttcagtcatgtgaatttgaggtacctgtgagacattcaagtgaagatgtccactagaatgtcagaaatataggcaaagaatgcagacttgaatgataatcagcatataggtgagagttgtcatcatatagatgagagttgaagccatgggaaagtgtatattgtgagaagaaaaagtggtcaagaagaaaattttgaagaacacaaacattgaaatgactgggagaggaagtgggtcctggaaaggaaactgaattgacaaaaaaaagtaaaaaaggtaagcagaaaatgaggattcctgaaacctaagggaagaaactatctcaagaaagagggtgtggttaacagtgtcaaatatttttataagagaaggatttaaaagcatccattggtgatggggacagaagggaaggaaaaaaaaacattgagtctatcaaaggaggtcctgtattagtgactttggtaagagaagatttattggcatagaagggacagaaaaaagattgtagtggattgaagagtgcatggaggagtgtgaggaagtgggtgaagatagggaagacattgcttccaggaatttgagctgtgatgagtagcaaaaggggaagaaagttataataggaggggaacaaggttaaaggaaccatcttttaagatggaaaagacttaaacttgtttaaatgtcagtaggaaagatcaaataaagaggaatagctgaagagagaggaaaaagtgagtataatgaatagttcgaaggaagtgagattatatgggatccagagcagaggtggaagagtatgccttaggagaggaggagaattgaagggagaaataaacagttccacaataatagttggagacttaaataccttactttcaataatggataagacatgtaaacagaagatcaataaagcgatagtgaacttgaacagcactgtaaaccagtagatctaacagactgtaaagacctaacagcactgtcccatagacctaacaggcatgtatagaacacttcatctaacaacaggaatatacacatttttctcaagtgccatggaacattctccaggataggccatatattaggccacaaaacaagcttcaataaatttaaaaagatgaaagtcatacaatatcttctacaatgacaatggaaggaatctaaaaatcaataacagaggaaaactggaaaatcatataacatttttaataaatggttcaaagaagaaatcttaagggaaattagacaaaattgtgaaataaatgaaaatgaaaacatgccagaacttaagggacacagtaagatcagtgctcagagggaaatttgtagctgtaaatgtcaacattagaaaagcagaaagatcttgaaacctgactctacacctagaggaacaagaaaaataatagcaaaacaaacccaaaactagaagaaggaaggaaataataaagattagagtggagataaacaaaacagagaatagaaaaacaataaagggaaaaacaaaccaaaagttgatttttttgaaaatatcaacaaaattgacaaaacgttaccaaatacctgaaataataagtaaatcagaaatgagaatggagccacatatctacaaccatctgatctttgacaaacctaacaaaaacaagaaatggggaaacaattccctatttaataaatggtgctgggaaaactggctagccatatgtagaaaactgaaactggatcccttccttacaccttatacaaaagttaattcaagatggattaaagacttaaatgttagacctaaaaccataaaaaccctagaagaaaacttaggcaataccattcacgacataggcatgggcaaggacttcatgtctaaaacaccaaaagcaatggcaacaaaagccaaaattgacaaatgggatctaactaaactaaagagcttctgcacagcaaaagaaactaccatcagagtgaacaggcaacctacaaaatgggagaaaatttttgcaatctactcatgtgacaacgggctaatatccagaatctacaatgaactccaacaaatttacaaggaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccgtctcacaccagttagaatggaaatcattaaaaagtcaggaaacaacaggtgctggagaggatgtggagaaataggaacacttttacactgttggtgggactgtaaactagttgaaccattgtggaagtcagtgtggtgattcctcagggatctagaactagaaataccatttgacccagccatcccattactgggtatatacccaaaggactataaatcatgccgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcataaggacaaaaaaccaaacactgcatgttctcactcataggtgggaattgaacaatgagaacacatggacacaggaaggggaacatcacactctggggactgttgtgaggtggggggaggggggagggatagcattacgaaatatacctaatgctaaatgacgagttaatgggtgcagcacaccagcatggcacatgtatacatatgtaactaacctgcgcattgtgcacatataccctaaaacttgaagtataataataataaaataaataaataaataataaaatggttaaatttataatatattaatttatccacagctaaataaaaaacaattaaaagatccatttggaaaaggatacaccctattaaagtaagcctgatacatgaaacaacagctaaaaaagaaaaaaaaaaagtaacacaattgacaacctaaataaagaaaatacttacactgaaagaaaacataaacaagaccaagatcaggttataaaaaaagagttagtgtataatgtacttaaaaacattgcctctgtcaatgaataaaaagaataacatattagcgaagtgcattaaggaaggcaacagacgaataggaaaaataatgtgcaagatttagtaaataaatataggaaaactaaaatggccaggcacagttgctcactcctgtaatctcaatgttttgggagggcaagctgggcggatcacttgaggtcaggagtttgagactaggctgtccaacatggtgaaaccctgtctctacaaaaaattagcggacttggtggtgcatgcctataatcccagtgaatctggaggctgaggcatgagaatcacttgaaccaggaggcgggggttgtagtgagccgagattgcgccactccactccaccatgggtgacaaagtgagactctccctgaaaaaaagaaaagaaaagaaaagaaaatgaccctagacacattttagtatttacataatgtaaattatttaacacaacagtactgattaaactgtaataacaacgataaataatattgactggcttttgataagtataattctcaaatatgatcagaattagaatatattgctaaagaactttaggaaggtgttaattgaaaattctaattgtgagaattcagtgtccacaagagacatgttctatttcataatacattaatatatttccttatattagatttttctgaaggtttgtagaagtgcatcttgtactctgcagaggaataggatgacaaatgaactcagggttaattggaataattttaaaatgcacgttgattaaataagaaggcagcattgatttcacagcaactatatataactattcattgtggtttcataaacaacaaaaattgtaaccactaaacacactaattctgggcatcccttccttcgcttcgtgcaccatcaattcagtggccctttgcagtgagcacttgacatccgaaaaacaaaagaaaacctaaaaaacaaaatgaggaaccaactaaggtacacccttctcacttcagcagggctccccccacttgaccacattggggaaacctgcaaaagtaggaggattctctgcttccatcattccttctagattattctctcggaaagggaaaaagaagagaagagaagggaaagagaagggaacgggaggggaggggaggagaaagggagcggggaagggaaggtttgtcttcaaaaaatccaaccattggggctgtagcatggtggggggagcttgtaggaaggaaggaaggaatgcttgtcttcaaaaaatacaaccactggggctgtagtatggtgaggggagcttgtatttccgggaaacaggggaggtgtgtgtgggtattggaggagggtggctacagaatcctctatgaacctgctcaggtctcataaacaggaaaacaagccacttgcttgtgtgcaccacacttgtccctaggcagcacactccctcctgggaaagagatcaaagtttggattaaaagcagccaggtccgctaggcatggtggcccacacctgtaatctcagcactttgggaggccaaggtgggcagattgcttgaggccaggaatttgagaccagcctggcaaatatggtgaaaccctatctctactaaaattacaaaaattagcatgtaatctcagctactttgggaggctaaggcaagagaattgcttgaactcaggagacagaggtttcagggagccgagattgtgccactgcactccagcctgtgtgacagagtgagactctgtctcgaaaaaaaaaaaaaaaaagaaagaaaaaaagaaaggcagccaggtccaacaggcatctgcacattgttgacccatccagcagaacagggtcgagaaaggcatctgtcgggatggggcaggacaggacgagacagactattgtctgaggcatttggctacctctctgactggaacccaggcactcatatgtgcccaggaatgggtgggatattccggatgggttccacaggtggctctcctagagagacccacttggcatatttgatgatggagcatgcaggctccctggaacgtgatggctcactagttagtacccccggcatcttggtcattctgctgaagtgcatgggtagccaggcccccggcagtgctcagtttctcctgggcccctctgtgttcctgtggtgggtgtggaagtggaggttgaggctagagtgtctttgagggtggtggggcagctgtgccttgatttgatacagagctctctgggctcctcaagctaaactctggtgcttgccagatactcagctcagataatgaatgagacggtggaggacaaattattttgcccctttagggtctccaggcagacatgcaaaagcctggtgcagggccttcatacagagcccatgttgggtgcaaagccatgaccccgttgctctaaaggttgcatgtcctacccataccgcttggtacctggagagcagcatggaacacaatgctctcagaatattgaaaaggttttctgtgtctccactgagggatactcctgcctcaggccctgtggctgcctattgagccatcagcccattctggtgacctgcatgtgccaggacaatgtggtaatctcaaccaggagctccaggtttacataggcccccagtccttgggtaaatccttgtgtaagccagctgggtggctcccactttctcctggaatggcagccctatgatcccagtccacctgtggtgtcccagtggccatgattatgtgtcctttgtcattactttctgcactagaagcagccacaaaacctggagagggccaaaggaagggcaaaggctggatgccgaaacaggattcccacagggtctccagcctaccaggccttggtcattgggacccctgagtttggtggtcaacctgggacctagtggctgttttctttttctccccactttttctctttctccttcctatttttttttttcacatgggaaaaggcggaggacctcggggtggaggagcagggttacagttatagttagtgtttgtggagccctactgccatcaagcagaaacagtttctggcactgggatacagctgagcaccagtgctggggaaagcccaggagtgctaaacagatggcgacaagccgtccacaggctgaagcaggaggagagaggaactcctgactggcccttggcctgtgcttattcccaggatggcgccttggctccacagctctctctgaaagaaagggcaggcaggggcaccccaccatgggctcccctggcagtctccagggacttccaagcatgaatcgccccgcccccagcaccccgaagttcctttgttcccagggagaataagaaccccttggccccagcttggacccagccaatggcaccttggaactccccacaaaggagaccagagtaaacagccccagtctcgaccatcagtgcccagtggcttcccttatgcccatcacaagacagggtgtctctgcccactgggtagactggtcttgaggctgccgggttgttctgtcccagggcctctagagttgctgcttctccatgaggtcccaatggcaggtacacttccttcaagggctttgaaccccggtggggggaaaccctgccttgggctgagtctacccagcctggcacatcctcactgtttgttgtctgtgcctggaagaaggcaagtttccttgcagcctgtagttcagaaacaccttccactggatgtcactgtggctccacaaatggcagtcaccccttttctttcccccaccttgccttcctctccctccttttgctggcaaccaaacaaaacaaagaccagaaaacagaaactggggctgggtgcggtggctgacgcctgtaatcccagcactttgggaagccgaggcaggcagatcacttgaggtcaggagctcgagaccagcttgaccaacatggagaaaccctgtctctattaaaaatagaaaattagctgggcgtggtggcacatgcttgtaatcccaactacggggaggctgaggcaggagaatcgcttgaacccgggagacggaggttgtggtgagccgagattgcaccattgcactccagcctgggcaataagagtgaaactctgtctcaaaaaacaaacaaacaaacaaaacaaaataaaaaaaacaaagaaacaaaccggccaaagagcacccacctcatcttcagcattgctcctcacctacatggtcactttggggaaacttgccttcctccttccctctggattcttctttgtgcagggggtcccaatgaaccagcctatcctcaagaaatcccacccttggggctgtggcatgatgtggggaggttgcactggggaaggtgtgaggggctacagggtggcgggtgtgtgggtgtgtaggtctgcattccagccactgcagatttctctatgaatctgcataggcctcctaagaaggagactggcgcgtgcctagagaaaaagcaggaagataagaatgcaggaagatctggactgcatccttaggggtggcattgtgactctgattgtcagaggtctccgtttttaacgtttaactcccatcacatctcaactttttcctgtcttcacctgtgcttccaaatgtcctcaggcacatatatgtgtccctactcatactcactcacaagcgtctgcccaggcacctccactcatacctgggtcctgttgtgcaggcaactctcagagggcagggttcttcagcttcccggttccatcttgttcatcttcctcatcccttgttgtctggctgcccaatatttgctggcggagggtgcgggatgtgttgggggtggagacagcagggagcagggcagcctcctggcccaacaggcctctgtgcacatgcagtgcagacctgggcataaggggctgacactttctcctggctggttggtggctcttcctctgtgaagccacagaaggtcactcgggttgccacctgtccatctgggacattctgcattcttgttcgctgtcatcctcattgctcacgttgattcttagtatacttttggagtttttcttccttcacttttttcttcttcactgtctttacttctcgtccacttctggtttggggaggtcaggattcgcctggaaggcagggtccggttggcaagcgaacatatttagggagaacacgccttcttttcctcaggaaattagaaagacctcagttgactcctgccagatgtaatcggggtgcccctctcctttctgccctctctccctagtgccataggtggctgattacctcctttccctggtgtccttttcctctccgtttttcctctctcctcccatttctggggtcctacccttcattggccttgtagactaggggctcgtggccccttgcggtttgcagatgacatccagagggtatggtttagcctgcatctttgtcctctgtagcccctgcagacctatttgtggatcaaagcttttgatccgactcacaagggatcccatcaacaagaagcttcttggtggtgtgtcctttcactgggatgtcactgttgtctctttgtcactcgttatgtatgtcaccacgcattgaggcacccatgaactctatccttcaggacagctgaggtggcatgaagctgccatttcttgttctttttctccatctggttcttcttcctcttcctcctcttcctctttctttctcttttcttttcttttctttctttctttccacctcctcctcctttttcttcttcttttcttccctcctcctcctcctcctctctcttttcctttcactttcagatcttggcgagacaaatgttctatggagactgcttcttctgctccttggtaatgggggatgtccctctgcgtgctaggcaaggagaaagcttcacttttgttctgaaaggagcagagatgaaggtcacatgttcagttcctctggtcctctaaaaaaccacccatgtgttacttttaagtgaaatgtcattctgaatgcacttcctaccagtacctcacgattcatccttctaccttgttctccttgaagacgatctaataatgtaatcttggccagtaggagcctcagcaagttttcccccatttcctctccttccagtcaagccatgtgaacacaactatccggatttcagtgtatacaggcaggctgtctctgccatgtgccagtttacccactctcacacaggaaggcacccacaaaccatagacacagatacacatacacacactcactagggacctcagaaatgaaatcacaaacacacccgcacacagagacacatgcagacacacacaaacacacacatagacacacaaacaagaaacctcacaggggcacaggggtgcaggcccaagcattctcccacacagacacatacacaccaccacaggcacgagactgcctacaatttctcccacacaggttctaaatgtgcaaagggaacaggagacaggggagaattcctgactccaggcctgggccatcatgccattgattgatgggcaactctcgccttctcctgagaatcaatgtgggaagtctgttaacagataggatccagcagctggtgtaaaactggagcatcctgggtcaagctgcttaaaaaggaacctcactttgtgttagagacagagagagttcccttgggagccttggccctgtgtgatgccataagaatctgtggtgtgtggtggcattccccagcacccctgagccaccctcctcccacccccatctgtgtgaaacccaggacagcctgagcagagtcagacttgagcaagttgctgagtgtcctctctgagagatactcctgcttcaggccctgtggtttccagttgagcagtccacctattttgatgacctccatgtgtcagcccaaggcggtaaactctacctggagctccaggctttcgtaggacccccagtcctgcagcagaaccttgtgtaagccagctgggtgaccagcaccttgtcctggggcagtagccctatgatcctagtcctcctgtggtgtcccagtaatgatcatgttttttgttgtttactttctgcacgggcaagagccatgaaacctgcagagagccaaaggaagggcaaaggctggctccctaaacaggattcccacaggatctccagcctactggtcctggtccttggtcacacggtcccatgagtttggtgatcaatctgggaccaggtgactgattcctttcactcctctgtctttttttttgtttctctttcctctttaccttttttcacatgggaaaaggcggaggccctggagttgaagtggcagggttacagttgtagttggcgtttgtggagccatactgccatcaagcggaaactgtatctagaaaccggaggcagctgggcacaagtgctggggaaaccccacgagcgcaaaagagatggcggcatggagcccccaggctgaagcaggacaagagaggaactccaagctggcccttggcctgtgctcattcccaggatgcctccctggttccacagctctctccgaaaaaaagggcaggtaggggcgacccaccatgggttcccctggtcatctccaggtactgctggtcctgggttgccacgtctccagtatcccgaagctcctttgttccccgggaggatcggggcccccttgccaacacgtggctccagccaagggaaccccggaactccccacaaaagacaccagagtaaacggcccccgtctcggccagtggcttcgtttatgtccatctcaacatggctgccgggccagctccgccctctgggctgactggtcttggggctgcctggctgttctgtcctggggcctctagagtagttgcttctccaaagcgtcccaatgccaggtacacttccttcaagggctcagaaccccggtgggggaaacccaggcttagacatagtctaagcacatcctcgctgatctctgttcctggcagaaggcaggtgtccgtgcatcctgttgtgttcagaaacaacttccactagatggcaatgtggctccacaaacagcagtcttgtctttcccttcccccattttctttccctctttctgtttttggtgccaaaaaccaaaacaaacaccaaaaaaaaaaaaaaaaaaaagaaactggcctaggagcacccatctcacctacagcagggcttcccatctatgtggtcactttgggggaaccggcaacagtaggatggggtaggggtgggggccacagggagcagggcagcttcctggcccaacaggcctctgtgcccacgcggtgcagacccgggcttgaggggctgatgctttctcctggctggtggctcttcctctgtgaggccacaagaggccactcatagtgctgccagctgtccatctgaggcactttgcattgcagttcgctgtcaatctcattgctcactgattctttgtgtacttttggagtttttctcccttcacttttttcttcttcattctctttactttttctccacttctgctccaggagcagactggaaggcagggtcagctgggcgcggggacaccgttagggaaaacaggcttacttttcctaaggaaattagtaggactctagctgacccctgcgaggagaaattggcgtttccctctcctttctgccctgtctccatattgcagtgggtggctgattatctcttttccctggtgtccaattcctccccgtttttcatcttattcttttttgggcggtccttccctgccttggccttgtagccttggggcttggtagccccttgcagtcagctgatgacatcttcagggcaaggttcagccagcacctgtgttctctgtagcttctgcaggcctacttgtggatcaaagcttttgatcttactcaggaaataccccatcaacaagacgcttcctggttgtgtgtcctttaagccggatgtcagaagtggctccgtgcccctcgttgtatgtcaccacgcgttgaggccctcctaaactagatccttcgggacagctacagtggcatggacctctcacttcctgttctccttctgattcttcttcctcttcctcctcctacccctcttctttaattcttctccttctcctccttctcctcttgctcctcctcctccaactccttcttatcttcctactcctcctttttctttttcttctttttcctccttctactcctcctccccctccccctgcacttccttctcctttgcctctttttctttttttgcttttgcttctgcttctgattctgcttctgtttttcctttcacttgcggatctgggtgggcacgtgttctagcagactgcttcttcttttgctccttggtgatgtgggatgtccctctgcagaattaggcctggagaaagcttcacattcgttctttaaggagcacagatgaaggtcatgagtttagtccctctggtccaccaaaaggctacccacgtgttacttttaagtgaaatgtcatggtgaacgcaccctttacccaatacctcatggctcattgttatttcccattctccttctggatgctgtaagtgtaatcctgagccagtaggagccttggcaagttgtttcctaactcctttttttccagtcaagccatgtgaacacatcaatctgaatttcagtgtgtgcaggcagggtgtctctgccacgtgttcatttgctcacatttcagtgtgtgcaggcagggtgtctctgccacgtgttcatttgcccactctcactcacacagggaggcacacacagacacacatgcaggcacttacaagagacccccagaagaagaaataaaatcacaaacacacacacagagatacatgcacacccagacaaaaacacgcttacacatacccacacaaacacacacatacacacacataaagtaagctcacaaaatcaaaggggtaggggcccaagcattatgggacacaaacacacatcgccacaggcatgcgactgcccacattctcttcgacaggggttcgaaatatgcaaaggggaaagggagacagaggagcattcctgcctccaggcctgagtcattatgccatttattgggcaactagggccttctcctgagaatgaattcgggaagtctgttatcagataggctcaagcagcaggcatgaaactggagcatcctgggtcaagctgcttaaaaagggcccccaagccttgtccctgtgtgatgccatgagaagctgtggtacttggtggccttccccagcctctctgagccaccctcctcccaaccctacctctgtgaaagccgagacagcctgagcagagtcagtcttgagtgagttgctgaatgtccccgctgagggagactcctgcctcaggccctgtggctgcctgttgagctgtctatccgttcttcggacctccatgtgccatcccaaggtggtaaactctaactgcaactccaggctttgggaggacccccaattctccagcaaaaccttgtgtaagccagctgggtggccactgccttgtacttgggcggcagccctgtgatcccagtccttctgccgttttccagtagccatgattatacgtcctttctcttttactttctacaccagcgaaagcgatgaaacctggagaggtccaaaggaaagtcaaaggcttgctgcctccacagcgttccgacaaggtctccagcctactgatccttgatcctagggtccccttaagaggtgaaagtctgatggcagccctggcagccctcgctcgctctcggcgccccctcggcattggcgtccactctggccgcccttgaggagcccctcagcccgccgctacactgtgggagcccctgtctccactggccaaggtcggagccggctccctcagcttgcggggaggtgtggagggagagccgcgggcggtaacacgagctactcgccgcgcttgcgggccaccgggagttgccggtcggcatgagctcggcgggccccgcactccgagcagccagttggacctgcctgcccagggcagtgaggggcttagcaactgggccagcagctactgtgctccacttctcgcctatctcttctccttaactttcttttataattatgttttctccttcctctttgcttttttcacacgagaaagggcggaggccctcggattggaggggcagggttgtggttgtacttggcatttgtggtgccatactgccatcaagcggaaaccgtttctggaaaccggaggctgtagggcacaagtactggggaaaggccaggagcccaaaagggagggtggtgtgggaccccagactgaagcgagacgagagaggaactcctcgctggcccttggcctgggctcattcccaggatggcgccctggctccgcagctgtatgtaagaacgggcaggcggggcggcccgccatggcttcccctggcagtctccaggaactgccaggcatgggtcgccccacactcagcactccgaaacttttttatttcccggcaagatagaggctttctggccccactgtggccccagccaagggcatcgcggagctgcccacaaaagcgaccagagtaaacggccccgttctctggctgtcagtggccagtggcttcccttatgcgtatctcaaaatggctgccggggcagctgcaccctgtgggctgactggtcttcgggatgcctggctgatctgtctcggggcctctagagtagctgcttctccaaggggtcccaatggcaggtccgctttgttctagggctctacgcccgggtcggggaaaccctggcttaggcagagtccaccccgccccgcccatcctcactcttctcggtgcctggcagaaggcaagtgtccctgtccctgcagcctgttgtcatgtccagaatcaccttccgctggatggcactgtggctccgccaatggcggtcacgtcttttccttcccccaccttgcctttatctttctccatctgctgccgacagaataaaacaaacgccaaaaacaaaaaaagccaagaaacaacgaaagataccggccaaggagcacccacctcacctacagcagggctctccacctaggtggtcactttggggaagcctgcaacggtaggagggttctctgcctccctccttccctctggattcttctccgggcagggttcccagtgaaccagagaacgtcaagaaattccacccttagggctgtggctcggtgggggtaggtcgcactgggggcagtgtgagggggtacagggggagggatatgtgggtgtgtgggtctgcatgcgggccgctgcagattcctctaggaatctgcgcaggccgcctgagcaagagaccaggctgcatgcctgtgcgcaccacacttgtccctaggtagcactcttcctcttggggaagggatcaaagttggatggaaagcagccaggtccagcaggcatccgcaccttgttgagccatggagctgcagggagtcgggccggatgtttcttgggatgatgggactggacgggacggactcctgtctgaggccttcagctccctccctctctggagcccaggcactcgtctgtgcacagtggtgggaggagcatgccgggtgggtttcacaggtggctctcctggagagagagcctcttggcatgtctgacggagcacgcgtgctcagtggaacgtggtggttcaccacttagttgccaggcatcttggtccttgtacccaagtgcatgggtagccagggcccagcctgccccacttcgcctggaccccgtctgatttcctgtgctgcgtgtggaggtggaggttgagccttgagtattttgggggagaaggggctcgggcggggggctgtgttttggtttggtagagggctcactgggctctcgagctaaaccctggtgcttgccggatattcagcccagaaaatgcatgagaccgtcaaggacaaattatgccgcccataattagggtctccaggcagacataagaaagcctgatgcgggacatcatacagtgcccatgttgggatgcgaagccgcgaccgccttgctctaaaggttgcataggctactcatgccgctgggtgcctggacagcagcatggaacacaacgctccccgaatattgcaaatgttttctgtcttggcttgttacaaatcttcctggatgtgtaggccaccctggggacgagcagcccttcttagggcagaaaattcaccccacgggtgatgattcccacgctgggggtgtgtgaaccactctcacaaggaggaatgtcaatctcgtgagcgggcctgcactctcacggcattccgggcagaagaaccacatgaccatggaacaggagtcaccccctttctgtcacttgtcaacaaatgcggatttttttttttttttttttttttttttcctcatatgtaggtagcatgcaccagggtgcgcctctggcggtgcctagggagaacgcgagaagaaaagaatgcaggaagatctggactgcgtctttagggttggcactgggactgtgagtgtcagaggtcctcggttttaacttttaactcccatcacatctcaactgtttcctgtcttcatctgtgcttccacaggtcctgaggcaggcccgtacacgtatccccacccatactcacaagcgtctgcccagacaccttcattcacagccggggccggtcatctaggcaactctcaggggggcaggttttcagctttcgggttccctcttgttcacttcaccttccttgtcgctttctgcctggcttcccaatatgtgctgacggagtgtgcgggatggggttgaggtgtgggcagcagggtgcagagccgcctactggcccaacaggcctctgggcggacgcggtgcagacccgggcctaaggggctgatgctttctcctagctggtggctctttttctgtcaggccactcacagggctgccagctgtccagctggggcactctgcattccacttcgctctcaacctcattgctcactctgattctttgtgtactttcggagttttcctcccctcacttttttcttcttcactttctttacttttcgtccacttctgtttggggaggtgagaagcagcctggaaggcagggtcgactgggcgcggggataccgttagggaaaacaggcttacttttcctaaggaaattaggaggactctagctgacccctgtgaggagaaattggcatttccctcccctttctgccctgtctccatattgccgtgggtggccgattacctcttttccctggtgtctgattcctccccgtttattaccttcctctttttggggggggggctcttccctgccttggccttgtagacttggggttcggtgacccttgcagtcggctgatggcatcctcagggcaaggttcagcctgcacctgtgtcctctgtagcttctgtaggccgatttgtggatcaaagtttcggtcccactcaggaaagatcccatcgacaagaagcttcctggttgttcgtcctttaagcgggacgtgactggtggctccttgtccctcgttgtgcatgtcaccatgcattgaggtcttcctgaactagatcctccaggacagctacagtggcatggacctccctctttcttgttcttctgattcttcttcctcttcctccttcttcttcttcttctctacttttattcttccctttctcctctattttacctcttgctcctcctcctccaacttcctctcctcctcctcatgctcctcctttttgtcctcctcctcctcctccttcttctcgttctcgttctccttttccttcttctttttcttctcatttttcttcttcttcttaatctttttctgcctcctcctcctcctcctcctcctcctcctcctccgcctcctcctcctcctcctcctcctcctcctcctccttttcctcttcttctttttctgcttttgcttctgctttttcttccctttttcccttcacactcagatctgttcgggcaagtgttctaggagactgctgctgcttttgctttttggtgattcgacatgtccctctgcagcactaggcctggaggaagcgtcacttttgttctcaaaggagcactgatgaaggtcaccagtttattccctctggtccaccaaaaagctgcccacgtgttacttttaagtgaaatgtcgtggtgaacccaccgtttacccagtacctcatgtctcaccgttattccccattgtccttgtggatgctctaagtgtgcctttctgagccattaggagctttggcaagttgtcccctgtctcctttttctccagtcaagccatgtgaacacatcgatccagatgtgtgcaggcagggtgtctctgccacgtgttcatttgcccactgtcactcacacaggcaggcacccacagaccgcagactcaggtacacaggcacgcaatcatatgggatccggcaacccaaactgaaatacacgcgcacacacagacacatgcacacgcagacacaaacgcacacgttaaacacgcccaagtagacacacgcatacatacacaaacacacgcacgtgcgcacacacgtcagctcacactagcaaaggggtgtgagctcaagcattatcggacacagactcctacacaccgccactggctcgaaagcgcccacaacctcttccacgctggctctaaatgtgcaaagcagaacgggagacaggcgagcattcctggctccagtcctgggtcatcatgccatttattgggcaactagggtcttctcctgagaatgaatgcgggatgtgtgtcatcagataggcccaagcagcaggtatgaaactggatcatcctgggttatgctgcttaaaaagggaccccactttggaggaggggcagagacagtccccctggagtcttggctctgtgtgatgctatgagtatctgtggcgcggggtggccttcccaggcctccctgagccgcccccctcccaccctctcctgtgtgaaagccgagacagcctgagcagagtcagacttgagtgtgttgctgagtgtctcctgtgagggagactcctgcctcagccctgtggctgcctgttgagccttcggccccgttctggtgacctccgtgtgccatgccaaggtggtaaacactacctgcagctccaggccttgggaggacccccggtcctggggcaaatccttgtgtaagccagctgggtggccagcgccttgtcctggggcggcagccctatgatcccagtcctcctgtggtttcccagaggcggtgattatgtgtcctttgtcttttacttcctgcaccagcgggagccaaaatccctgaagagggccaaaggaaaggcagaggttggctgcctccaccgcattcccgcaggttctccagccggctggtcgttggtcctagggtcccctgagtttggcggtcaacctgggaccaggtggctggttcctttcccttctccgtgtctttcttttattattatgttttctccttcctctttgcttttttcacacgagaaagggcggaggccctcggattggaggggcagggttgtggttgtacttggcatttgtggtgccatactgccatcaagcggaaaccgtttctggaaaccggaggctgtagggcacaagtactggggaaaggccaggagcccaaaagggagggtggtgtgggaccccagactgaagcgagacgagagaggaactcctcgctggcccttggcctgggctcattcccaggatggcgccctggctccgcagctgtatgtaagaacgggcaggcggggcggcccgccatggcttcccctggcagtctccaggaactgccaggcatgggtcgccccacactcagcactccgaaacttttttatttcccggcaagatagaggctttctggccccactgtggccccagccaagggcatcgcggagctgcccacaaaagcgaccagagtaaacggccccgttctctggctgtcagtggccagtggcttcccttatgcgtatctcaaaatggctgccggggcagctgcaccctgtgggctgactggtcttcgggatgcctggctgatctgtctcggggcctctagagtagctgcttctccaaggggtcccaatggcaggtccgctttgttctagggctctacgcccgggtcggggaaaccctggcttaggcagagtccaccccgccccgcccatcctcactcttctcggtgcctggcagaaggcaagtgtccctgtccctgcagcctgttgtcatgtccagaatcaccttccgctggatggcactgtggctccgccaatggcggtcacgtcttttccttcccccaccttgcctttatctttctccatctgctgccgacagaataaaacaaacgccaaaaacaaaaaaagccaagaaacaacgaaagataccggccaaggagcacccacctcacctacagcagggctctccacctaggtggtcactttggggaagcctgcaacggtaggagggttctctgcctccctccttccctctggattcttctccgggcagggttcccagtgaaccagagaacgtcaagaaattccacccttagggctgtggctcggtgggggtaggtcgcactgggggcagtgtgagggggtacagggggagggatatgtgggtgtgtgggtctgcatgcgggccgctgcagattcctctaggaatctgcgcaggccgcctgagcaagagaccaggctgcatgcctgtgcgcaccacacttgtccctaggtagcactcttcctcttggggaagggatcaaagttggatggaaagcagccaggtccagcaggcatccgcaccttgttgagccatggagctgcagggagtcgggccggatgtttcttgggatgatgggactggacgggacggactcctgtctgaggccttcagctccctccctctctggagcccaggcactcgtctgtgcacagtggtgggaggagcatgccgggtgggtttcacaggtggctctcctggagagagagcctcttggcatgtctgacggagcacgcgtgctcagtggaacgtggtggttcaccacttagttgccaggcatcttggtccttgtacccaagtgcatgggtagccagggcccagcctgccccacttcgcctggaccccgtctgatttcctgtgctgcgtgtggaggtggaggttgagccttgagtattttgggggagaaggggctcgggcggggggctgtgttttggtttggtagagggctcactgggctctcgagctaaaccctggtgcttgccggatattcagcccagaaaatgcatgagaccgtcaaggacaaattatgccgcccataattagggtctccaggcagacataagaaagcctgatgcgggacatcatacagtgcccatgttgggatgcgaagccgcgaccgccttgctctaaaggttgcataggctactcatgccgctgggtgcctggacagcagcatggaacacaacgctccccgaatattgcaaatgttttctgtcttggcttgttacaaatcttcctggatgtgtaggccaccctggggacgagcagcccttcttagggcagaaaattcaccccacgggtgatgattcccacgctgggggtgtgtgaaccactctcacaaggaggaatgtcaatctcgtgagcgggcctgcactctcacggcattccgggcagaagaaccacatgaccatggaacaggagtcaccccctttctgtcacttgtcaacaaatgcggatttttttttttttttttttttttttttcctcatatgtaggtagcatgcaccagggtgcgcctctggcggtgcctagggagaacgcgagaagaaaagaatgcaggaagatctggactgcgtctttagggttggcactgggactgtgagtgtcagaggtcctcggttttaacttttaactcccatcacatctcaactgtttcctgtcttcatctgtgcttccacaggtcctgaggcaggcccgtacacgtatccccacccatactcacaagcgtctgcccagacaccttcattcacagccggggccggtcatctaggcaactctcaggggggcaggttttcagctttcgggttccctcttgttcacttcaccttccttgtcgctttctgcctggcttcccaatatgtgctgacggagtgtgcgggatggggttgaggtgtgggcagcagggtgcagagccgcctactggcccaacaggcctctgggcggacgcggtgcagacccgggcctaaggggctgatgctttctcctagctggtggctctttttctgtcaggccactcacagggctgccagctgtccagctggggcactctgcattccacttcgctctcaacctcattgctcactctgattctttgtgtactttcggagttttcctcccctcacttttttcttcttcactttctttacttttcgtccacttctgtttggggaggtgagaagcagcctggaaggcagggtcgactgggcgcggggataccgttagggaaaacaggcttacttttcctaaggaaattaggaggactctagctgacccctgtgaggagaaattggcatttccctcccctttctgccctgtctccatattgccgtgggtggccgattacctcttttccctggtgtctgattcctccccgtttattaccttcctctttttggggggggggctcttccctgccttggccttgtagacttggggttcggtgacccttgcagtcggctgatggcatcctcagggcaaggttcagcctgcacctgtgtcctctgtagcttctgtaggccgatttgtggatcaaagtttcggtcccactcaggaaagatcccatcgacaagaagcttcctggttgttcgtcctttaagcgggacgtgactggtggctccttgtccctcgttgtgcatgtcaccatgcattgaggtcttcctgaactagatcctccaggacagctacagtggcatggacctccctctttcttgttcttctgattcttcttcctcttcctccttcttcttcttcttctctacttttattcttccctttctcctctattttacctcttgctcctcctcctccaacttcctctcctcctcctcatgctcctcctttttgtcctcctcctcctcctccttcttctcgttctcgttctccttttccttcttctttttcttctcatttttcttcttcttcttaatctttttctgcctcctcctcctcctcctcctcctcctcctcctccgcctcctcctcctcctcctcctcctcctcctcctccttttcctcttcttctttttctgcttttgcttctgctttttcttccctttttcccttcacactcagatctgttcgggcaagtgttctaggagactgctgctgcttttgctttttggtgattcgacatgtccctctgcagcactaggcctggaggaagcgtcacttttgttctcaaaggagcactgatgaaggtcaccagtttattccctctggtccaccaaaaagctgcccacgtgttacttttaagtgaaatgtcgtggtgaacccaccgtttacccagtacctcatgtctcaccgttattccccattgtccttgtggatgctctaagtgtgcctttctgagccattaggagctttggcaagttgtcccctgtctcctttttctccagtcaagccatgtgaacacatcgatccagatgtgtgcaggcagggtgtctctgccacgtgttcatttgcccactgtcactcacacaggcaggcacccacagaccgcagactcaggtacacaggcacgcaatcatatgggatccggcaacccaaactgaaatacacgcgcacacacagacacatgcacacgcagacacaaacgcacacgttaaacacgcccaagtagacacacgcatacatacacaaacacacgcacgtgcgcacacacgtcagctcacactagcaaaggggtgtgagctcaagcattatcggacacagactcctacacaccgccactggctcgaaagcgcccacaacctcttccacgctggctctaaatgtgcaaagcagaacgggagacaggcgagcattcctggctccagtcctgggtcatcatgccatttattgggcaactagggtcttctcctgagaatgaatgcgggatgtgtgtcatcagataggcccaagcagcaggtatgaaactggatcatcctgggttatgctgcttaaaaagggaccccactttggaggaggggcagagacagtccccctggagtcttggctctgtgtgatgctatgagtatctgtggcgcggggtggccttcccaggcctccctgagccgcccccctcccaccctctcctgtgtgaaagccgagacagcctgagcagagtcagacttgagtgtgttgctgagtgtctcctgtgagggagactcctgcctcagccctgtggctgcctgttgagccttcggccccgttctggtgacctccgtgtgccatgccaaggtggtaaacactacctgcagctccaggccttgggaggacccccggtcctggggcaaatccttgtgtaagccagctgggtggccagcgccttgtcctggggcggcagccctatgatcccagtcctcctgtggtttcccagaggcggtgattatgtgtcctttgtcttttacttcctgcaccagcgggagccaaaatccctgaagagggccaaaggaaaggcagaggttggctgcctccaccgcattcccgcaggttctccagccggctggtcgttggtcctagggtcccctgagtttggcggtcaacctgggaccaggtggctggttcctttcccttctccgtgtctttcttttattattatgttttctccttcctctttgcttttttcacacgagaaagggcggaggccctcggattggaggggcagggttgtggttgtacttggcatttgtggtgccatactgccatcaagcggaaaccgtttctggaaaccggaggctgtagggcacaagtactggggaaaggccaggagcccaaaagggagggtggtgtgggaccccagactgaagcgagacgagagaggaactcctcgctggcccttggcctgggctcattcccaggatggcgccctggctccgcagctgtatgtaagaacgggcaggcggggcggcccgccatggcttcccctggcagtctccaggaactgccaggcatgggtcgccccacactcagcactccgaaacttttttatttcccggcaagatagaggctttctggccccactgtggccccagccaagggcatcgcggagctgcccacaaaagcgaccagagtaaacggccccgttctctggctgtcagtggccagtggcttcccttatgcgtatctcaaaatggctgccggggcagctgcaccctgtgggctgactggtcttcgggatgcctggctgatctgtctcggggcctctagagtagctgcttctccaaggggtcccaatggcaggtccgctttgttctagggctctacgcccgggtcggggaaaccctggcttaggcagagtccaccccgccccgcccatcctcactcttctcggtgcctggcagaaggcaagtgtccctgtccctgcagcctgttgtcatgtccagaatcaccttccgctggatggcactgtggctccgccaatggcggtcacgtcttttccttcccccaccttgcctttatctttctccatctgctgccgacagaataaaacaaacgccaaaaacaaaaaaagccaagaaacaacgaaagataccggccaaggagcacccacctcacctacagcagggctctccacctaggtggtcactttggggaagcctgcaacggtaggagggttctctgcctccctccttccctctggattcttctccgggcagggttcccagtgaaccagagaacgtcaagaaattccacccttagggctgtggctcggtgggggtaggtcgcactgggggcagtgtgagggggtacagggggagggatatgtgggtgtgtgggtctgcatgcgggccgctgcagattcctctaggaatctgcgcaggccgcctgagcaagagaccaggctgcatgcctgtgcgcaccacacttgtccctaggtagcactcttcctcttggggaagggatcaaagttggatggaaagcagccaggtccagcaggcatccgcaccttgttgagccatggagctgcagggagtcgggccggatgtttcttgggatgatgggactggacgggacggactcctgtctgaggccttcagctccctccctctctggagcccaggcactcgtctgtgcacagtggtgggaggagcatgccgggtgggtttcacaggtggctctcctggagagagagcctcttggcatgtctgacggagcacgcgtgctcagtggaacgtggtggttcaccacttagttgccaggcatcttggtccttgtacccaagtgcatgggtagccagggcccagcctgccccacttcgcctggaccccgtctgatttcctgtgctgcgtgtggaggtggaggttgagccttgagtattttgggggagaaggggctcgggcggggggctgtgttttggtttggtagagggctcactgggctctcgagctaaaccctggtgcttgccggatattcagcccagaaaatgcatgagaccgtcaaggacaaattatgccgcccataattagggtctccaggcagacataagaaagcctgatgcgggacatcatacagtgcccatgttgggatgcgaagccgcgaccgccttgctctaaaggttgcataggctactcatgccgctgggtgcctggacagcagcatggaacacaacgctccccgaatattgcaaatgttttctgtcttggcttgttacaaatcttcctggatgtgtaggccaccctggggacgagcagcccttcttagggcagaaaattcaccccacgggtgatgattcccacgctgggggtgtgtgaaccactctcacaaggaggaatgtcaatctcgtgagcgggcctgcactctcacggcattccgggcagaagaaccacatgaccatggaacaggagtcaccccctttctgtcacttgtcaacaaatgcggattttttttttttttttttttttttttcctcatatgtaggtagcatgcaccagggtgcgcctctggcggtgcctagggagaacgcgagaagaaaagaatgcaggaagatctggactgcgtctttagggttggcactgggactgtgagtgtcagaggtcctcggttttaacttttaactcccatcacatctcaactgtttccttgtcaacaaatgtgtgtccttttctcataagtgtataccatccacctcggggcccctccttttgtgccttgggacatcgggtgaagtaaggaacgcaggaactttggtgttgttagttttagtgtcagaggttcttgtttttacctttgaacatcaatcacgtctgaactatatcctgtcttcatctgtggttgcataggtcctcaggcacatacaagtatcttctccagtaatgacaagcttctgcctagacaccttcattcacaactgtttcccgtcatctaagcaaccctcaggaggtagttgttaagctttcacgttccctcctgttcatttttcttattgctttctctctgccttcccaatatttgctgatggagtgtgcgggatggggttgaggtgtgggcagcagggaacagggcagtctcctggcccaacagatctttgtgcagacgcggtacagacccgggatttaggggcttatgctttcttctggctggcgccttatcctgtgtgaggacacaggaggctactcacagggctgtcagctttccatatgatgaactctgctttccagtttactctgtaactcattgctcactctgattctttgtgtacttttggagttttcctcccttcacttttttcttcttcactgtctttacttttcgtccgcttctgtttatggaggtcacaatcagccaagaaggcagggtcagttatgcacggggacatggttaaggaaaacaggcttactgtttctaaggaaattagaaggactccagctgaaccctgcgaggagaagttggcatttccttattctttctgccgtgtctccatattgccatgggtggctgattacctcttttccctggtgtccgattcctccccgtttttcatctttttcttttgggtggttcttcactgccttggttttgtagactttgggcttggtggccccttgcagtcagctgatgacatcctcagggtaaggttcagcctacacttgtgtactctgtagttctgcaggccaatttgtggatcaaagttttgatcccactcaggaaagatcccatcgacaagaagcttctcgtttgtatgtcctttaaacgggaggtgacctggggctccttgtcactcattgtgtatgtcaccacacactgaggtcttccttaactagatccttcaggacagctacagtggcatggacctcccactttctgttcttgttctctttctggttattcttcctcttcctcctcctactcttttaattcctcttctcttttttgttttcttactcttcctcctccatcttctcctcctcctcctccttcttctttccttctcctcttcttttgcctcttcttcttttttgtcttttgcttttgcctctgcttctctttttcccttcactttcagatcaggacagacaagtgttctaggagactgcttcttcttttgctccttggtgattcagcatgtctctctgcagtactaggcctagagaaagcttcacttttgttcttaatttagcactgatgaaggtcaccagtttagtctctctggtataccaaaaaccttcccacatgttgcttttaagtgaaatgtcatggtgaacagatcctttacccagttcctcatggcttgctgttatttcctgttctgttcgtggatgcactaggtgtgtaatcctgagccattaggaagtttggcaagttgtcccgtgtctccttttttttcagtccagccatgtgaacacattgatccggatttcagtttttgcagggtgtctccgccacatgcccatttgcccactctcactcacagaggcaggcacccacagaccacagacacagacacaatacatacactcacaagggaccccccaatcagaaattaaatcacaaacacacacgcacatggagactcatgcacacacagacacaaacacacacattaaacacgcctaagcggacacacacacagatacacacagacacacacacacacacagaagtaagctcacactagtacaaatgtgcgggtttaagcattatcgtacacagacacacacaacacctcaggcacgaaactgcccacaatgtcttccactcgggctgtaaatggggctgtaaatggtggcgtgtggccctcaaactgaggcgggacaagagaggaactccttgctggctcttggcctgccctcattcctaggatggcggcctgtctccacagctgtatgtaagaaagggcagtcggggcggccagccatggcttcccctggcagtctccagaaactgccgggcatgagtcgcccaacactcaacacgccgaagctcctttgtttcctgggtggataggggctttcttgccccactgtggccccagccaagggcatcccagaactgcccacaaaagagaccagattaaacggccccattttctggctgtcagtggccagtggcttcccttatgcgtatctcaaaatggctgctggtgcagctccactctgtgggctgacgggtcttcaggctgcctggctgatctgtctcggggcctctagagtagctgcttctccaagcggttccaatggcaggtacgatttgttctagggctctaaaccccagtcggggaaaccctggcttaggcagagtccacccagtcccgcacattttcgcggatctctgtgcctggcagaaggcaagtgtccctgcagcctgttgtcatgttcagaaacaccttccgctggatggcactgtggctccacagatgacagtcacgtcttttccttcccttcccttgcctttgtctttctccatttgttgcgaacagaataaaacaaaaacacacacacaaagcgaagaaacaaagaaagaaacgggccaaagagcacccacctcatctacagcagggctccccacctacgtggtcactttgggggaaggtgcaacagtaggagcgttctctgcctccctccttcttctggattcttctctgggcaggggtcccagtgaaccagaggagcctatcctcaatacatcccacccttatggctgtggcatggtgggggtaggtcgcactgggggcagtgtgagtgggtacagggggagaggtgtgtggatgtgtggccctgcatgcaggctgctgcagatttctctaggaatgtgctcagctccccctaggcaagagaccaggccgtatgctgaggtgcacgacacttgtccctaggtagcactcttcctcttggggaagggaccaaatcttgtatggaatgcagtccggtccaacaggcttccgcacattgttgacccatggagcagcaaggagtttggctggatgtttgttgggatgggactggactggaaggactcctgttggaggccttcagctccctctctctctctggagcccaggcactcatctgtgcccaggggtgggaggggtattccaggttgttttacaggtggctgtcctggagagaaagccacttgttatgtctgactgagcatgcgtgctcactggaacgtggtggttcaccagttatttgccccggcatcttggtcattctgcataagtgcatgggtagccaggttccagacagtgctcgccttctcctgggcctgtctttgttcctgttctgcgtgtggaagtagaggtggatcctggaatgtgttgggtgggatggtggtagggcaactgtgccttggtttgatacagagctctctggggtcctcaagctgaactctggtgcttgcgggatattcagccctaaaaatgaatgagtcggtcgaggacaaattttgccggctctttagggtttccaggcagacgtaagaaatcctgacgcgggccatcatacagcccgcttcttgggatgcgaagccatgaccgcgttgctctaaaggttacatatgctacccatgccgctcagtgcctgggcagcagcatggaacacacagctcttcaaatattgcaaatgttttctgtctttgcttgttacaaatcttcctggatgtgtaggccgcactgggaatgagcagagtttcataggacagaaaattcatgccacgggtaatgattctcacactcatgagagtgtgaaccactctcacaagaggaacatcaatctcgggtgtgggcctgcactcccagggcattccaggaagaagactcacatgaccatggaacaggagtcaccccctttctgtcacttgtcaacaaatgcggattcttttttcacatgtaggtagcatgcaccagggggtgcttctgccccttcctagggacaaagggagaagaaaagaatgcaggaagatttggactgtgtctttggggtggcattgcgactctgagtgtcagaggacctcgtttttaacttttaactcccatcacgcttcaactttttcccatcttcatctgtgcttccatagttcctcagacaaatacacgtatccccacgcacactcacaagtgtctggccagacaccttcattcacctccgggtacagtcgtctaggcaattctcagggggcagtttttcagctttccctttccttcttgtttacctttcttgttgtttcctgtctggcttcccaatatttgctgatggtgtgtgcgggatggggttggggttggggcagtagagagcagggcagcctcctgaaccaacaggcctctatgcagtcgcggtgcagactcgggcttaaggggctgacactttcttcttgctggtggctctttttctgtgaggacacaagaagtcactcacagggctgccagctattcatttggtgcactctgcattccagttccctctcaacctcattgatttctctgattctttgtgtacttttggagattccctcctttcacttttttctccttcactgtctttacattttgtccacttctgtttggggaggtcaggagcagcctggaagacagggttgactggttgcggggacaccctcagggaaaacaggcttacttttcctaaggaaattagaaggactctagctgaccccgtgaggaaaaattggcatttccctcccctttctgccctctctccatattgccatgggtggctgattccctcttttctctggtgtctgattcatccctgtttattatctttttttttggaggtggggtagggggtccttccctgctttggccttgtagacttggtgctgggtggccccttgtagtcggctgatgacatcctcagggcaaggttcagcctgcacctgtgtcctctgtagcttctgcaggcccatatgtggatcaaagttttgatcccactcaggagagatcccattgacaagaagcttcctagttgtttgtcctttaaagggctgtgactatggctctttgtcctttgttgtgtacatcaccatgcattgaggtcttcctgaactagatccttcaggacagctacagtggcgtgaacctcccactttctgttctttttctgcttctggttcttcttcatcttcctccttctaatcctcatctttaattcttcttctcctcttttttatcctcttgctccttctcttccaacatcctcttcttctccttctcctcctccttctcctccatcatctcctccctcctccttcttctttctcctccttctccttctttctgcttcttctttttcttcttcttcttcttcttgtgcctctgcctcctcctcctttgcctcttctttttttgcttttgcttctgcttcagctttttttccccccttcactgtcggatctgggcgggcaattgttctaggagactgcttcttcttttgctcttttgtgatgtgtgatgttcctctgcaacattaggcctggagaaagcttcactttcattcttaaaggagcacagattgaggtcaccagtttagtccttctggtccaccaaaaagctgccaacatgttacttttaaatgaaatgtcgtggtgaatgaatgcccccttcacccagtacctcatggctcactattatttcccgttctccttctggatgctctaagtgtgtaattctgagtcattatgagatttgtcaagttgtcatctctctccttttttccagtccagccatgtgaacacattgatccggatttcagtgtgtgcaggcagggtgtctctgcacgtccatttgctgactctcactaacaaaggtaggcacccacagaccacagacacagacacaatgcacgcactcacaagggaacatgaaccagaaatgaaatcacaaacacacatgcacacagacacatgcacacacagacacaaacacacacgttaaacaagcccaagcagacacacgcacacacacacacaaacacacagaagtaagctcacactagcaaaggggcgtgggcttaagcattgttgtacacagacacacaccaccacaggcctgaagctacccacaatctcttccacatgggctctaaatgtgcaaaggggaacgggggacaaacaagcattcctggctgcaggtgtgggtcatcatgccatttattgggcaactaaggccttcttctgaacataaatgcaggaagtctgttatcagattggcccaagcagcaggtgtgaaactggagcatcctgggtcaagctgcttaaaaagggaccccactttggggtaggggtagataaagtccccttgggatccttgtccttgtgtgatgccatgagaatctggtgtgtggtggccttccccagccaacctgtgccaccctcctctcacccttgcctgtgtgaaagcagagtcagacttgagtgaggtgttgagtgtcccctgtgaggagactctggcctcaggccctgtagctgcctgttgagtgggtggccccagtggcccattctggtgacctccatttatgatcccaagttggcaaactctacctgcagttccaggccttgggaagtctcctagtctgggggcaaatccttgtataagacagccgagtggccagcgcctcgtcctggagctgcagccctatgatcccagtcctcctgtggtttcccagaggccatgataatgtgttctttgtcttttactttctgcacctgcgggagccatgaaacctagagaggaccaaaggaagggcaaaggctggctgcctccatagcattcccgcagggtctccaggctactggtccttggtgctagagtcccctgagtttggttgtcagcctgggaccaggtggcttgttcctttctcttctccttatcttttttatttttttctccttcctctttattcacatgggagaaggcagagaccatcagcttagagaagcaaggttatggttgtagttggcatttgtggagccatactgccatcaagtggaaactgtttctggaaatgggagggagctgggcacaagtgctggggaaagcccaggggcacaaaacagatggtggcatggggcccccagactgaagcaggatgagagaggagctcctcactggcccttggcctgggctcattcccaggatggtgccctggctccacagctgcatgtaagaaagggcagttggggcagcccaccatggcttcccctggcagtttccaggaactgccgggcatgagtcgccccacactcagcaccccgtagctcctttttttttttttttaccaggaagataggggccttctggccttactgtggccccagccaaggagggcaagctgtaactgcccacagaagaaaccagagtaaaccacttcattctctggctgtcagtggccagtggcttcccttatgcgtatctcaaaatggctggggggcagcttcactgtgtggactgactcgtcttggggctgcctggctgccctgtgtcagggcctctagagtaactgcttctccaaggggtcccagtggcaggcactctttgttctagggctctaaaccccagttggggaaaccctggcttaagcagagtccacccagccccgcacattttcactgatctctgtgcctggcagaaggcgagtgtccctgcagcctgttgtcatgttcagaaacatcttcctctgggtggcactgtggctccgcaaatggcagtcacgtcttttccttcccccaccttgccttgtctttctccatttgctgccaacggaataaaacaaatgccaaaaacaaaaagcaaagaaacaacgaagaaactggccaaggatcacccacctcacctacagcagggatccccacctacgtggtcactttgggggaacctgcaacagtaggaggttctttgcctccctccttccctctggattcttctctgggcagggtacccagtgaaccagaggagtctgttctcatgaaatcccacccttagggctgtgtcatggtgggggtaggttgtactgggggcagtatgatggggtacaggagagggatgtgtgagtgtgtgggcctgcatgcaggccactgcagattcctctaggaattggcccaggtccccaaagcaagagaccaggcctcatgatggcatgcaccacacttgtccctaggtagcactcttcctcttggggaagggacaaaatcttggatggaaagcagccaggtccaacaggcatccacacattgttgagccatggagcagcagggagttgggtcggatgtttgttgagatgggactgcatgggactgactcctgttcgaggccttcagctacctctctctctggagcccaggcactcataggggtccaggggttggagggattttccaggttttttcacaggtggctctcctggagagagagccacttgtcatgtcttactgagcgtgcatgctcactggaacgtggtggttcaccagttatttgccttggcatcttggtcattcttcccatgtgcatgggtagccagagcccagacagtgcttgccttctcctgggccctatctttgttcctgttctgcgtgtcgaaatggaggttgagcctggagtgtgttggtggggggtgtggtggagtgtctgtgcctttgtttgatacagagctctctgaggtcctcaagctaaactctggtgcttgccggatattcatccagaaaaatgaatgagacagtcgaggacaaattatgctgcccctttagggtctccaggaagacataagaaagcctcacttgggccatcatacagagcccattttgggatgcgaagccatgaccgcgttgctctaaaggttacatatgctacccatgctgcttgatgcctgggcagcagtatggaacacacagctcttcgaatattgcaaatgttttctttctttgcttgttacaaatcttcctggatgtgtagaccacactgtgaacaagcagagcttcataggacagaaaattcaccccatgggtattgattcccacactcaggggtgtgtgaaccactctcacatcacaagagcagtgtcaatctcgtgtgtgggcctctactctcagggcattctgggaagaagacccacatgactatggaacaggagtcacccccttttggtcacttgtcaacaaatgcagattcttttctcataagtaggtagcatgcaccacggggcacctccggccctgcctaggtacaatgggagaagaaaagaatgcaggaagatctgactgcgtctttaggagtgacatggcaactctgagtttcagaggtcctcgtttttaacttttaactcccattacgtctcaacattttcctgtcttcatctgtgcttccaaaggtcctcagatacatacacatctcaccatgcatactaacaagcacctgcccagacaccattcactcccagatctggttgtctaggcaactcttaaggggcagtttctcagctttcaggttccctcttgttcacctttcttgtcgctttctgcctcacttcccaatatttgctggcagatcgtgcggatggggttggggtgggcgcagtggggagcatggcagcctcctggcccaacaggcctctgtgcagatgtggtgcaaacccagtcttaaggggctgacgctttctcttggctggtggctcttcttctgtgaagccacggaaggccactcacaaggctgccagctgtccacctgaggcactctgcattccagtttgctctcaacctcattgctcactctgtttctccgtgtacatttggagttttcctcccttcacttttttcttcttcactgtctttacgttttgtccacttttgtttggcaaggtcaggagcagcctggaagtcatggtctactgggggaggggtcacccttagggaaaacaggcttacttttcctaaggaaattaggataactctagctgacccctgtggggagaaattggcatttccctcccatttctgctctgtctccgtattgccattggtgggtgactacctcttttccctggtgtccgattcatccccatttattatcttcctcttttttggggggtccttccctgccttggccttgtagacttggggcagggtagctctttgcagttggctgatgacattctcagggcaatgttcaacctgcacctgtgtcctctgtagcttctgtaggcctatttgtggatcaaagttttgattccactcaggaaagatcccaacgaaaagaagcttcctgattatttgtcctttaagcggaacatgaccagtggctccttgttcctcattatgtatgtcaccatgcattgacgtcttcctgaactggatacttcaggactactacagtggcatggacctttctgttcttgttctccttctgatttttcttcctcttcctcctcctactttttttctttaattttcctttttttatcctcttgctcctcctcttccagttcatcttctcctccatcttcttctactcctatttttcctcctcctcctccttcttcttcttattgttgttgttgttcttcttcttcttcctcttcctcttcctttctttctccttcttcttcgtcctcctcctcctctgtctctttttttttctttttaatttttttttctttgcttttgcctcttcttatgcttctctttttcacttcacttttggatttgggtgggcaagtgttctaggagactgcttcttcttttgctccttggttatgctggatgtctgtctgcagcactaggcctggagaaagcttcactttctttcttacaggagcacagatgaaggtcatcagtttagtccctctggtccaccaaaaagctgcccacatgttatatttaagtaaaatgtcgtggtgaacgcacccttacctcgtacctcatgggttgccattatttcccattctccttaaggatgttggaagtgtgtaatcctgagccattaggagctttggcaacttgtcctctgtctcttttttttccagtcaagccatgtgaacacattgatctggatatcagggtgtgcaggcagggtgtctctgccacgtgttcatttgcctactctcactcacacaggcaggcacccacagaccacagacacaatgcacttactcacaagggaccctgcaaccagaaataaaatcacaaacacatgcacacaaagagacacatgcacgtgcagacacaaacattcatgtcaaatacgcccaagcagacacacacacacacaaacacacacaagttaactcacactagcaaaggggtgtgagctcaagcattattggacacagacacacacaccccaccacaggcccaaaactgcccacaatctcttccacactggttctaaatgtgcaaagcagaatgtgagacaggcgagcattcctggctccaggcctgggtcatcatgccatttattgggcaactagggccttctcctgagaatgaatgtgggaagtctgttatcagataggcccaagcagcaggtgtgaaactggagcatcctgggtcaagctgcttaaaaacggaccctgcaaccagggtaggggcagagaaagtcccctcaggagccttgtccctatgggatgccatgagaatctgtggcacgtggtggccttcctcagcctccctgagccaccatcctcccaccccgcctgtgtaaaagccaagacagcctgagcagagtcagacttgagtgagttgctgagtgtcccccgtgagggagactccgggattctggtgacctccatgtgccatcccaaggtggtaaactctacctgcagctccaggctttggaggaccctcagttctggggaaaattgttttgtaatccagctgagtggccagcgccttgtcctggggtggcagccctgtgatcccagtcctcctgtggtttcccagaggccatgattatgtgtcctttgtcttttactttctgcactggtgggagccataatacctggagaggaccaaaggaagggcaaaggctggctgcctctacagcattctgcaggatctccagtctacaggtccttggtcctagggtcccctaaatttggtggtcaacctgggaccaggtggctggttcctttgtcttctccttgtcttttttttctccttcctctttacttttttcacatgggaaagcatggagggcctcagcttggaggggcagttgaggtagtagttggcatttgtggagccatactgccatcaagcggaaactatttctggaaacgggaggcagctgggcacaactgctggggaaatccgaggggcacaaaagagatggtggcgtgtggcccccagactgaagctggatgagagaggaaccccttgctggcccttcgcctgggctcattcttaggatggcaccctggctccacagctgtctttaggaaagggcagtcaggccggctgtgagcaagcagagcttcataggacagaaaatggcttcccctggcagtctccaggaactgccaggcatgagtcaccccacactcagcatcctgaagctccttttcctcccgggagggtaggggctccctgttccccctgtggccccccaagggcacctcggagctgcccacaaaagagaccagggtaaacagccccattctcatccatcagttgccagtggcttcccttatgcacatctcaaaatggctgctggggcagctccaccctgtgggttgactggtctgcaggctgcatggctgctctgtctctgggcctctagagtagctgcttctccaaggggtcccaacggcaggtacgctttgttctagggctctaaaccctggtcggggaaaccctggctcaggcagagtccacccagccccgcatatttttgctgacctcggtgcctagcagaaggcaagtgtttccgcagcctgttgtcatgttcagaaacaccttctgctggatggcactgcgactccacaaatggcagtcatgtcttcttcttcccccactgtgccttcgtctttctccatttcctgccaactgaacaaaaccaacacaaaaaaacaaaagcaaagaaacaaagaaagaaactgtccaaggagtacccacctcacctatagcaggtctccccacctacgaggtcactttgcggaaacctgcaacagtaggagggttctctgccttcccccttccctctagattcttctctgggcaggggtcccagtgaattagaggatcctatcctcaatacatcccacccttaggcggtggcatggtgggggtaggttgcactgggggcagtgtgagggggtacagggggaggggtgtgtgggtgagtgggcctgcgtgtgggcccctgccgattcctctatgaatctgcacaggtctcctaagaagagaccaggccgaatgctggtgcacaccacacttgtctctaggcagcagtctttttcttgctgaaaggttaaaagcttggatggaaagcagccagttcaaacaggtatccatacattgttgacccatccagctgcagggattcgggccagatatttcttgtgatgggactggatgggagggactcttgtctgagaccttcagcgacctctctcactggagcccaggcactcattcgtgcccagaagtgggaggggtatttctgggtgaatttcacagttggctcttctggagagagagccacttggcatgtctgatagagcatgcatgcttactggaacgtggtggttcaccagttagttgttctggcatcttggtcattctgccaaagtgcatgggtagctcgctttcacctgggcctgtctgtgttgctgtgctgcgtgtgaaaggagagattttatgtggagtgttttaatttgtggttgggcaattgtgccttggtttgatacagagctctctggggtcctcaaggtaaactctggtgcttgctggatattcatcccagaaaatgaatgagatggtcgaggacaaattatgccggccctttagggtctccaggcagacataagaaagcctgacgtggtccatcatacaaagcccatgttgggatgcgaagccatgaccgtgttgctctaaaggttacatatgctacccatgctgctcagtgcctgggcagcagcttggaacacaatgctctctgaatattgcaactgttctctgtctttgcttgttacaagtctttcttgatgtgtaggctgcactgggaacaggcagagtttcacaggacagaaaatttaccccatgggtaatgattcccacaatcaggggtgcgtgaaccactctcacaagaggaacgtcaatctcgtgtatgggcctgcactctctgggcattccgtggagaagacccacatgaccatggaacaggcttcacccgatttcttttaattgtcaacaaatgcaggtccttttttcatatgtaggtagcatccaccacgggcgcacctctggccctgcctagggaaaacgcgagaataaaagaatgcaggaagatctggactgtgtctttaggggtggcattgtgactctgagtttcagaggttctcgtttttaacttttaacccccattatgtctcaactttttcctgtcttcatctgtgcttgcataggtcctcaggcacatccatgtatccccacccatgctcataagtgtctgcccagacaccttcattcacacctgtgtctggtcctctaggccgctctcagtgggcagtttttcaggtttccggttccctcttcatctttcttgtccctttctgtctgacttcccagtatttgttggcataatgttcaggatggggttggggtgggggcagcggggagcagggcagccccctggcctaacaggcctctgtgcggatgtggtggagatctgggattatgggactgactctttctcctggctgatggctccctctctgtgagcccacaggaggccacttgggctgccagctgcccacctggagcactctgcattccagttcactctcaacttcattgctcactctgattctttgtgtagttttggaggttttctcccttcacttttttcttctttactctttttacttttcattcacttttgtttggggaggtcaggatcagcctggaagtcagggtcaactgggctagggaacacccttagggaaaacaaacttatttttcctaaggaaattagaaggaccccagctgatccctgcaaggagtgattggcatttccctttcctttctgccctctctccatattgccatttgtggctgattatctcttttccctgatatatatttcctccccgtttttcatcttcctctctttttgggggtccttccctgccttggccttgtaggcttggggctcagtggttccttgcagtctgctgatgacatcctcagggcactgttcagcctacacctgtgtcttctgtagctcctgcaggactatttgtggatcaaagcttttgatcccactcaggaaagatctcattgacaagaagcttctcggttgtgtgtcctttaagtgggacatgaccggtggctccctgccactcgttgtgtatgtcatcacacattcaggtccccctgaactagatccttcaggagagctacagtgtcatggacctcccacttcctattctttttctccttctgtttcttcttccttttcctactcctgctcctcttctttattgttcttttcctcctttcctcctcctcctcctccaactccctctccttcttcttctttttctttccctcttcttctttcttcttcttcttcctcttcttccccttccctccttctccttcttcttcttcctcttcctcttcttctctccttctttccttttcctcctccttctccttcttcttttcttctttgacttctctttttgccttctttttctttctctccttcttttctatttctccttctacatctttttttctacttttcttctccttcttcttctacttgttcttctttctttcctttttttttcacttttggatttctgcatgcaaatgttctagcagattgcttcttcttctccttggtgatggggaatgtccttctgcagctctaggcctcaagaaatgcttcacttttcttcttaaaagaacagcgatgaaggtcaccagttcagtccttcttttccaccaaaaagctgtcctcgtgttacttttaagtgaaatgtcatggtaaacacaccctgtacctagtaccttatagcccaccattctttcctgttctccttgtggactctctaaatgtgtaaacctgagtcagtaggagcctcagcaatttgttacattgttcccctattgcctttccttccagtcaggccaggtgaacaaaacgatacggatttcagtgtgtacagtcaggctgtctctgccatgtgccaatttgcccactctcactcacacaagcaggaactcacagaccacagacacagaacacatgcacacactcacaagaaaccccacaaccagaaatgaaattacaaaacccatacacacatggagatacatgcagatgcagacacaaacacacatgcagacacacacacgcaggcacactgacacataaagtcacacatacacaaccagaccaataaacaggtaacctcacatgggcacaggggttggggctcaagcattctcacacttagaggtaaacaaacacacaaagccacaggcatgagactgcccacactgtctcatacgggctcttaatctctgacaagcaatgggctatgggcaagcattcctggcttcaggcctgggtcctcatgccattgattgggcaacttggctttctcccaaaaatgaatgcgggcaatcttttatcagaaaggccacagcagcagatgtgaaactggagcatcctgggtcaacccgcttaaaaacagactcccctttcagatagaggcagagagagtcctgttgggatccttagccctttgtgatgtcatgggaatctgtggcaacgtggtggcctttttgagtccccctaagccacatcctcccacccctgcctgtgtgaaagccaggacagcctgtgcagagtcagacttgcacgagttgctgagtgtgctttctaagggatacacctgcctcaggtcctgtggctccctgttgagcagtctgcccgttctggtgacctccatctgccagcccaaggcggtaaactacctagagcctttgggaggactcctagtcctgcagtaaaaccttgtgtaagccagctgagtgaccagcaccttgtcttggaacggcagccctttaatcccaagcctcttgtgtcccagtgcccatgattatctgtcatttgtcttttactttctgcaggagcaggagacatgaaacctggagaaggccaaagaagggcaaagactggctgcctaaacagtattcctgcagggtctccagcctactggtccttggtcattgggacctgtgagttttggtggtcaacctgggaccagttggctcgttcctttctctccctcctgtctttttctcgttctccttcctatttgcttttttcacattggaaaaggtggaggccctcagggtggaggagcagggttacaactgtacttggcgtttgtggagccatagtgccatcaagtggaaattgtttctggaaatgggaggcacctgagctcatgtgctgaggaacgctcgggagtgccagacagatggtggtgtggagcccccaggctgaagctgggagaggaactcctgtctggcccatggtctatgctcattcccaggatagcgccctggctccacagctctctttgtaagaatggacaggcaggggcggcccaccatgggttcccctggcagcccccagagactgcttggcatgagttgccccaccccagcatcccaaaacttctttgttcccagggaggatagggtgcccctgtccctgcgtggccccagccaagggcacccctgaactctccacaaaagagaccagagcaaatggccccagtctcggcagtcagtgaacagtggtttctcttaaacccatttcaagatggggaagctccgcccactgggctgactggtcttggggctgccagactgttctgtccccgggcctctagcttagctgcttcttcatggagttccaatggcaggtacacttccttaagggctctgaaccccagtgggggaaaccctggcttgggcctagtctacccagcctggcacatcctcgctgatatctgtgactggaagaaggcaagtgtccttgtagtctgttgtcaagaaacaccttccgccggatggcactgtgactccacaaatggcaatcaccccttttccttcctccactttgcctttctctccttccttttgctgccaaccaaacaaaacaaacacacacaaaaaaaacaaagaaacaaagaaactgcccaagcagcacccacctcatcttcaacagggctccccacctatgtggttactttggggaaacttgcaacagtaggagtgatgtctgcctctcctaccctctggattcttctctgggcagggggtcccagtaatccagaggagcctatcctcaagaaatgctatgcttttgctgtggatttgtagcaccgggggcagtgtgagggggtaaagggggaggggtgtgtgggtgtttaggcctgtgtgtgggccgctgcagattcttctatgaatctgcacaggtctcctcagaaggagactggtgcctgcctagggaaaacataggaagaaaagaatgcaggaagatctggactgtgtccttaggggtggcaaggtgactttgagtgtcagaaatcctcatttgtaatatttaactcccatctcatctaacttttttcctgtcttcatctgtgcttctatatgttctcaggcacatacatgcatccccaccaatactcactaaaaggtgtctgcccaggcacctgtgctcacactcagatccccacatctaggtaactctcaatgggaagggttcttcagcttcccggttttctcttattcatttttgttctccctttctgtctggcttcccagtatttgctggtggagtgtgtgggatggtgtgggggtgggggcagtgtggagcagcgcagtctcttggctccactggcctctgtgtggacccagtacaaaccctggcctaagggtctgatgcttttctctggtaggtgactcttcttgtacgaaggcacaagaggccatttgggcagccacctttccacctgggatatcctgcatttcagttcactctcaacctcattgctcaccctgattctttgtgtacttttggagtttttcttccttcacttttttcttcttcactctttacttttcatcaatttctggtttagggagttcaggatcagcctgcaaaagcagggtcgggtgggcacaggaatgtccttagggagagtaagcctacttttcctaaggaaatcagaaggacccgggctgaaccctgggggtgtaagcagcatccccctcccctatctgccttctgtcagtgttgccataggtggctcattacctcctttctctggtatccatttcctccccgttttacatctctcctcccacccatttccggggtacttccctacccaggccttgtagattagaagcccgtggccccttgcagtgcgctgatgacatctggagggcatggctcagcctgcacctctgtcctctgtagcttctctaggcctacttgtagatcaaagcccttgataccactcggaaaagaacccatcaacaagaagcttcttggtgttgtgtcctttcaccgggacatcacaggtttctctttgcctcttgttgtgtatgccaccatgcagtgaggcacccctgaactaggtccttcaggacagctgctgtggcgtgaagctgccacttcttgttcttattgtctttctggttcttcttcctcttcctcctcctcctcttttttctttttctttttcttctactccttctccttctccttctcatttttctcttctttcttctctttttcctttcacttttggctcttggcgggtcaagcattatactgagactgcttcttcctctgctcctggtgatgcaggatgcccctttgcagaacaaaagtgagaaaggcctcatttgttcttaaaggagcagatatgaaggtcaccagttcagtccctctggtgttccacaaaggcgccaatgtgttacttttcatgaaatgtcaccatgaacccaccccttaacctgttcctcatggctcaccattctttcccattctctttgtggatgctctaaatgtgtaatcctgagccagcaggagccttggcaagttgtccccctttgtcttttctttcaatccagccatgtgaacacaacgatccagatttcagtgtgtataggcaggctgtctctcccacgtgcccatttgcccactctcactcacacaggcaggcacccagagaccacagacacagacacaaccacatggactcacagggaaaccccgacaaccacaaatataatcacaaacacacatgcacagggagatacacacacagacacaaagacatacactaacacatgcacactcacaaactcatagacacacacacacacacacacacacacacacacacacacaaatcctcacacaggcccaggggtgcgggctcaagcattcacccacacagacgcacacacacatgtgtcgccatagccaccagactgcccacgaactctcccataaaggctctcagtcggccacaggcaatgggctatgggtgaggattcctggctccaggcctgggtcattatgctgttgattgggcacctaaggccttctcctgagaatgaatgcgggaagtctgttatcagataagccccagcagccagtgtgaaactggagcctcctgggtcaacctgcttaaaaagggaccacaccttgggtagaggcagacagtccccttgggacccttggccctctgtgatgccatgggaatctgtgttgcgtggtggccttccccagttcccctaagccaccctcatgtcacccctcccccccaccccatgtgaaagccaggacagcctgcacagagtcagacttcagtcagttgctgagtatcccctctgagggagattcctgccacacgccctgtgactgcctgttgagctgttcgctcattttggtgacctccatgtgccagcccaaggtggtaaactctatctggagctccaggctttgggagaaccaccagtcctgcagcaaaaccttgggtaattcagctgggtgaccagcaccttgtcctggggcggcagccccatgatcccagtcttcctgtggtttcccagtggccatgattatgtatcatttgtcttctatttttctgcatgagcatgagccatgaaacctggagagggccaaaggaaaagcaaaggctggcggcataaagaggatttccgcagtgtctcctgcctactggtcctaggtcgtagggtcccttaagtttggtggtcaacctgagaccaggtggctggctcctttttatcctccctgtcttttttttgtttctctttcccttttctttttttcacattggaaagggtggaggccgtcggattggaggggcagggttaagcttgtagttggcctttgtagagccatagtgccatcgagcggaatctgtttctggaaactggaggcagctgggcatgagtgctggagaaatcccaggagcacgaaagagatggtggcggtgtggggcccccaggctgaagctggacgagagaggaactcctggctggccctttgcccttgctcattaccaggatggcacccgggctccacagccctctccgaaaaaagggcaggaaggggcggccctccatgggttcccctggccatctccaggaattgccgggcaggagtcgtcccgcccacagcaccccacagctccttggttcactgggaggataggggacctctggccccagcgtgattccaggcaagggcaccccagaactccccacaaaagagaccagtgtaaacgaccccagtctcggccgtcagtagtcagtggcttcccttaagcccacctcaagatggctgccagggcacctccgcactctggactgactggtcttggggctgcctggctgctctgtccctgggcctctagattagctgcttctccgtggggtccaaatggcaggcacacttccttcaaaggtttaaaaccgcgatgggggaaactctggcttagtcagagtccacccagcccgacatattctcgctgaagtctgtgcctgtcagaaggcaagtatccctgcagccggtcgtgttcagaaacaactgccgctggatggcagtgtggctccagaaatggcagtcacttatttcccttgcttttctctttctccttttgcttccaacaaaacaaaacaaaacaaaaagaaaagaaagaaagaaagaaaccggccaaggagcgctcacctcatctacagcaggactccccacctacatggtctctttggggaaacctgcaacatgcgaaaggctctctgcctccctccttccctctggattcctctctgggcaggggtcccagtgagccagaggagcctatcctcaagaaatcccacccttggggctgtggcatggtggggataggtcgcactgggggcaatgtgaaggggtatgggggaggggtgtgtgagtgcatgggcctgcttgtaggccactgctgattacttctctgaatttgcacaagcctcctaaggagaccaggctgcctgcttgtgagcactacgcttgtaaatagggaacacactgtttcttggggaagggacaaaagcttggatcaaaagcacccaggtccaacaggcatccatagattgttgacccttctagcagaagaaggtcgggccaggtgtctgtcaggatgagactcgacagattggacacctgtcccaggccttcagctacttttctcactggagcccaggcactcatccatgcccaagagtaggaggggtattctgggtggcttccacaggcggctctcctagagaaagccacttggcatagctgatggagcatgtgtgctcactgaatgtgatggctcaccagttaattccccgggcatcttagtcattctgccaaatacatgggtagccaggccccagccatgctcactttcgcctgggcctcctctgtgttcctgtgctgggcatggaagtgaaggttgaggctggcgtgtctttgcagatggtgaggtggctgttccttggtttgataccgagcactctgggctcctcaagctgaattctattgcttgtcagattattcagcctggaaaatggatgagacagtggaggacaaattgtgccaccccttttgggtctccaggcagaaatgggaaagccatgcatgggtccttcatacagaacacttgttgagatgcaaagctgtggcctcattgctctaaaggttgcatgtcttacccatgcctctcagtgactggagagcagcatggaacacaaccatctcagaatattgcaaatgttttctttcttcgcttgttacaagtcttcctggatgtgtaggctgcactgggaacgtgcagagctttagaggagagaaaattcaccctacaggttatgattcccacactcagaggggtatgacctactctcacgaacgtcagtttcatgcatgggcttgcactctcagggcattccaggaagaagggcaacagtaccatggaacaggaatcactccctttctgtcacttgtcaacaaatgtggatccttttctcatgtgtagtaatcaccatgggggcacctccagtgcctgcataaggaaaatgcaagaagaaaggaatgcaggaagatctggacagagttcttcggggtggcattgggagtctgaatgtcagaggtcctcatttttaacatttaactcccatcacatctcacctttttcctgtctttatctgtgcttccatacatcctcaggcacatacatgtatcctcacccatagtcactcaaaagtgtaggcccaggcacctcccgtaaaacctggatcccattgtctagacaactctaactgggcagggttcctcagcttccaggttctcttttgttcatctttcttgtccctatctgtgtggctttccaatatttgctggcagaggatgcaggatggggtggtggtgggggcagtggggaccagggcagcctccaggcttgccaggcctctgtgccaatgtggtgcagacctgggactaaggggctgactctcttggctgatggctcttcctcctctgtgaggccacaggaggccacttgggctactacctgtctacttggtacactctgcattccaattcactctcatcctcattgctcactctaattctttgtgtacttttggagtttttctcccttcactttttttttattatacttaaagttctggggtacatgtgcagaacacgcaggtttgttacatagatatagacgtgccatggtggtttgctgaacccatcaactcgtcacctacattaggtatttctcttaatgctatccctcccctagctccccaccccatgacaggccccggtgtgtgatgttcccctccctgtgtccatgtgttctcattgttcaactcccacttatgagtgagaacatgtggtgtttggttttctgttcttctgttagtttgctgagaatgatggtatccagcttcatccatgtctctgcaaaggacatgaactcatccattttatggctgcatagtattccatgatgtatatgggccacattttctttatccatcttatcattgatgggcatttgggttggttccaagtctttgcttttgtgaacagtcccgcagtaaacatatgtgtgcatgtctctttagagtagaatgatttataatcctttgggtatgtacccagtaataagattgatgagtcaaatggtatttttagttctagatgcttgaagaattgccacactgtcttccagagtggttgaactaattgacactcccaccaacagtgtaaaagcattcttatttctccacatcctcttcagcatctgttattttctgactttttaatgatcaccattgtaacgggcatgaaatggtatctcattctggttttgatttgcatttctctaaagcccagtgatgatgagcttttttatatgttcattggctgcataaatgtcttctcttgagaagtctctgctcatatctttcgcccactttttgatggggttgtttttttcttgtaaattggtttaagttctttgtagattctggatattagccctttgtcagatgggtagattgcaaagagtttctcccattctgtaggttgccttttcactctgatgatagtttcttttgctgtacagaagctctttagtttaattatatcccatttgtctattttggcttttgttgccattgcttttggtgttttagtcatgaagtctttgcccacgcctgtattctgaatggtattgcctaggttttcttctaggttttttatggttttaggttttaggtttaagtctttaatccatcttgagttaatttttgtataaagtgtaaggaagggttccagtttcacctttctgcatatggctagccagttttcccagcaccatttattaaatagaaaatccttccccatggcttgttattgccaggttcatcaaatattaggtggctgtagatgtgtggtgttatttctgaggcctccattctgttccattggtttatatatctgttttggtaccagtatcatgctgttttggttactgtagccttgtagtgtagtttgaagttaggcagcgtgatgcttccagctttgttctctttgcttaggattgtcttggctatttgggctcttttttggttccatttgaactttaaagtagtttttttctaattctgtgaagagagtcaggggtagcttgatggggatagcattgaatctataaattaccctgggcagtatggccattttcatgatattgattcttcccatccatgagcatggaatgtccttccatttgtttgtgtcctcttttatttcattgagcagtagtttgtagttatccttaaagaggtccttcacatcccttataagttggattcctagggattttattctctttgtagtaattgtgaatgggagttcactcatgatttggctctgtgtttgtctgttcttggggtataggaatgcttgtgatgtttggacattgattttgtatcctgagactttgctgaagtagcttatcagcctaaggagattttgggctgagacgatggggttttctaaatatacaatcatgttatctgcaaacagagacaatttgacttcctctttttctaattgaataccctttatttctttctcttgcctgattgccctggccagaacttccaatactgtgttgaataggagtggtgagagagggcattcttgtcttgtgccagttttcaaagggagtacttccagttttttcccattcagtatgatattggctgtgggtttgtcatgaatagctcttattgttttgagatacattccatcaatacctagtttattgaaagtttttagcatgaaggctgttgtatttgtcggaggccttttctgcatctattgagataagtgtgtggttttttgtcattagttctgtttatgtgatggattaagtttattgatttgaatatgttgaaccagccttgcatcccagggatgaagccgacttgatcgtggtggataagctttttcaaatgctgcctaaaatcctctttctttgttgtgtctctgtcaggctttggtatcaggatgatgctggcctcataaaagttggggagttagggaggattccctctttttctattgtttggaatagtttcagaaggaatggtaccagctcctctttgtacctctggtagaattcgtctgtgaatccgtctggtcctggactcttttttggtcagtaggctattaattgctccctcaatttcagagcctgttattggtctattcagggattcaacttcttcctggttttgtcttgggagaaggtacatgtccaggaacttatccatttcttcaagattttctagtttatttgcatagaagtatttatagtattctctgatggtagtttgtatttctgtgggatcagtggtgatatcccctttatcattttttatcacatctatttgattcttctctcttttcttctttattaggctggctagaggtctatctattttgttgatcttttcaaaaaacgagctcctggattcattgatttttttgatgggtttttcttgtctctgtattcttcagttctgatttgatcctagttatttcttgccttctgctagattttgaatttgtttgcttctgcttctctatttcttttaaatgtgatattaggttgttgattttagatctctcctgctttctcttgtgggcatttagtgctataagtttccctctccacactgctttaaacgcatccctgagattctggtacgttgtgtctttgttctcattcattcaaggaacatatttatttctgcctttatttcgttatttacgcagtagtcattcagatgcaggctgttcagttttcatgtagctgtgcggttttgagtgagattcttaatcctgagttgtaatttgattgcactgtggtcttagagactgttataatttccgttcttttgcatttgctgaggagtgttttacttccaattatttggtcagttttagaataagtgcaatgtgctgctgagaagaatgtatattttgttgatttggggtggagagttctgtagatgtctattaggttcacttggtccagagctgagttcaagtcctggatatccttgttaattttctttctcgttgatctatctaatattgacagtggggtgttaaagtctcccactgtttttgtgtgggaatgtaagtctctttgtaggtctctaagaacttgctttatgaatctgtgtgctcctgtattgagtgcatatatattgaggatagttagctcttcttgttgcattgatttatttaccattatgtaatgtccttctttgtctcttttgatctttgttcatgtaaactctgttttatcagagactaggattgcaacccctgctttttttggctttccatttgcttggtaagtattcctccatctcttttgttgagcctgtgtgtgtctttgcatgtgggatgggtctcctgaatacagcacaccaatgggtcctaactctttatccaatttgccagtctgtgcttttaattggggcatttagcccatttacatttaaggttaatattgttatgtgtgcatttaatcctgtcgttatgatgctagctggtttttttgcctgttagttgatgcagtttcttcatcatgttgacagtctttacaatttagtatgtttttgcagtggctggtactggttgatccttccatgtttagtgcttccttcaggagctcttgtaaggcaggcctggtggtgacaaaacctctcagcatttgcttgtctgtaaaggattttatttctcctttgcctatgaaacttagtttggctgaatatgaaattctgggttgaagattcttttctttaagaatgttgaatattggcccccactcttttctggcttgtagggtttctcccgagagacctgctgttagtctgattggcttcccttgtaacccaacctttctctctgtctgcccttaatattttttccttcatttcaaccttggtgaatctgacaattatgtgtcttggggttgctcttctcgaggagtatgtttgtggtgttttctgtatttcctgaatttcaatgttggcctgccttgctagattggggaagttctcctggataatatcatgaagagtcttttccaacttggttccattctccctgtcactttcacgtacaccaatcaaatgtagttttggtctttccacatagtcccatatttcttggaggttttgctcatttcttgttactcttttttctctaatcttgtcttcttgctttattttattgagttgatcttcaatctctgatatcctttcttctgcttgatccattcagctattgatacctgtgtatgcttcacgaagttcttgtgctgtgtttttcagctccatcaggtcatttatcttcctctctaaactggttattctagttagcaattcatctaaccttttttcaaggttcttagcttccttgcattgggttagaacatgttcctttagcttggaggagtttgttattactcaccttttcaaggctacttctgttaatttttccaactcattctctgtccagttttgttcctttgctggtgaggagttatgatcctttggaggagaaaaagtgttcggtttttggaattttcaacctttttgtgctggtttctccccatcttcatggatttatctacctttggtctttgaagttggtgaccatcagctgaggtctctgattggatgttctttctgttgatgttgatactattcctttctgtttgttagtttttcttctaacagtctggctcctctgctgcaggtctgctggagttttgctggaggtccactccagaccctgtttgcctgggtatcactagcggaggctgcagaccagcaaagattgctgcctgttctttcctctggaacctttgtcccagagagacacctgccagatgccagccagagctcttctgtatgaggtatctgtcagttcctactgggaggtgtctcccagtcaggatacatgagtgtcagggattcacttgaggaggcagtctgtcccttatcagagctcaaacgctgtggtgggagatctgctgctctattcagaggtaccaggcagggacgtttaaatctgctgaagctgcacccccaactgttccttcccccaggtgctctgtcacaaggaggtgggggttttatctataagtccctgactggaactgctgcctttttttcagagatgccctgtgcagagaggaggggatctggagaggcaggttggccacagtggccttgctgagctgcggtgggctccacccagttcgaactttccagcagctttgtttacactgtaagggtaaaactgcctacttaagcctcagcaatggcatatgccactccccccaccaagctccagggtcccaggtcaagctcagagtggtgtgctagcagcaagaatttcaagccagtagatcttagcttgctgggctccatggggttgggacccgccgagccagaccggttggccccctggcttcagcctcctttccaagggagtgaatggttttgtctggctggacttctgagtgccactgaggcatgaaaaaaaaacaacttttgtggctagcttggtgtctgcccaaacggccacccagttttgtgctagaaacccagggccctggtggcatgggcactggagtgaatctcctggtctgcgggttgtgaagaccatgggaaaagtgcagtgtctgtgctggagtgcatggtatagtccctaatggcttcccttggctaggagagggagttccctgacaccttgcactttcttggtgaggtgacacccctaccctgctttggctgaccctccttgggctgcacccactatccaaccagtcccagtgagatgaacctggtacctcagtttgaaatgcagaaatcacccatcttctgcatcgatctcgctgggagctgcagactggaactgctcctattccaccatcttgccagcttcccacttttttttatcttcactgtctttacttttagtccacttgtggtttggggagggtcgggtgggcacaggcacatcattagggagaacatgcttacttttcctaagaaaattagatggatcctggctgacccctgaagtgcataatcagaatccccctcctctttctgccctccctattgccataggtggctgattacctctttttcttggtgtccggtttctccccatttttcatctctcctcccatttccagagtccttccctcccttggccttatgtactagggacttgatggccccttgaagtgtgctgatgatattcagagggcaagattttgcctgtacctttgttctcttttgctcctgcaaggctacttgtggatcagagcccttgatcccactcagaaaggaccccatcaatgagaagcttttcagtggtgtgtcctttcacccggacgtcactcatatctctttgtcacttgttgtgtatgtcaccacgcagtgatacacccctgaactagatctttcaggacagctttggtgacacgaagctgccacttgttgttgttctttttctcctctttctttcttcttcttcttcctttttcctttcactttcagctctctgcgggacaaatgttctatcgagactgcttcttctgctcattggtgatgggtgtgtccccttgcagcaccaggcctggaaggaggcttcactttcatttttaaagaagcagagatgaaagtcaccagttcagtttctctggtgaacaatgagaacacttggacacagggtggggaacatcacacaccggggcctgtcttgctgtgaggggagggggagggatagcattagagatatacctaatgtgaatgatgagttaatgggtgcagaacaccaacatggcacatgtatacatatgtaacaaacctgcacattgtgcacatgtaccctagaacttaaagtatatatataaaacaccacccaggagttacttttaagtgaaatgtcatcgtgaattcatggatttcccagtacctcttggctcgctgtttgtccccattctttttgtggactctgtaaatgtccaatcctgagccagtgggagccttggcaagttgtgtcctgttgcctttctttccagcccagccatgtgaacacaacagcgatccacatttcagtgtgtacaggcaggctgtctctgccacgtgcccattttcccactctcactcacacaggcagatgcccacagaccacagacacacccacacacgcactcagaagggactccacaccccaaaacataatcacaaacacacaagcagagaaacacacaagaaacttgacacgggcacaagggtgtgggcccaagtgttcccccacacagacatgtacgcacatgcacccccacaggcataacactgcccacaaactctcccatacaggctctgaatcaccacttgcgatgggcatgcttttttgtctccaggcctgggtcatcatgccattgattgggtaacttgggcgttcctttgagaatgaatgcaggaagtctgttatcagataggccccagcagttggtgtgaaactggagctttcttggtcaaactgcttaaaaacttacactcggaaaggatcccatcatcacaaagcttcttggttgtgtgttttttcacggggatgtcactggtgtctctttgccactcccgttcattgtcattgcttcttctcagtctgattcttttgtctttttttttgtttttcattttttattttcactgctttacattatttttaacataattggtatcagtttcagtttttttcttttgtgtttttcaatttgttcttttacttttttatttagtactttcagattgtaattgatttttgcattttctttctatcaatttttctggaccgaaggtagtcattttaggtggtgaatttttcttcttcccagtggtggattcatagtgatatcttatcttcttttaatttcatggtttttgagtctttttttattgagttgtttttgagtggttattgaatggctttattgaatgttatatgaaatattttttctccatttattttactctgtaacttttttttttcgtggcttatcagggcatttaagaaacagttttattaaagttgattatatatcaattagggattattaagtcattattttaagaagatcatttctcttttgcatcatatgttttaattttcttttgcttattgtttaagtgacccaagttatgaaccacatttttttttttttttctgagagggagtctcgctctgttgtctaggctggtgtgcagtggtgtgaccttgactcattgcaacctccacctcccaggttcaaccgattcttctgcctcaggctcctgagcagctaggactacaggtgcatgccaccatgcccagctgattttttggtacttttagtagagatggtgtttcaccatgttggcccggatggcctccatctcttgacctcgtgatctgctcacctcggcctcccaaagtgctgggattacagacctgagccaccatacctggtgaaccacatcttctcttccgctgttcaccttagactcttgatcatattttggggtatttctttttttttttaatttgatcaaatgtgatagtaagaaatgtcatattttatgtgtcattaatagctaatagagaatatatttttggaatatatatttaacctttacttcattctataatgctttttacatttctgtcatatcttatacacaatttttactacactgagaaatttattcttaaagtagtgataaatcaactcattttaatataaattcatgattttatagactatatgacttggcttaaatagatctttctgagaaatcaggaaaatttgaaagccatcaataaattatttactctttgataatgaaaatattttaataaaaatgctaaaaacacttaattttaaaccaaaatacagtatagtatctggtaaagagatttaaacctatgttgcaaagatgattaaaatgattcatacgcaatgaccctttatagagattcatttaaattaaaatttatttttctacatcaaaatgaggagatcatcatgactaagaaattttggattactaaattcttaaaaaattgtccacttttaaaattctattaaggtacaataaatcaaacatatactatgttttctttatcatttatagaaatttaaagtatgataacaggtatttcttgttgaggtgattagcttgtctctcatacattggtgtttggagaattgtttactgaaacatttgaaatggtaatccacaaattgtttaacttttttattataccatctgagaatatgtttgcatatttgtgaaaacaattggaaactgtctcagttatgttcattttgagaattactatgttttggtggacacatttgctggaattttgtgcagatatttttaaaatatttaagtttatgtggttactatgagatattattaaataaataaaacatgttcggagtaatgtgtataatacaaactcattttttgtaacaacaaacagaaagagttacatgttggtaagtatatgtgtctttgattggttatggaaaaaattattaggcatttattccatacttttaacatcttttaacctccacagatttagaattgtttttctggaagaaattgttaatcttctcttttatacatttcatgttgttttcctcattttaatgccttcgtattatatttctaaatataattttcttttataaaacatgcaaattttatacgaagaaaaacagcataagtaaacttaaagactatttatatacaatgtggttccatttaaaagatagataatggatgccattaattcatagaatatataatacatttctttatgttaatacagaaacaaagcctgatagaaatatagtcaaagaacaggcaattcataggagacaaaaatatatggccaataataataataaatatagttgactttaatattaggtcatcatatttgccacaatcaaaaaagtctccagaattctcagttttagaaaggatttggttaaatatctactgtctataaaattgtacgtttctaaagtattttatctctatcgtaattttaatgtttgtaagttttgacttgtgttttatttgtagaatatatggaaataattctacatatcaataaattggcttgcttgtagtaaaaatgttgcaagcatattaaatatctttcaacagaatttgaacatctttcaacagttaaaattatactgtaacacgatgcaatattttgaagccattgaaatattgagactgatctatttttatattaaaaattattaagacatttataagtgaataaaaacaaattgccgaagtgtatgctaggatgatctaatttatattataaactccaaatctaaattattatattattataaatactatatatgtgtacatttaaatagaaataaaaaggtctagacagaattgataactatgttttcttctgtaaataggagaaagactgaggaatggtaaaagtttagcagtaagaagaattatgtctatgttgtttgaattatatacagttagattgtattcatgtatttattcatgtattatttgtgtaaataaataaataaatataaaatttccaaggaatataggagtttgtcaaggggctatgagggaacaatgaggctgattgattagttttggaagcctaataaaacaagagtaatagcggtagacatccctgtactttttgggggagaaatatgcctaagataatagaaacatctggtccacctaacagataaattattttgcattcaaatacattagataccaaaaagatgcaggttattgacattgtatgcctttgatttaatatttattaagcactcatctaataattttgcattctctttaacttgcttaatagggaaattggggtgttttctgctcaacagacatatctgacctgtatgataatggaatttctcattataagtcaataaacttttgttctttctgtatctttcagtcttatgatgtaatcagcgcgatttcacttcctgaatttcgatgaattctaagacat

SEQ ID NO: 4636 - DNA, 89121 bp, human
gctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccaggtcagattctttctcatctaggacatctaggctctttgaaacttatttatgcattctcacaaatttccttccccttttccctgttctttccatgatttcaaaatagaaaaaataacatgcagggattaagcagctctttcacaaaatatgcttgaatgaaatgatggatatttaacgacattaaataattatttgtaatattttagatgaaataattgtagttatattttctaagaaatagacttgaatcttttgatttgcttgaaagtaagtcattggtgccaaggtggagggaaagtgtaataaaaatgctcatgagttgataatttaaagctgggtgatgtatatgtagggatttattatattattctctctacttttgcgtgcattggaaaatttttttgttaaaaaaaaaaaggctggttcaaggccaataaaaagcatctgttgaaggccagccttcagaagtgtatgtctttctctgtgtaaggcaggagagttgaatttttttttttaaagctacaatgtgatagtcaaatccaagtgccataatgtttgcttgttcaaggtattcaggaagggtggaggatggaccaagtcactgcctggtagtaatcatgagccatcaaaaaggaggagtaggggggcggacgcggtggctcacgcctattatcctagcactttgggatgccgaggtgagcagatcaggtcaggagttcgagaccagcgtggccaacacggtgaaaccccgtctctactaaagttacaaaaattagccaggcgtgatggtggacgcctgtaatctcagcaactcgggaggctaaggcaggacaatcatttgaacctggaaggcagaggttgcagtgagccgagatcgcgccattgctctccagcctgggcgacaatagcaaaaaactacgtctcaaaaaaaaaaaaaaaaaaaaaaaaaaaaaaaaaggaaggaggaactttgggtgggccttaaaggttgagtgacatctgccatgtggaggggcagggaatgcttttcaggccgagggtttccagagaaaaggcagaattcttctggaaacagcttggctataattttgaatctacaagaaggactaggaggtgaagataaagtgcttcagggccttaaatgttatgctgagcatatacttcattccaatatccatcaagtgctactatttgtattttaagattcctattcttactatcagaaaaggaatctctgatatttagatgaactttatagaatgcaaattataaaactgaatctgacccaagttttatagatccttttaattcaaaggagagaagcatcttttcttcattcgtgcagtaaacctttatgaagcccttgcaatgggtaggaattattctgagagctgtaggggatggatggccaaggcatagtgcctagtacataataggagtgaaacagatatttcaataaataaatcaatgaatgatgggacaactttggcgaccaaaaaagttttagacattgggtttggtggtaatgcatagaaaaaaaaaaatagaaatctattttacttgaaagcatctccctgtcattccatacagttttacttctcacatgtttacctctattcaaaggggtagtggagtggaaggttgcagggagtagggagaaaattgctcagatagaaaacaaaagagcagccgggcgcagtggctcacgcctgtaatcccagcactttgtgccgctgaggtgggcagatcacctaaggtcaggagttcgagaccagcctggccaatatggcgaaaccccatctctactaaaagtaaaaaaaaaaaaaaaaaaaatagccggtcatggtgttgtgtgcctataatcccagctactcgggacgctgaattaggagaatcgcttgaatccaggaggcagagattgcagtgagccgagatcatgccactgcactccagcctgggcgacagaccgggactcggtgtaaaaaataaataaataaataattttaaaaaataaaaaggaaaaagaaaagaaaacaaaagaacaaaacaataagtgcagtagctacataatttcccctccaagtgattcaaatcactgataattgtaataatagccaatatttactgaagatttatgtgccaattttctaaagggctttgcatgttataatttatttaatcacaactctactagagaagtttgtatagaccaagggaagttgtatgacttgccacaagttacacagcaagaagtagctgagctgagctttgaacccagaacacctgattccagagtttatgctctaaacttctatataatacatcccttctaatactatgtatacaactgttttataggaataaatcattgaaatagaggtatgggaaggataatgatttgaggagaccaagggacaaagagatggacaaaaacagaaaaaatgatgccacaatattttttactatttttcagtctttgagtgattgcagtatgactccatttccctggtgcattcatataatagttcacctggtgaaaacaatgaagattatttacaatgctaccctgctttttctggtgtcctgaacctggaagttgtgctttttaaggtaatctctttaccaaaaattattaagaggaggaagagaaaaaaaagagttggttttgacacattaaaaagtagccaaacaaaactcaaaaagatagcagcaaatgataaaattgaaactatattctacattatatgaaaacatattcataataatagtgtaatctgaagaaatgttttgttagattcacttgtacttatagtttctattattactgtgaaatatatcatctttttaactacattttctaattgtttctagtaaatgggaacatgattgatatttttgtatatttattttatatgctggagccttcttaaattctgtttattctaataatgtatagattttcttggattatctgttaattaattatattttgaataatgacagtttctttacaatatttctttaccttatattactgtgctagctaggatcttcagtacaaagaggaacaacagcattggtagaggatttccttattttgttcctaaattctacaaaagtttcaccttttttagtagattgtctttctcaagttaaggaactttcttaatgttcctagtttgctgagaggttttattacaaatattatgaagttttttcccgtctatatgtactgccactttcatatcctttcttcaccattaatatcacagtgtgaccatgtgataaattacaataatcaattttctaatgtatttcttgcttttgctttcatcgagcctcgtcattggatatttggttcctattttaatcattttgacttttatttttatattgaactttcttctactttccttttattgttctttttctaatttattgagttgaatctttagcatcttaattttcaatgttcttctgtaaaataagaatttagaactataaattttcttctaccactttagaaatatttcacagacttttatatatagtatttttatcattcaatatttattatttttaaatttctcttatgatttttttgacccatggtttgttttttttcaatttctaatcatatgggattccttttttaaaaaatatattatgaaatcattacattattcccattctagtttaactttatcttatttttcttttttaattttttttacatctatagactttattagatgttctttatacagtcatctggtatgtataaagagtgaacaatcatataaaaggaaatatggtcataactgattgaattaataaaatcctgaaactaaataactcataattcattgcacaacatatattaggtttcattagatcagtatatagcttagtagtaaactctcctgatggccataaacctctaaggtgttgtcatcctgaaaaatgaaggaggggagggagctggtggggtgcagaatggagaaaccttccatagtgctggtgtgatgtaccctaagttgtaaagttatagggcatcgccacctagtggcagaatttcatgccttgttctaattaagggactttccttgttttccaaagagcaatgtgtcttgttcactttctaaccatccctctctgatgctgtccttcctaaaatccatgcctcctcccatacagtgtaaacccatctgcttttcatccatcaagctgtcaaggatttggttatgacaatttttatgttcacctaactttttagttccaagtacttcggttattttcaaagctacacacaggatgcccatatttttataactccatcttatttgtgaaggattattactttgtgctttggcctagtttttattcttactgctgaatcttttcataagttaaagttattgcagagttaatgctttaaaaggcagtccttagagtaaatagctaaatgaaatcattaccaaaatgtacactttggatttattaagattctagaatttaaaaacaggaaaaggtgccattagtgaaaattccatcactaacattttggtaccactcgtagagcatcacataaatattcagaccgtgataactcagtgcaggaatgttatcaaatatgtccatgcaatctggaactaggaccagagttggcaattgggggtctgaaggcccaacatcccttacactgcttcctacaccttgacaacaggaaggctgagtgatactaggtagtgcactacaacagtgaacataagccagccatctgttttttgcaaagtataataaaatagaaaaacagaacatagaccacttcagagcaaacaaacatatccttcttcaagatgtaggaaaaccatatattcaaaaccaatctcaaactttaaacaataaaagatatcaaacattttaaactgtacaaagcaaattagcaagattttaatgttggcagttttaaaatgtcacccatccaaaacacaaaacagggagataaccaagtcttagctccatcctaatcaaagctgtcatgcagatccagttccactcttctcatctccagcaggtacttcactcaaggaggtaacacccaaggggagtagatggaccaaaaacaagagtgccacatagaaggaagagaggggaccttggactttagctactggttagctattcaactttgatgatattcagtgttttcccaagttattttttctcgcttctcatcacataatttacattatgcatactatgtgccagagactgtttgacatgtagtcagttaattttcacaactgtgtaaagttggtttctatcattagctctatcttagggccaaagaaactgaagcacggagaggttaaattgtattcctaaagcactacacagtgagcaaatagattcagacctgtgcagtctaacccagaattagctctgaatcactctaccattctgtctacaggacaacaagcctgtgtgtttcaggtactttcatggtgatttttcacacaggacagcttttgataatagaaaggccctctctttcaaatgaaaggacttcactgatggattaacaaattctcaccttttcacctatgtgagccaaatactagatctactttcttagtcttcataacaagcaggacgataaccataatttataatgaacacaaaacattgatatagtgttcaaagaacttttgcacacttggtctcgtttggaagaatgaagtaatctggaaacatagaataggcatacactgtgactttaggaagaactctcacaaaatcagaggttgccctatgtaatatcacactttttaccttgagcaggtggatagcctgggagttcttgttatacctcaatcttggtccattctatttgttcccctgtccttcagcagtgcccttaggcttgctttaaacattaacagcattcataagcatggtttctagggtcagagcccagcctccctccacccacccggctccctacacaccttgacagtgctctttgagatgcctcagttctagtctccttgtaattgtgcacagtagatgtctgaacaaatagaccagagtcctgcaaaagtgatcttgaaatcacaattaaaagagactttggagagatctactcaggaaaattttctgaatagacaaatgcttttaaagggggttctagacagtccgtcttttctgcctccttctgcgaagtagggctacactaaaaccttgtcacaatgtgacctgagcaaaaccattatcaagtgatttagttgtcttgaaccagacaaaagaaaattgacatgatttcaagataggtttagaaaaataatctgactagcaaaaaaaaaaaaaaaaatggggggtggttcctagggaatatgagacttgatattttagcaaaaatttaaatatgctctttatgatacacacatttctcgttgctttacaaattttaaatgtaacacaaatttgtttttcacactgttttgttagttgaggtaaggcattcctgccgcacgcagcaatgactcgtcctggaaaaccagggaggctgcatatcctactgttccttctctactagctgtggctccacactctcacctccaccaaagaaagcatttcagaatttaggggtggaaatgatgacaacattgaataattctatttttttcttttttttgagacagagccactgtcgctcaggctgaagtgcagtggcgcaatctaggcccactgcagcctccgccccccggggtcaagcaattctcctgccgcagcctcccaaacagctgggaccaccggtgcccgccaccatgcccggccaattttccgcatccctagtagagacggggtttcaccatgttggtcaggctgatctcaaattcctgacctcaggagatctgcctgcctcggcctcccaaagtgctgggaccacaggcgtgagccaccacgcccggccaatgattctaatttatatttttaaaaattaccttataatcttaaaacttttaactgatgagtatccaacccttaaactttataacaatcatttccaaagtggaaaagtcactgggatatggggaaaagtatgatttgtttttgtacttctatttttctaatgtctactttttgttttctagtctacatgttagcacaggagtatatatattacttaagtatacctatgttggagtgcatacagaatttctttttaaatgataggatgcaaaatcaaatctatttggatagcagtgaagaggctgtttttcaatcctggcaaactagggggtgcatacccccttttttatttagtagcttccataaggctataactcatggaagttacatccttacataaactgatgggctatccaaccagtgaggaaaactgataaagtggcctctgagctccaggaagtagttaaacactactaaaaacatcttgaaaatttggaaaaaaatttaacagtaaatggattcagtagttattcagtataaggtttggaataactccagccattacaatagacatttatttaaagtaaaacatctgcagaccaaataattcttaaaattgtttgtttcaagtttaaccatcttcataacagctgcatccacagacttcaactacatgattacttctttgcccattcttctctttcttttctttcccgaataacctcttgcacatacagttcaaggtagaaattttcctcttcatatttggtccactgctctttaggcaagatctgatgcttcatggtcaggtccaatgcactcttaatgtgacacatcctgtcattataaaggttctcaggaagccttcttatggcttcttttatgtcttcatcctcatatattgtatcatctctcattaaccccagtttattgaatcctgcagtattgtaataccattttcgaataccatccagccacttgcctgatgctgaaatggcctgcttgccagccattttgacctgctttaattttttttaatccttcttataacaagatacaaaaattatacactggctgctcatcccaacagaatttggcaatataaaacattttctttcattaaatacatagaaaaagtgtggttattgatatttattgatgtagttattattgaattttatatttgtgtttttaaaatttttatttttatttaatttcacacttgaaaaaccaggaatattacaaagaactcccagaatgtcctttacccagattcaccaattaacattttatcacgtttgccttatcattctgtttttctcttcctctcctccttctcctatttgacagtagtttgcaaatatcattctcctttacctcttaatatgtcagtgtgtatttcctcagaatgatgatttcctcttatacatcctcagtaaatgtgtcacaatcaagaaatttgacattgtttcaatatcataatctacgccatattccaatgttatcagttgtcccaataatgtcttttgtggttattttctttccttggtcaaagtgctaatccaagatgatgcattacatttacttgtcatgtctcttcagtttttaatatggaacaattccttgacctttctttgtcttttatgtttatagaaaaacaaacttagtttctctcattatattctcacaaccccacttctgacactgattgtgtggaaaaaaagtttttctttggctcttgtaccacagcaaccaacacagaaagcttgtgaacaaatgtattgggattttttctcaccgacaggcaagtaaacaattctgcagtggacaccagctgggtgttctccaatccaattcaattctgaagctatctccctacagaaagtatcagatcccacagattgagggcttagtcccacgagactgcctcaactttagacatcagtttcaaatctgggcctctggaacttttaactgaccagcttcaagttagggttcccgcaacctctctctttaggctcaaataatttgctagaacaacacacagaactcagggaaacacttacttacatttacccattaacagccagatgaagagatacatagagtgaggtctggaaggctactgagcacaggagcttccattcctgtggagttagggtgtgccaccctcctggcatgtggatgagttatttgtcacctttctgaaatcctccacaaattcagctgtactttgtcctcttgtgctttttatgaagactttatctgataggcactaatgaagcatgaacaaccatgtagaaatgtgactggactaaagggtatgatctaataccaatagacttggtggagaaacccagcaaggcttgtctgttcagattcttcttggtttctctgtgcagcattccttcctcctgggtatggggcaggactctttctgaaatgggagtcttatgacccacagtcaaactaggtaggtcagagaatttctttacgaccagctccaagccagaaagctgggtgaagattagagtatatttttagtttctatggcttgcctttgggagaaaaaaaaagcaggtaaaaggagggcaggagaaagtcagagagagattctgttttgtgaagcctaaagtgccccaacattatacatatatatgtgtgtttgtgtgtgtatatatatatatatatatatatatgtatgtatatatatatatttttatatatatatatatagagagagagagagagagagaaactgtctctcacttttatttctctgaagctgtttcaaagctgcttcaggaaccaaagacaaaagaccaaatactttaacaagagatatgcttatttctttagtcacttaggaaataacaagagatttgggagttataagccaggaaccatggacaaaaaccaatatatatatatcacaatatcacacatcgacaattgacacttgggtaaatacaggacacttatttcatagattgtcctttaatttaaatttgtgtgccatttccccattattcagagtacgcatattagcaaaagcaccacagaagtaatgtattgttctcagggcatcataatggtggtacatgatgctggtttgaccctttagtagtaaagttaactttgattacttggttaatgtggtgaatagttgctagattaatccactttacagttatcattttcctctttataattaatgattttgctggggatactttgagactatgtaaatatcctgttcctcattaaattatcatccactggttttcaaatccattgataattcttgactgaatcagatattgctatgatgaatgcaaaatggtaattttcaaactccatcatttttagtacatttattagtttatattctacatcaaggtagagctttttctccatttatttgtttattaattactttggacacatagatttttactttattttaaaaataccctattgttattatttattttaatacccaaattgtctcagatttagtgactggctgcccattcaagttggctcccctgtcttttgacatgtgtcatcattcttaaacacactttttacttactttaaaatttttttacttccttactttcaagcttgtcttgtacttcctaccccattaatcatttctctatagacctctgttatcttttatggagacagtatttagaaactaagtcattgtatatagctgttttttagcttaacattttgtcattgttttccatttaaaagacaatattgcttatgtgataatgattatttagtgtttgttgaaacttgctttatgtcctagagaacatgatcaactagtgttttatgtgtgcctggaaagattgtgtatctaatttttgcgtgtagtgttctgttcattaaatttaactgtgttgtttaaatcttctctattcctaagttttttgtttgctggacctatcagttaccaagagagttaaaatctcccactgtatttgtgtatttgtcaaattcttacacttttgacaatttttgctttgtatacttgaggcattgttagtatgtacatacaagtctagaatagatacatattttacaattttaggaactctttttatctttttgaatgtaaattttttttgtttgctgggtctttttaattttgtaaaatctttctgggtacctagtagttgtatacatttatggggtatatgagatgttttgatacatgcaaagtgtaataatcacatcatgtacaatggggtatccatcatttcaagcatttatcctttgtgttacagacaatttaattatacagttatattattattgactatagtcaccctgctgtcctatcaaataataggtcttattcattctttttgtatacccgttaaccatccccactctcccccaccacccattacccttcccagcctctggtaaccatctttctactctccatctccatgagttcaattgttttgatttttagattccacaaataagtgagaacatgtgatgtttgtctttctgtgcctggcccatttcacttaacataatgatatccagttccatccatgctgttgtaaataactagatctcattcttttttatgactgattagtactccactatgtatatataccacattttcttcgttcatgtatctgttgatgaacccttaggttgcttctaaatcttagctgttgtaagcagtgctgcaacaaacatgggagtgcagatatctctttgataatactgatttcctttgtttggggtatatacccagcagtgggattgctgggtcatatggtagctcaatttttagttttttgaggaatcttcaaatcgttctccattgtggttgtactaatttacattcccatcaacagtgtacaagcattccctcttctccgcattcttgccagcatttgttattgcctgtcacttggatataagccattttaattgaagtgagataatatcccattgtagttttgatttgcatttccctgatgatcaactacaatgagtactttttcacatgcctgtttgccatttgtatatcttcttttgagaaaggtctattcaaatctttgtcacaattttgatcaaattattagattttttcctattgagttgtttgagctccttatatattttggttattaatttcttgtcaaaagtgtagtttgcaaatattttctcccattgcacctatactttatagactgtttgctttgctgtgcagaagctttttacttgatgtgatcccatttgttcatatttgctttgattgcctttgcttgtggggtattaattaagaaatttttgcccagatcaatgtcctggagatttttcccatattttcttgttgtagtttcatagtttgaggtctttgacttaagtctttaatacattttgatttgatttttgtgtatggcaaaagatagctatctagtttcattcttctgcatatggatatccagttttcccagcaccaattattgaagagactgtcttttccatagtgtatgttcttggcacctttgtggaaaatgagtttgttaggtgtgtggatttgtttctgggttctcagttatctttcattggtctatgtgtctgtttttgtgacaataccatgctgttttgattactgtagttctgtagtataatttgaagtcaggtaatatgattcctccagttttgttctttttgcttaggatagctttggttattctgggtcttttgtggctccatataaattttaggattgttttttctatttctgtgaagaatgttttttgtatttttataagtattgcattgaacctgtagattgctttttgtggcatggacgttttaacaatattgattctttcaattcatgaacatggactatctttccattttttggtgtcctcttcaatttctttcatcagtgttctacagtttttattaaagagatctcccacttctttggttgagttaattgctaggtatttaattttatgtttggccattgtaagtggaattacttttaaatttctttttcagattgcccaatgttggcatgtggaaatgctactgattttcgtatgttgattttgtatcctgcaactttactgaatttatcagttcttatagtttttgtggaatctttatgcttttccaaacacaagatcaaatcctctgcaaacaacggtaatttgacttcttcctttccaatttggatgcccttaatttctttctcttgtctgattgctctaactaggacttgcagtactatgttgaataacagtggtgacaatgggcgtccttgtcatgtttcagatcttagaggaaaagctttcagtttttccctatttggtatgatactagctgtgggtctgttatatatgggttttattatgttgaggtatgttccttctatacccatttttgaaggtttttatcatgacggcatgttgaactttatccaatgctttttcagcatcaagtgaaatgaccatatggtttttgtcctccattgtgttgatactatgtatcaccactgttgaaccatccttccatcccagggataaatcccacttggtcatgatgaataatctttttaatgtattgttgaatttgatttgctagtagtgtgttgaagatgtttgcatcaatatttatcagagatattggcctgtttttttttaatttgtttctgtctgattttggtatcaggcctcatggaattagtttggaagtatcccttcctcctgtatttttcagaatagttcaggtaggattgatattagttcttctttaaatatttggtagaattcagcagtgatgccatcaggtcccaggcttttctttactgggagactttttattatggctttttattggtcttttcaggttttggattatcttcatggttcagtcttgatatgtcatatgtgtagaggagtttctctatttagtctagattttccactttattggcatatagttgctcatagttgccattaatgatcctttgaatttctgcagtatcagttgtaatgtgtcctttttcatctctggttttatttatttggatcttccctctttttttcttagtctgggtaaaggtttgccaaatttgtttcacatttcaaaacaccaactttttatttcatttacttatttattttgtattgttttcttcattccaatttcatttatttcggctctggtgtttattatttcttttcttcctctaattttgagtttagttttctcttgcttttctagttctttaagattcattattggtttctttattttaagttttactttttttttatttaggcactaaataactaaacttatatataactaaactttatagctataaacttccctcttagtactgcttttgctttatcccgtaggtttttgtatgttgtgtttccattatcatttgtttcaagaaatttttcaattttcttcttggtttcttcattgacccactgcttattcaggaacatactgtttaatttccaggtatttgtatagtttccaaaattcttcttgttattgatttctatttttattccattgtggtcaaagatgcttcatattatttcaatttttttgaatgttttaagacttgtattgtgacctaacatatggtcatgtgacctaacatggtggctttagagaatgatccatgtgctgaggaaaagaatgtatattctgcagccgttggatgaaatgttctgtaaatatctgttaggtccatttggtctacagtacagattaagtgtgatgtttctttgttgattttctgttcggaagacctgtccaatgtttccttgctgttaacatagctactccacctttccttttttggtggtatttctttttccattgttttactcattcacttttttctttcttttatcttttacaaaatgttctgccaaaaaatcaatgcattgatttgtttgtttctgaatttaccaatagaatttataattagtattaaggataagctttatatatccaaacattatctttctttactaattttttattttatagaatttaaactctacagaaaagtcaaaagatatctttcatgtattgtagtgccattcttttccaagggagatacattccaaaatccccagtggatgcctggtaacatgaagagtaattaatcctatataaactatgtttttttcctatacatacatatgtatgataaagttaaatttataagttaggcacaatacaagattaacaacaacagtaataaaatagaacaattattacaatattcatagtttcatggatagaagactcattcttaccataggtcttagcaacttcaacacatgatttttttcttcccttattaagttgaaaacttcctccttttcacttaaaggaagcattttacagcttctctttagcatatgtgaactgccagcattatcattcttgcactttggggttactattaagtaaaataaggattacgtgaacataagcactgtgatactgcaacagtttattggataaccaagatggctagcaagtgactgatgggcgggtaaggaatacagcgttgatgtgctggacaaagggatgattcacatctggagcaaacatgagatttcatcacactactcacagtggtgtgaaatttaaaacttatgagtcgtttatggaattttccatttactgttttcagactgcagttaatcatgggtaactgaaactgtggatgaggggggaccactttagattcatcagggcatcaatttggctacatatggcttatctctttttctaaatactatatacatatatgtatatatacatacacagatttttttgctgagccattgggaagtaacttgcagatatcatgacacttcaaccctaaacactaaatcatatatctcttaagaacaattaaattactattacacccagagaaatttaacattgatacaatactattatctaatatactatccatatcaagttctcacaattttcctaacaatatcctttatagctttttatttgttttggtccaggatccagtcaggggtcatgcattgtatttagttgtcatgctcctttttagtctttttaaatctagaatagcaccctccctttttttttcttgtcctttttttgtgacgttgccatttttgatgagtccaggtagttttcctctatatgtctcacagtatgaaatgtgtctgattgttttcccatgattagtttaagcgtttttagcaagaagactacatgggcgatgttctgtccttcttaggcacaaaattctagtttatcccaagagcatagatacctttggggattttacagatagctaggtgggtattttttacttcccccttaagaaagttacttttctggacacgggtcaaattatggtttataatttgcaccatattccatgtctaggttacctgtttacagaaatgctcagcatgaagaggagtttctatatctgttctgccatcacattttcctacttcagagcatttacttagtccggttggttgtctgtctgtgtattcacaaactttcacaatcaactcaatagggaataaagttttttttttcagcagcttcatgtgcagtctccttaagtactttttcctatgacttggtcacttttctccctctcattgtataaagactttctcatactactctatattgatcatttttaagaggcaaatatgatatgatcgagttcctctcctgttattcttacctcctgacatgttatcatagcatctgggtcttctgtctctgggaagataagccagattttattgcatggattctgtattagttttatatttctaccataacaaaatgatcacaaatttagaaatttaaaagaacatatttattatagttctggaggccagaagcctgctatgggtctcatcagacctgatgagaagtcaagctgttggctggctgcattcctttctagaggctctggggggatatgtcctgctcatttggttattggcagaattccgttccttgccactgtagatctgagatctgtagatctcagttccttgccactgtagatctgtagatctgagatccctttcttgctggctatgagctaagagctgttcctagcttctagaggccacccaaattccttagattgtcatctcttttctccatcttcaaagccaaccatggcaaattgagtccctctcatacttagaatttctccattttcttttgtcattacatctttcactgactcagatgatatgcttttaaagatatatgcaattagagtatgcccacccaaataattcagaatattctcccccatctcaagatccttaacttaatcacatcagtaaagttccttttgccttgtaaaataacatagtcatggattcttgtaattgtggtgtggacatctttgggtggccatcattttgcctaccacagattttattatagcagcaagccataacctgacaccgagtgtgtgattcatccattcttttattcaaccaacacaaatattaaagaatgcctattaaattgagcatgtattaaattccaggcattgttttatgtgccagggttacaaaaatataacatctaactcaccaaggagttcataaactggtttggtaagttctgtagatagagattggcacagagttctataagagaatacaagaaggcacatgagcaagactagaagagccaggaatggcctcctgtattgatcaatatctaagctcagtctttgaaatgaaatgaggtactaagtaaggatggatgattgtagatgggtaaagaacttcaagcagtgagaaaataatgaccaaagttacagaactcgaggtaggctggtttttggaggaggtgagatgtatggtaggtagttttcctggagtggagagatggagctagatcagcaagctgaagcataaacatgaagactttgtgcactacaaaggctcaagatagatctgtaggaaatgggatgtgactgacaatcttgaaagagagtgctgtgttcacatttatattttatataggtcatactagtggccatgtggaggatagtatagtagagcaagattggggtaagaagatcatttaagatgcttgtatgaaaatcccgacaaaaagtgatgaaggcttgaactcagccaatggtagttgggatggagcacagatcagtgaatttgagaaagttttatgaagtattattgattagatggtgtatcaatcagggttcaaccagagaaatagaaccagtaggagatatatattaagaaatgtattataaagaattggcttgtgggggctgtgtaggcaagcctgaaatctgtggagtgggctttcaggaaggacagactggaactcctggacatgggctgaagctgatgtcctcaggttaaatttattcagggagaccttagctctggtcttaaggtccatcagctgattgaatcaggtctacccaaattatttaggataatctcctttacttaaagttaactgattatagacagtaatcacatctacaaaatagcttcacagcaaaacctagttaaattgaataactgaggactctagcctagccaaattaacacatcaaaagacaatcacagatgggatgtcaagggaaacagaataatagagggtagttctcaagtatgtggcttgagtattacatgaaatcactaactgagttatagaatacaagaaaaagagcaggttttcaacattttcagtaagatacctagatggaggttcctggcaagcaggtaaagatctgagattgcaagagaagtgttgtccatataaatatatttagataaccatcagcataaaggtgatagataaaaccaggagagtaaattaaataatctagaagaaggtatatatagagaaaagttatggattgagaaggaaattctggggaccactaacatttaaggattatctagagaaagatgaacagataaaggagtaataggatgagggggaaacctgaaaaagtctgatgccgattaagaaaaatgtagtgaacagcaacataatatacattagagggttcagtactgaaaaatatttattaatttgtaaattaagtttattggtgaatttagcattaacggtttccgtgttgtgagagcagaggccagattacagtgggttgaagagttactaggaagtgccaagttgagggtagctggcatacgagatgggatgagaatggaggataaaaattggacaatattttataattaaatgataactgtaagaagattaagagccaagggagtattaaaaaataatggtaggaacttgcagttttattgacttaaagtaacaagaaaaggggtagagactgaagatataggacataagagaattcaaagttactgagaaataaaagaaataggcctggttgttagagagggtgcagtgacaagagaaggacttgttttattctttggataagactagggtattggtactcaatggaggtagtataatcctgagagggtgattggaaagtttgtgaaaggcatttaagataatcattattgaagtgcttcctgacatattgtgggcagggtcagtattgctaaataacctgcaatatgcaagacagcctgcacaatgaaattttctatatcccatacaacttttaaatatatcatcagattaaacacttatttttgttaatctagaccttgaattgaactccattctatatatatataagcaagtttttaatacacactaacttttccaggaatgtaactaccatgtaatccaaggtaaaaacctttgttttgttcagaatcttatcaagaatgtttatcattttggaaaatcgtgatacctacaaaaacgctgctcttggatatttgaaatccagataacaacacacatgcatcagtcagtaattatagctgccacctttacaggcattctctgtatattttttgcatacttcattgtcttctagtgttgtcatgtccccacatttgcatcctttttttttttttttgagacagggtctcactctgacacccaggctcgagtagagtgtcacagtcccatctcactgcagcctcgacctcccgggttcaagcgatcctcctgcctcaaccccccaagtagctgggaccacaggcacatgccgtcatgcccagctaatttttgcgtttgttgtagaaacggggttttgccatgttacccaggctggtctcaaactcctgagcttaagtgattgtccgattcagcctcccaaagtgctaggattacaggcatgaacctccatgcctggctgcacatttacgtcttaaaatacattatattttattataaattactttcttgttatttctatttcatattatagatgttttgaaatttttatcttaatataataaagcattaaaatatttaagaaagggagccagatagaattggaaaccattggcacaggagaaataagataagaatgagtgaaaatgccgatttttaaacaacaatgaagagatttgtgagaatggctaatgcattatgctttgtggaagaggttaccatagttctaattcccaaatccaatgactggattttgggttttatcttgatccttctgcaacgtttaaaattctctgctttcttccattctacaacattcttctcttctagttctccttttacatatctggccattgtttctaactatttttttctgagtacctcctcagcctagatccttaaattgagtggttcctgaatcttcctatttcaatcctcacttcttcttggcaatctcacccactgtcctgggttaaataaaaaaaatatatgcagacgacttccaaatctgtatttctagcacaagctttatgccaggctcaaactcatatagtcacctgcctgctctttctgtgtgattgccttatcaccttagactgaatgttaccaaaactgaactcttcatcaccccaccagcagcaccacaaacctctttattctttattgtttgtactagtacttctaaggcaaaaactagggtatatgtcatgtttcttctctcttacctccactttttaatctgtcaccaagtcataatggttatttcttcaaaatattccatgattttttcttctatctttcatttccaaaactctagtcccattccccggtttggaccctcaacatttttctcctgaatgacaataatagttttctaactgatctcctgcctccagtactgtgtactgactcttggcacagcctttagaatagcctctaaaataaatatctgatcacattgctcccctacttaaaatcctttaatgattttttgcttcctatgaaaatcctttaatgatttcttgctttctatgataatgtctaaagtcttagcatgacctaaaagattctgtatggcatacctcttaatcaagccttatctgttgccaccaattcctacacctcatcccaaactcacacaactttttttttttttggattttatgtgccactagggttttcttgaacatactattatttcatgcagatttctttgtacatttgactccctctaacatctttacacccttgtttacctagtgaacttcattcttcaaattcctgctcatttgtcatagcctcaatattttttttcctcatcctctgtcttcagcctctaaaaataattgcttcctctttactatttctgtgcctggtatttgtctattattgcacatgtcaaacaataacttggtgaatgtacattgaattctcagtgtagtacctttccatctggttgattaggaattttaaaaagaattacaatgcacaacagaagttacttcatttgtttctaggtttttgctttttatggtggtataagtcatagtaaagtacataaatcttaagtatatagctcaatgaatttgtacatatacttatatactagtgtaaacaacacctagatcaaaatataaaacacttccaataccctagaaagcacatttgtgtccttttcaagttaacattcacaaaaagtaaccactattctaacatctgtcaccattgattagtttcgcatattcttgaactttatttaagtggaatcacagaatatgtactctttttaaaattttaactattattttacttgtaggggctacatacgcaggtttattacatggatgtattgcactgacatccattccctcctgcctctagtaatctgcagtgtttattgctcccaagtttatgtccatatgtgttcaatgtttagatcccacttataagtgagaacatgtggtattaggttttctgtttctgcattaattcatttaggattatggactccagctccatccatattgctgcagaggacataatttcattgttttctgtggctgcatagtattccatggtgtacatgaaacacattttcttcatccagtctaccactaatgggcacctaggttgatttaatgtctttgctattgtgaatagtacagtagtgaacatacgagtgcttgtgtctttttggtataatgatctatttattatcagttatgtatacagtaatgggattgctggatcaattggtagctctgttttaaaaatttctttgagaaatctaaactgctttccacagtggctgaactaatttacattcacaccagcaatgtatacgtgttcccattgctccacagcctcaccagtagctattgttttttgactttttatagtagccatcctgattggtgtgagattttttttattgtggttttgatttgcacttcacaagactgtactcttttgtcagataggtttttatttgaagccttatcagtaccttagaactctgctgcaccctaatgatatctgtgaggaaagagatattgaaacagctcttgaggggatgctccaagaggaaggcaagacttcaacaactctttttatttttattttatttatttatttttttgagatggagtctcactctgttgcccactctggagtgcagtggcaagatctcagctcactgcaacctccacctcccaggttcaagtgattctcctgcctcagcctccgagtagctgggattacaggtgcacaccactatgcccagataatctcttgtatttttagtagagacgggggtttcaccatgatggccaagctggtttcgaactcctgacctcaagtgatccacctgcctcggcctcccaaagtgctaggattacaggcatgagccaccgtacccagccagcaactattgaatcataaaaatcagaaagcctatgattatttggatgggtgtcctcacagtgaaatagaatgtttatctaatgtgttatctacttgaaggcaaaatgaaatatccagaaatttgaagagactgtggaagaagagatcttaaacgtttccaagaaagaaagggtgttaatttgaaattaactcagttctattcagtcaacacttactgaacacttgctgtgttaggcactatatgagacaaaggggacacccagattactaaaccatgcacctgttcttgaagactactcagtctaatgctggagacaagatctttctgtaaggaagaagctaaagctaggaagcacaaaggatagatagtgatcccagacacagaaggcttcttggaagatatagggcttgaattaaacttacattataaataggaggcattcaggtgaagaaagttagcaaggtatttagttttcagtcatgtgaatttgaggtacctgtgagacattcaagtgaagatgtccactagaatgtcagaaatataggcaaagaatgcagacttgaatgataatcagcatataggtgagagttgtcatcatatagatgagagttgaagccatgggaaagtgtatattgtgagaagaaaaagtggtcaagaagaaaattttgaagaacacaaacattgaaatgactgggagaggaagtgggtcctggaaaggaaactgaattgacaaaaaaaagtaaaaaaggtaagcagaaaatgaggattcctgaaacctaagggaagaaactatctcaagaaagagggtgtggttaacagtgtcaaatatttttataagagaaggatttaaaagcatccattggtgatggggacagaagggaaggaaaaaaaaacattgagtctatcaaaggaggtcctgtattagtgactttggtaagagaagatttattggcatagaagggacagaaaaaagattgtagtggattgaagagtgcatggaggagtgtgaggaagtgggtgaagatagggaagacattgcttccaggaatttgagctgtgatgagtagcaaaaggggaagaaagttataataggaggggaacaaggttaaaggaaccatcttttaagatggaaaagacttaaacttgtttaaatgtcagtaggaaagatcaaataaagaggaatagctgaagagagaggaaaaagtgagtataatgaatagttcgaaggaagtgagattatatgggatccagagcagaggtggaagagtatgccttaggagaggaggagaattgaagggagaaataaacagttccacaataatagttggagacttaaataccttactttcaataatggataagacatgtaaacagaagatcaataaagcgatagtgaacttgaacagcactgtaaaccagtagatctaacagactgtaaagacctaacagcactgtcccatagacctaacaggcatgtatagaacacttcatctaacaacaggaatatacacatttttctcaagtgccatggaacattctccaggataggccatatattaggccacaaaacaagcttcaataaatttaaaaagatgaaagtcatacaatatcttctacaatgacaatggaaggaatctaaaaatcaataacagaggaaaactggaaaatcatataacatttttaataaatggttcaaagaagaaatcttaagggaaattagacaaaattgtgaaataaatgaaaatgaaaacatgccagaacttaagggacacagtaagatcagtgctcagagggaaatttgtagctgtaaatgtcaacattagaaaagcagaaagatcttgaaacctgactctacacctagaggaacaagaaaaataatagcaaaacaaacccaaaactagaagaaggaaggaaataataaagattagagtggagataaacaaaacagagaatagaaaaacaataaagggaaaaacaaaccaaaagttgatttttttgaaaatatcaacaaaattgacaaaacgttaccaaatacctgaaataataagtaaatcagaaatgagaatggagccacatatctacaaccatctgatctttgacaaacctaacaaaaacaagaaatggggaaacaattccctatttaataaatggtgctgggaaaactggctagccatatgtagaaaactgaaactggatcccttccttacaccttatacaaaagttaattcaagatggattaaagacttaaatgttagacctaaaaccataaaaaccctagaagaaaacttaggcaataccattcacgacataggcatgggcaaggacttcatgtctaaaacaccaaaagcaatggcaacaaaagccaaaattgacaaatgggatctaactaaactaaagagcttctgcacagcaaaagaaactaccatcagagtgaacaggcaacctacaaaatgggagaaaatttttgcaatctactcatgtgacaacgggctaatatccagaatctacaatgaactccaacaaatttacaaggaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccgtctcacaccagttagaatggaaatcattaaaaagtcaggaaacaacaggtgctggagaggatgtggagaaataggaacacttttacactgttggtgggactgtaaactagttgaaccattgtggaagtcagtgtggtgattcctcagggatctagaactagaaataccatttgacccagccatcccattactgggtatatacccaaaggactataaatcatgccgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcataaggacaaaaaaccaaacactgcatgttctcactcataggtgggaattgaacaatgagaacacatggacacaggaaggggaacatcacactctggggactgttgtgaggtggggggaggggggagggatagcattacgaaatatacctaatgctaaatgacgagttaatgggtgcagcacaccagcatggcacatgtatacatatgtaactaacctgcgcattgtgcacatataccctaaaacttgaagtataataataataaaataaataaataaataataaaatggttaaatttataatatattaatttatccacagctaaataaaaaacaattaaaagatccatttggaaaaggatacaccctattaaagtaagcctgatacatgaaacaacagctaaaaaagaaaaaaaaaaagtaacacaattgacaacctaaataaagaaaatacttacactgaaagaaaacataaacaagaccaagatcaggttataaaaaaagagttagtgtataatgtacttaaaaacattgcctctgtcaatgaataaaaagaataacatattagcgaagtgcattaaggaaggcaacagacgaataggaaaaataatgtgcaagatttagtaaataaatataggaaaactaaaatggccaggcacagttgctcactcctgtaatctcaatgttttgggagggcaagctgggcggatcacttgaggtcaggagtttgagactaggctgtccaacatggtgaaaccctgtctctacaaaaaattagcggacttggtggtgcatgcctataatcccagtgaatctggaggctgaggcatgagaatcacttgaaccaggaggcgggggttgtagtgagccgagattgcgccactccactccaccatgggtgacaaagtgagactctccctgaaaaaaagaaaagaaaagaaaagaaaatgaccctagacacattttagtatttacataatgtaaattatttaacacaacagtactgattaaactgtaataacaacgataaataatattgactggcttttgataagtataattctcaaatatgatcagaattagaatatattgctaaagaactttaggaaggtgttaattgaaaattctaattgtgagaattcagtgtccacaagagacatgttctatttcataatacattaatatatttccttatattagatttttctgaaggtttgtagaagtgcatcttgtactctgcagaggaataggatgacaaatgaactcagggttaattggaataattttaaaatgcacgttgattaaataagaaggcagcattgatttcacagcaactatatataactattcattgtggtttcataaacaacaaaaattgtaaccactaaacacactaattctgggcatcccttccttcgcttcgtgcaccatcaattcagtggccctttgcagtgagcacttgacatccgaaaaacaaaagaaaacctaaaaaacaaaatgaggaaccaactaaggtacacccttctcacttcagcagggctccccccacttgaccacattggggaaacctgcaaaagtaggaggattctctgcttccatcattccttctagattattctctcggaaagggaaaaagaagagaagagaagggaaagagaagggaacgggaggggaggggaggagaaagggagcggggaagggaaggtttgtcttcaaaaaatccaaccattggggctgtagcatggtggggggagcttgtaggaaggaaggaaggaatgcttgtcttcaaaaaatacaaccactggggctgtagtatggtgaggggagcttgtatttccgggaaacaggggaggtgtgtgtgggtattggaggagggtggctacagaatcctctatgaacctgctcaggtctcataaacaggaaaacaagccacttgcttgtgtgcaccacacttgtccctaggcagcacactccctcctgggaaagagatcaaagtttggattaaaagcagccaggtccgctaggcatggtggcccacacctgtaatctcagcactttgggaggccaaggtgggcagattgcttgaggccaggaatttgagaccagcctggcaaatatggtgaaaccctatctctactaaaattacaaaaattagcatgtaatctcagctactttgggaggctaaggcaagagaattgcttgaactcaggagacagaggtttcagggagccgagattgtgccactgcactccagcctgtgtgacagagtgagactctgtctcgaaaaaaaaaaaaaaaaagaaagaaaaaaagaaaggcagccaggtccaacaggcatctgcacattgttgacccatccagcagaacagggtcgagaaaggcatctgtcgggatggggcaggacaggacgagacagactattgtctgaggcatttggctacctctctgactggaacccaggcactcatatgtgcccaggaatgggtgggatattccggatgggttccacaggtggctctcctagagagacccacttggcatatttgatgatggagcatgcaggctccctggaacgtgatggctcactagttagtacccccggcatcttggtcattctgctgaagtgcatgggtagccaggcccccggcagtgctcagtttctcctgggcccctctgtgttcctgtggtgggtgtggaagtggaggttgaggctagagtgtctttgagggtggtggggcagctgtgccttgatttgatacagagctctctgggctcctcaagctaaactctggtgcttgccagatactcagctcagataatgaatgagacggtggaggacaaattattttgcccctttagggtctccaggcagacatgcaaaagcctggtgcagggccttcatacagagcccatgttgggtgcaaagccatgaccccgttgctctaaaggttgcatgtcctacccataccgcttggtacctggagagcagcatggaacacaatgctctcagaatattgaaaaggttttctgtgtctccactgagggatactcctgcctcaggccctgtggctgcctattgagccatcagcccattctggtgacctgcatgtgccaggacaatgtggtaatctcaaccaggagctccaggtttacataggcccccagtccttgggtaaatccttgtgtaagccagctgggtggctcccactttctcctggaatggcagccctatgatcccagtccacctgtggtgtcccagtggccatgattatgtgtcctttgtcattactttctgcactagaagcagccacaaaacctggagagggccaaaggaagggcaaaggctggatgccgaaacaggattcccacagggtctccagcctaccaggccttggtcattgggacccctgagtttggtggtcaacctgggacctagtggctgttttctttttctccccactttttctctttctccttcctatttttttttttcacatgggaaaaggcggaggacctcggggtggaggagcagggttacagttatagttagtgtttgtggagccctactgccatcaagcagaaacagtttctggcactgggatacagctgagcaccagtgctggggaaagcccaggagtgctaaacagatggcgacaagccgtccacaggctgaagcaggaggagagaggaactcctgactggcccttggcctgtgcttattcccaggatggcgccttggctccacagctctctctgaaagaaagggcaggcaggggcaccccaccatgggctcccctggcagtctccagggacttccaagcatgaatcgccccgcccccagcaccccgaagttcctttgttcccagggagaataagaaccccttggccccagcttggacccagccaatggcaccttggaactccccacaaaggagaccagagtaaacagccccagtctcgaccatcagtgcccagtggcttcccttatgcccatcacaagacagggtgtctctgcccactgggtagactggtcttgaggctgccgggttgttctgtcccagggcctctagagttgctgcttctccatgaggtcccaatggcaggtacacttccttcaagggctttgaaccccggtggggggaaaccctgccttgggctgagtctacccagcctggcacatcctcactgtttgttgtctgtgcctggaagaaggcaagtttccttgcagcctgtagttcagaaacaccttccactggatgtcactgtggctccacaaatggcagtcaccccttttctttcccccaccttgccttcctctccctccttttgctggcaaccaaacaaaacaaagaccagaaaacagaaactggggctgggtgcggtggctgacgcctgtaatcccagcactttgggaagccgaggcaggcagatcacttgaggtcaggagctcgagaccagcttgaccaacatggagaaaccctgtctctattaaaaatagaaaattagctgggcgtggtggcacatgcttgtaatcccaactacggggaggctgaggcaggagaatcgcttgaacccgggagacggaggttgtggtgagccgagattgcaccattgcactccagcctgggcaataagagtgaaactctgtctcaaaaaacaaacaaacaaacaaaacaaaataaaaaaaacaaagaaacaaaccggccaaagagcacccacctcatcttcagcattgctcctcacctacatggtcactttggggaaacttgccttcctccttccctctggattcttctttgtgcagggggtcccaatgaaccagcctatcctcaagaaatcccacccttggggctgtggcatgatgtggggaggttgcactggggaaggtgtgaggggctacagggtggcgggtgtgtgggtgtgtaggtctgcattccagccactgcagatttctctatgaatctgcataggcctcctaagaaggagactggcgcgtgcctagagaaaaagcaggaagataagaatgcaggaagatctggactgcatccttaggggtggcattgtgactctgattgtcagaggtctccgtttttaacgtttaactcccatcacatctcaactttttcctgtcttcacctgtgcttccaaatgtcctcaggcacatatatgtgtccctactcatactcactcacaagcgtctgcccaggcacctccactcatacctgggtcctgttgtgcaggcaactctcagagggcagggttcttcagcttcccggttccatcttgttcatcttcctcatcccttgttgtctggctgcccaatatttgctggcggagggtgcgggatgtgttgggggtggagacagcagggagcagggcagcctcctggcccaacaggcctctgtgcacatgcagtgcagacctgggcataaggggctgacactttctcctggctggttggtggctcttcctctgtgaagccacagaaggtcactcgggttgccacctgtccatctgggacattctgcattcttgttcgctgtcatcctcattgctcacgttgattcttagtatacttttggagtttttcttccttcacttttttcttcttcactgtctttacttctcgtccacttctggtttggggaggtcaggattcgcctggaaggcagggtccggttggcaagcgaacatatttagggagaacacgccttcttttcctcaggaaattagaaagacctcagttgactcctgccagatgtaatcggggtgcccctctcctttctgccctctctccctagtgccataggtggctgattacctcctttccctggtgtccttttcctctccgtttttcctctctcctcccatttctggggtcctacccttcattggccttgtagactaggggctcgtggccccttgcggtttgcagatgacatccagagggtatggtttagcctgcatctttgtcctctgtagcccctgcagacctatttgtggatcaaagcttttgatccgactcacaagggatcccatcaacaagaagcttcttggtggtgtgtcctttcactgggatgtcactgttgtctctttgtcactcgttatgtatgtcaccacgcattgaggcacccatgaactctatccttcaggacagctgaggtggcatgaagctgccatttcttgttctttttctccatctggttcttcttcctcttcctcctcttcctctttctttctcttttcttttcttttctttctttctttccacctcctcctcctttttcttcttcttttcttccctcctcctcctcctcctctctcttttcctttcactttcagatcttggcgagacaaatgttctatggagactgcttcttctgctccttggtaatgggggatgtccctctgcgtgctaggcaaggagaaagcttcacttttgttctgaaaggagcagagatgaaggtcacatgttcagttcctctggtcctctaaaaaaccacccatgtgttacttttaagtgaaatgtcattctgaatgcacttcctaccagtacctcacgattcatccttctaccttgttctccttgaagacgatctaataatgtaatcttggccagtaggagcctcagcaagttttcccccatttcctctccttccagtcaagccatgtgaacacaactatccggatttcagtgtatacaggcaggctgtctctgccatgtgccagtttacccactctcacacaggaaggcacccacaaaccatagacacagatacacatacacacactcactagggacctcagaaatgaaatcacaaacacacccgcacacagagacacatgcagacacacacaaacacacacatagacacacaaacaagaaacctcacaggggcacaggggtgcaggcccaagcattctcccacacagacacatacacaccaccacaggcacgagactgcctacaatttctcccacacaggttctaaatgtgcaaagggaacaggagacaggggagaattcctgactccaggcctgggccatcatgccattgattgatgggcaactctcgccttctcctgagaatcaatgtgggaagtctgttaacagataggatccagcagctggtgtaaaactggagcatcctgggtcaagctgcttaaaaaggaacctcactttgtgttagagacagagagagttcccttgggagccttggccctgtgtgatgccataagaatctgtggtgtgtggtggcattccccagcacccctgagccaccctcctcccacccccatctgtgtgaaacccaggacagcctgagcagagtcagacttgagcaagttgctgagtgtcctctctgagagatactcctgcttcaggccctgtggtttccagttgagcagtccacctattttgatgacctccatgtgtcagcccaaggcggtaaactctacctggagctccaggctttcgtaggacccccagtcctgcagcagaaccttgtgtaagccagctgggtgaccagcaccttgtcctggggcagtagccctatgatcctagtcctcctgtggtgtcccagtaatgatcatgttttttgttgtttactttctgcacgggcaagagccatgaaacctgcagagagccaaaggaagggcaaaggctggctccctaaacaggattcccacaggatctccagcctactggtcctggtccttggtcacacggtcccatgagtttggtgatcaatctgggaccaggtgactgattcctttcactcctctgtctttttttttgtttctctttcctctttaccttttttcacatgggaaaaggcggaggccctggagttgaagtggcagggttacagttgtagttggcgtttgtggagccatactgccatcaagcggaaactgtatctagaaaccggaggcagctgggcacaagtgctggggaaaccccacgagcgcaaaagagatggcggcatggagcccccaggctgaagcaggacaagagaggaactccaagctggcccttggcctgtgctcattcccaggatgcctccctggttccacagctctctccgaaaaaaagggcaggtaggggcgacccaccatgggttcccctggtcatctccaggtactgctggtcctgggttgccacgtctccagtatcccgaagctcctttgttccccgggaggatcggggcccccttgccaacacgtggctccagccaagggaaccccggaactccccacaaaagacaccagagtaaacggcccccgtctcggccagtggcttcgtttatgtccatctcaacatggctgccgggccagctccgccctctgggctgactggtcttggggctgcctggctgttctgtcctggggcctctagagtagttgcttctccaaagcgtcccaatgccaggtacacttccttcaagggctcagaaccccggtgggggaaacccaggcttagacatagtctaagcacatcctcgctgatctctgttcctggcagaaggcaggtgtccgtgcatcctgttgtgttcagaaacaacttccactagatggcaatgtggctccacaaacagcagtcttgtctttcccttcccccattttctttccctctttctgtttttggtgccaaaaaccaaaacaaacaccaaaaaaaaaaaaaaaaaaaagaaactggcctaggagcacccatctcacctacagcagggcttcccatctatgtggtcactttgggggaaccggcaacagtaggatggggtaggggtgggggccacagggagcagggcagcttcctggcccaacaggcctctgtgcccacgcggtgcagacccgggcttgaggggctgatgctttctcctggctggtggctcttcctctgtgaggccacaagaggccactcatagtgctgccagctgtccatctgaggcactttgcattgcagttcgctgtcaatctcattgctcactgattctttgtgtacttttggagtttttctcccttcacttttttcttcttcattctctttactttttctccacttctgctccaggagcagactggaaggcagggtcagctgggcgcggggacaccgttagggaaaacaggcttacttttcctaaggaaattagtaggactctagctgacccctgcgaggagaaattggcgtttccctctcctttctgccctgtctccatattgcagtgggtggctgattatctcttttccctggtgtccaattcctccccgtttttcatcttattcttttttgggcggtccttccctgccttggccttgtagccttggggcttggtagccccttgcagtcagctgatgacatcttcagggcaaggttcagccagcacctgtgttctctgtagcttctgcaggcctacttgtggatcaaagcttttgatcttactcaggaaataccccatcaacaagacgcttcctggttgtgtgtcctttaagccggatgtcagaagtggctccgtgcccctcgttgtatgtcaccacgcgttgaggccctcctaaactagatccttcgggacagctacagtggcatggacctctcacttcctgttctccttctgattcttcttcctcttcctcctcctacccctcttctttaattcttctccttctcctccttctcctcttgctcctcctcctccaactccttcttatcttcctactcctcctttttctttttcttctttttcctccttctactcctcctccccctccccctgcacttccttctcctttgcctctttttctttttttgcttttgcttctgcttctgattctgcttctgtttttcctttcacttgcggatctgggtgggcacgtgttctagcagactgcttcttcttttgctccttggtgatgtgggatgtccctctgcagaattaggcctggagaaagcttcacattcgttctttaaggagcacagatgaaggtcatgagtttagtccctctggtccaccaaaaggctacccacgtgttacttttaagtgaaatgtcatggtgaacgcaccctttacccaatacctcatggctcattgttatttcccattctccttctggatgctgtaagtgtaatcctgagccagtaggagccttggcaagttgtttcctaactcctttttttccagtcaagccatgtgaacacatcaatctgaatttcagtgtgtgcaggcagggtgtctctgccacgtgttcatttgctcacatttcagtgtgtgcaggcagggtgtctctgccacgtgttcatttgcccactctcactcacacagggaggcacacacagacacacatgcaggcacttacaagagacccccagaagaagaaataaaatcacaaacacacacacagagatacatgcacacccagacaaaaacacgcttacacatacccacacaaacacacacatacacacacataaagtaagctcacaaaatcaaaggggtaggggcccaagcattatgggacacaaacacacatcgccacaggcatgcgactgcccacattctcttcgacaggggttcgaaatatgcaaaggggaaagggagacagaggagcattcctgcctccaggcctgagtcattatgccatttattgggcaactagggccttctcctgagaatgaattcgggaagtctgttatcagataggctcaagcagcaggcatgaaactggagcatcctgggtcaagctgcttaaaaagggcccccaagccttgtccctgtgtgatgccatgagaagctgtggtacttggtggccttccccagcctctctgagccaccctcctcccaaccctacctctgtgaaagccgagacagcctgagcagagtcagtcttgagtgagttgctgaatgtccccgctgagggagactcctgcctcaggccctgtggctgcctgttgagctgtctatccgttcttcggacctccatgtgccatcccaaggtggtaaactctaactgcaactccaggctttgggaggacccccaattctccagcaaaaccttgtgtaagccagctgggtggccactgccttgtacttgggcggcagccctgtgatcccagtccttctgccgttttccagtagccatgattatacgtcctttctcttttactttctacaccagcgaaagcgatgaaacctggagaggtccaaaggaaagtcaaaggcttgctgcctccacagcgttccgacaaggtctccagcctactgatccttgatcctagggtccccttaagaggtgaaagtctgatggcagccctggcagccctcgctcgctctcggcgccccctcggcattggcgtccactctggccgcccttgaggagcccctcagcccgccgctacactgtgggagcccctgtctccactggccaaggtcggagccggctccctcagcttgcggggaggtgtggagggagagccgcgggcggtaacacgagctactcgccgcgcttgcgggccaccgggagttgccggtcggcatgagctcggcgggccccgcactccgagcagccagttggacctgcctgcccagggcagtgaggggcttagcaactgggccagcagctactgtgctccacttctcgcctatctcttctccttaactttcttttataattatgttttctccttcctctttgcttttttcacacgagaaagggcggaggccctcggattggaggggcagggttgtggttgtacttggcatttgtggtgccatactgccatcaagcggaaaccgtttctggaaaccggaggctgtagggcacaagtactggggaaaggccaggagcccaaaagggagggtggtgtgggaccccagactgaagcgagacgagagaggaactcctcgctggcccttggcctgggctcattcccaggatggcgccctggctccgcagctgtatgtaagaacgggcaggcggggcggcccgccatggcttcccctggcagtctccaggaactgccaggcatgggtcgccccacactcagcactccgaaacttttttatttcccggcaagatagaggctttctggccccactgtggccccagccaagggcatcgcggagctgcccacaaaagcgaccagagtaaacggccccgttctctggctgtcagtggccagtggcttcccttatgcgtatctcaaaatggctgccggggcagctgcaccctgtgggctgactggtcttcgggatgcctggctgatctgtctcggggcctctagagtagctgcttctccaaggggtcccaatggcaggtccgctttgttctagggctctacgcccgggtcggggaaaccctggcttaggcagagtccaccccgccccgcccatcctcactcttctcggtgcctggcagaaggcaagtgtccctgtccctgcagcctgttgtcatgtccagaatcaccttccgctggatggcactgtggctccgccaatggcggtcacgtcttttccttcccccaccttgcctttatctttctccatctgctgccgacagaataaaacaaacgccaaaaacaaaaaaagccaagaaacaacgaaagataccggccaaggagcacccacctcacctacagcagggctctccacctaggtggtcactttggggaagcctgcaacggtaggagggttctctgcctccctccttccctctggattcttctccgggcagggttcccagtgaaccagagaacgtcaagaaattccacccttagggctgtggctcggtgggggtaggtcgcactgggggcagtgtgagggggtacagggggagggatatgtgggtgtgtgggtctgcatgcgggccgctgcagattcctctaggaatctgcgcaggccgcctgagcaagagaccaggctgcatgcctgtgcgcaccacacttgtccctaggtagcactcttcctcttggggaagggatcaaagttggatggaaagcagccaggtccagcaggcatccgcaccttgttgagccatggagctgcagggagtcgggccggatgtttcttgggatgatgggactggacgggacggactcctgtctgaggccttcagctccctccctctctggagcccaggcactcgtctgtgcacagtggtgggaggagcatgccgggtgggtttcacaggtggctctcctggagagagagcctcttggcatgtctgacggagcacgcgtgctcagtggaacgtggtggttcaccacttagttgccaggcatcttggtccttgtacccaagtgcatgggtagccagggcccagcctgccccacttcgcctggaccccgtctgatttcctgtgctgcgtgtggaggtggaggttgagccttgagtattttgggggagaaggggctcgggcggggggctgtgttttggtttggtagagggctcactgggctctcgagctaaaccctggtgcttgccggatattcagcccagaaaatgcatgagaccgtcaaggacaaattatgccgcccataattagggtctccaggcagacataagaaagcctgatgcgggacatcatacagtgcccatgttgggatgcgaagccgcgaccgccttgctctaaaggttgcataggctactcatgccgctgggtgcctggacagcagcatggaacacaacgctccccgaatattgcaaatgttttctgtcttggcttgttacaaatcttcctggatgtgtaggccaccctggggacgagcagcccttcttagggcagaaaattcaccccacgggtgatgattcccacgctgggggtgtgtgaaccactctcacaaggaggaatgtcaatctcgtgagcgggcctgcactctcacggcattccgggcagaagaaccacatgaccatggaacaggagtcaccccctttctgtcacttgtcaacaaatgcggatttttttttttttttttttttttttttcctcatatgtaggtagcatgcaccagggtgcgcctctggcggtgcctagggagaacgcgagaagaaaagaatgcaggaagatctggactgcgtctttagggttggcactgggactgtgagtgtcagaggtcctcggttttaacttttaactcccatcacatctcaactgtttcctgtcttcatctgtgcttccacaggtcctgaggcaggcccgtacacgtatccccacccatactcacaagcgtctgcccagacaccttcattcacagccggggccggtcatctaggcaactctcaggggggcaggttttcagctttcgggttccctcttgttcacttcaccttccttgtcgctttctgcctggcttcccaatatgtgctgacggagtgtgcgggatggggttgaggtgtgggcagcagggtgcagagccgcctactggcccaacaggcctctgggcggacgcggtgcagacccgggcctaaggggctgatgctttctcctagctggtggctctttttctgtcaggccactcacagggctgccagctgtccagctggggcactctgcattccacttcgctctcaacctcattgctcactctgattctttgtgtactttcggagttttcctcccctcacttttttcttcttcactttctttacttttcgtccacttctgtttggggaggtgagaagcagcctggaaggcagggtcgactgggcgcggggataccgttagggaaaacaggcttacttttcctaaggaaattaggaggactctagctgacccctgtgaggagaaattggcatttccctcccctttctgccctgtctccatattgccgtgggtggccgattacctcttttccctggtgtctgattcctccccgtttattaccttcctctttttggggggggggctcttccctgccttggccttgtagacttggggttcggtgacccttgcagtcggctgatggcatcctcagggcaaggttcagcctgcacctgtgtcctctgtagcttctgtaggccgatttgtggatcaaagtttcggtcccactcaggaaagatcccatcgacaagaagcttcctggttgttcgtcctttaagcgggacgtgactggtggctccttgtccctcgttgtgcatgtcaccatgcattgaggtcttcctgaactagatcctccaggacagctacagtggcatggacctccctctttcttgttcttctgattcttcttcctcttcctccttcttcttcttcttctctacttttattcttccctttctcctctattttacctcttgctcctcctcctccaacttcctctcctcctcctcatgctcctcctttttgtcctcctcctcctcctccttcttctcgttctcgttctccttttccttcttctttttcttctcatttttcttcttcttcttaatctttttctgcctcctcctcctcctcctcctcctcctcctcctccgcctcctcctcctcctcctcctcctcctcctcctccttttcctcttcttctttttctgcttttgcttctgctttttcttccctttttcccttcacactcagatctgttcgggcaagtgttctaggagactgctgctgcttttgctttttggtgattcgacatgtccctctgcagcactaggcctggaggaagcgtcacttttgttctcaaaggagcactgatgaaggtcaccagtttattccctctggtccaccaaaaagctgcccacgtgttacttttaagtgaaatgtcgtggtgaacccaccgtttacccagtacctcatgtctcaccgttattccccattgtccttgtggatgctctaagtgtgcctttctgagccattaggagctttggcaagttgtcccctgtctcctttttctccagtcaagccatgtgaacacatcgatccagatgtgtgcaggcagggtgtctctgccacgtgttcatttgcccactgtcactcacacaggcaggcacccacagaccgcagactcaggtacacaggcacgcaatcatatgggatccggcaacccaaactgaaatacacgcgcacacacagacacatgcacacgcagacacaaacgcacacgttaaacacgcccaagtagacacacgcatacatacacaaacacacgcacgtgcgcacacacgtcagctcacactagcaaaggggtgtgagctcaagcattatcggacacagactcctacacaccgccactggctcgaaagcgcccacaacctcttccacgctggctctaaatgtgcaaagcagaacgggagacaggcgagcattcctggctccagtcctgggtcatcatgccatttattgggcaactagggtcttctcctgagaatgaatgcgggatgtgtgtcatcagataggcccaagcagcaggtatgaaactggatcatcctgggttatgctgcttaaaaagggaccccactttggaggaggggcagagacagtccccctggagtcttggctctgtgtgatgctatgagtatctgtggcgcggggtggccttcccaggcctccctgagccgcccccctcccaccctctcctgtgtgaaagccgagacagcctgagcagagtcagacttgagtgtgttgctgagtgtctcctgtgagggagactcctgcctcagccctgtggctgcctgttgagccttcggccccgttctggtgacctccgtgtgccatgccaaggtggtaaacactacctgcagctccaggccttgggaggacccccggtcctggggcaaatccttgtgtaagccagctgggtggccagcgccttgtcctggggcggcagccctatgatcccagtcctcctgtggtttcccagaggcggtgattatgtgtcctttgtcttttacttcctgcaccagcgggagccaaaatccctgaagagggccaaaggaaaggcagaggttggctgcctccaccgcattcccgcaggttctccagccggctggtcgttggtcctagggtcccctgagtttggcggtcaacctgggaccaggtggctggttcctttcccttctccgtgtctttcttttattattatgttttctccttcctctttgcttttttcacacgagaaagggcggaggccctcggattggaggggcagggttgtggttgtacttggcatttgtggtgccatactgccatcaagcggaaaccgtttctggaaaccggaggctgtagggcacaagtactggggaaaggccaggagcccaaaagggagggtggtgtgggaccccagactgaagcgagacgagagaggaactcctcgctggcccttggcctgggctcattcccaggatggcgccctggctccgcagctgtatgtaagaacgggcaggcggggcggcccgccatggcttcccctggcagtctccaggaactgccaggcatgggtcgccccacactcagcactccgaaacttttttatttcccggcaagatagaggctttctggccccactgtggccccagccaagggcatcgcggagctgcccacaaaagcgaccagagtaaacggccccgttctctggctgtcagtggccagtggcttcccttatgcgtatctcaaaatggctgccggggcagctgcaccctgtgggctgactggtcttcgggatgcctggctgatctgtctcggggcctctagagtagctgcttctccaaggggtcccaatggcaggtccgctttgttctagggctctacgcccgggtcggggaaaccctggcttaggcagagtccaccccgccccgcccatcctcactcttctcggtgcctggcagaaggcaagtgtccctgtccctgcagcctgttgtcatgtccagaatcaccttccgctggatggcactgtggctccgccaatggcggtcacgtcttttccttcccccaccttgcctttatctttctccatctgctgccgacagaataaaacaaacgccaaaaacaaaaaaagccaagaaacaacgaaagataccggccaaggagcacccacctcacctacagcagggctctccacctaggtggtcactttggggaagcctgcaacggtaggagggttctctgcctccctccttccctctggattcttctccgggcagggttcccagtgaaccagagaacgtcaagaaattccacccttagggctgtggctcggtgggggtaggtcgcactgggggcagtgtgagggggtacagggggagggatatgtgggtgtgtgggtctgcatgcgggccgctgcagattcctctaggaatctgcgcaggccgcctgagcaagagaccaggctgcatgcctgtgcgcaccacacttgtccctaggtagcactcttcctcttggggaagggatcaaagttggatggaaagcagccaggtccagcaggcatccgcaccttgttgagccatggagctgcagggagtcgggccggatgtttcttgggatgatgggactggacgggacggactcctgtctgaggccttcagctccctccctctctggagcccaggcactcgtctgtgcacagtggtgggaggagcatgccgggtgggtttcacaggtggctctcctggagagagagcctcttggcatgtctgacggagcacgcgtgctcagtggaacgtggtggttcaccacttagttgccaggcatcttggtccttgtacccaagtgcatgggtagccagggcccagcctgccccacttcgcctggaccccgtctgatttcctgtgctgcgtgtggaggtggaggttgagccttgagtattttgggggagaaggggctcgggcggggggctgtgttttggtttggtagagggctcactgggctctcgagctaaaccctggtgcttgccggatattcagcccagaaaatgcatgagaccgtcaaggacaaattatgccgcccataattagggtctccaggcagacataagaaagcctgatgcgggacatcatacagtgcccatgttgggatgcgaagccgcgaccgccttgctctaaaggttgcataggctactcatgccgctgggtgcctggacagcagcatggaacacaacgctccccgaatattgcaaatgttttctgtcttggcttgttacaaatcttcctggatgtgtaggccaccctggggacgagcagcccttcttagggcagaaaattcaccccacgggtgatgattcccacgctgggggtgtgtgaaccactctcacaaggaggaatgtcaatctcgtgagcgggcctgcactctcacggcattccgggcagaagaaccacatgaccatggaacaggagtcaccccctttctgtcacttgtcaacaaatgcggatttttttttttttttttttttttttttcctcatatgtaggtagcatgcaccagggtgcgcctctggcggtgcctagggagaacgcgagaagaaaagaatgcaggaagatctggactgcgtctttagggttggcactgggactgtgagtgtcagaggtcctcggttttaacttttaactcccatcacatctcaactgtttcctgtcttcatctgtgcttccacaggtcctgaggcaggcccgtacacgtatccccacccatactcacaagcgtctgcccagacaccttcattcacagccggggccggtcatctaggcaactctcaggggggcaggttttcagctttcgggttccctcttgttcacttcaccttccttgtcgctttctgcctggcttcccaatatgtgctgacggagtgtgcgggatggggttgaggtgtgggcagcagggtgcagagccgcctactggcccaacaggcctctgggcggacgcggtgcagacccgggcctaaggggctgatgctttctcctagctggtggctctttttctgtcaggccactcacagggctgccagctgtccagctggggcactctgcattccacttcgctctcaacctcattgctcactctgattctttgtgtactttcggagttttcctcccctcacttttttcttcttcactttctttacttttcgtccacttctgtttggggaggtgagaagcagcctggaaggcagggtcgactgggcgcggggataccgttagggaaaacaggcttacttttcctaaggaaattaggaggactctagctgacccctgtgaggagaaattggcatttccctcccctttctgccctgtctccatattgccgtgggtggccgattacctcttttccctggtgtctgattcctccccgtttattaccttcctctttttggggggggggctcttccctgccttggccttgtagacttggggttcggtgacccttgcagtcggctgatggcatcctcagggcaaggttcagcctgcacctgtgtcctctgtagcttctgtaggccgatttgtggatcaaagtttcggtcccactcaggaaagatcccatcgacaagaagcttcctggttgttcgtcctttaagcgggacgtgactggtggctccttgtccctcgttgtgcatgtcaccatgcattgaggtcttcctgaactagatcctccaggacagctacagtggcatggacctccctctttcttgttcttctgattcttcttcctcttcctccttcttcttcttcttctctacttttattcttccctttctcctctattttacctcttgctcctcctcctccaacttcctctcctcctcctcatgctcctcctttttgtcctcctcctcctcctccttcttctcgttctcgttctccttttccttcttctttttcttctcatttttcttcttcttcttaatctttttctgcctcctcctcctcctcctcctcctcctcctcctccgcctcctcctcctcctcctcctcctcctcctcctccttttcctcttcttctttttctgcttttgcttctgctttttcttccctttttcccttcacactcagatctgttcgggcaagtgttctaggagactgctgctgcttttgctttttggtgattcgacatgtccctctgcagcactaggcctggaggaagcgtcacttttgttctcaaaggagcactgatgaaggtcaccagtttattccctctggtccaccaaaaagctgcccacgtgttacttttaagtgaaatgtcgtggtgaacccaccgtttacccagtacctcatgtctcaccgttattccccattgtccttgtggatgctctaagtgtgcctttctgagccattaggagctttggcaagttgtcccctgtctcctttttctccagtcaagccatgtgaacacatcgatccagatgtgtgcaggcagggtgtctctgccacgtgttcatttgcccactgtcactcacacaggcaggcacccacagaccgcagactcaggtacacaggcacgcaatcatatgggatccggcaacccaaactgaaatacacgcgcacacacagacacatgcacacgcagacacaaacgcacacgttaaacacgcccaagtagacacacgcatacatacacaaacacacgcacgtgcgcacacacgtcagctcacactagcaaaggggtgtgagctcaagcattatcggacacagactcctacacaccgccactggctcgaaagcgcccacaacctcttccacgctggctctaaatgtgcaaagcagaacgggagacaggcgagcattcctggctccagtcctgggtcatcatgccatttattgggcaactagggtcttctcctgagaatgaatgcgggatgtgtgtcatcagataggcccaagcagcaggtatgaaactggatcatcctgggttatgctgcttaaaaagggaccccactttggaggaggggcagagacagtccccctggagtcttggctctgtgtgatgctatgagtatctgtggcgcggggtggccttcccaggcctccctgagccgcccccctcccaccctctcctgtgtgaaagccgagacagcctgagcagagtcagacttgagtgtgttgctgagtgtctcctgtgagggagactcctgcctcagccctgtggctgcctgttgagccttcggccccgttctggtgacctccgtgtgccatgccaaggtggtaaacactacctgcagctccaggccttgggaggacccccggtcctggggcaaatccttgtgtaagccagctgggtggccagcgccttgtcctggggcggcagccctatgatcccagtcctcctgtggtttcccagaggcggtgattatgtgtcctttgtcttttacttcctgcaccagcgggagccaaaatccctgaagagggccaaaggaaaggcagaggttggctgcctccaccgcattcccgcaggttctccagccggctggtcgttggtcctagggtcccctgagtttggcggtcaacctgggaccaggtggctggttcctttcccttctccgtgtctttcttttattattatgttttctccttcctctttgcttttttcacacgagaaagggcggaggccctcggattggaggggcagggttgtggttgtacttggcatttgtggtgccatactgccatcaagcggaaaccgtttctggaaaccggaggctgtagggcacaagtactggggaaaggccaggagcccaaaagggagggtggtgtgggaccccagactgaagcgagacgagagaggaactcctcgctggcccttggcctgggctcattcccaggatggcgccctggctccgcagctgtatgtaagaacgggcaggcggggcggcccgccatggcttcccctggcagtctccaggaactgccaggcatgggtcgccccacactcagcactccgaaacttttttatttcccggcaagatagaggctttctggccccactgtggccccagccaagggcatcgcggagctgcccacaaaagcgaccagagtaaacggccccgttctctggctgtcagtggccagtggcttcccttatgcgtatctcaaaatggctgccggggcagctgcaccctgtgggctgactggtcttcgggatgcctggctgatctgtctcggggcctctagagtagctgcttctccaaggggtcccaatggcaggtccgctttgttctagggctctacgcccgggtcggggaaaccctggcttaggcagagtccaccccgccccgcccatcctcactcttctcggtgcctggcagaaggcaagtgtccctgtccctgcagcctgttgtcatgtccagaatcaccttccgctggatggcactgtggctccgccaatggcggtcacgtcttttccttcccccaccttgcctttatctttctccatctgctgccgacagaataaaacaaacgccaaaaacaaaaaaagccaagaaacaacgaaagataccggccaaggagcacccacctcacctacagcagggctctccacctaggtggtcactttggggaagcctgcaacggtaggagggttctctgcctccctccttccctctggattcttctccgggcagggttcccagtgaaccagagaacgtcaagaaattccacccttagggctgtggctcggtgggggtaggtcgcactgggggcagtgtgagggggtacagggggagggatatgtgggtgtgtgggtctgcatgcgggccgctgcagattcctctaggaatctgcgcaggccgcctgagcaagagaccaggctgcatgcctgtgcgcaccacacttgtccctaggtagcactcttcctcttggggaagggatcaaagttggatggaaagcagccaggtccagcaggcatccgcaccttgttgagccatggagctgcagggagtcgggccggatgtttcttgggatgatgggactggacgggacggactcctgtctgaggccttcagctccctccctctctggagcccaggcactcgtctgtgcacagtggtgggaggagcatgccgggtgggtttcacaggtggctctcctggagagagagcctcttggcatgtctgacggagcacgcgtgctcagtggaacgtggtggttcaccacttagttgccaggcatcttggtccttgtacccaagtgcatgggtagccagggcccagcctgccccacttcgcctggaccccgtctgatttcctgtgctgcgtgtggaggtggaggttgagccttgagtattttgggggagaaggggctcgggcggggggctgtgttttggtttggtagagggctcactgggctctcgagctaaaccctggtgcttgccggatattcagcccagaaaatgcatgagaccgtcaaggacaaattatgccgcccataattagggtctccaggcagacataagaaagcctgatgcgggacatcatacagtgcccatgttgggatgcgaagccgcgaccgccttgctctaaaggttgcataggctactcatgccgctgggtgcctggacagcagcatggaacacaacgctccccgaatattgcaaatgttttctgtcttggcttgttacaaatcttcctggatgtgtaggccaccctggggacgagcagcccttcttagggcagaaaattcaccccacgggtgatgattcccacgctgggggtgtgtgaaccactctcacaaggaggaatgtcaatctcgtgagcgggcctgcactctcacggcattccgggcagaagaaccacatgaccatggaacaggagtcaccccctttctgtcacttgtcaacaaatgcggattttttttttttttttttttttttttcctcatatgtaggtagcatgcaccagggtgcgcctctggcggtgcctagggagaacgcgagaagaaaagaatgcaggaagatctggactgcgtctttagggttggcactgggactgtgagtgtcagaggtcctcggttttaacttttaactcccatcacatctcaactgtttccttgtcaacaaatgtgtgtccttttctcataagtgtataccatccacctcggggcccctccttttgtgccttgggacatcgggtgaagtaaggaacgcaggaactttggtgttgttagttttagtgtcagaggttcttgtttttacctttgaacatcaatcacgtctgaactatatcctgtcttcatctgtggttgcataggtcctcaggcacatacaagtatcttctccagtaatgacaagcttctgcctagacaccttcattcacaactgtttcccgtcatctaagcaaccctcaggaggtagttgttaagctttcacgttccctcctgttcatttttcttattgctttctctctgccttcccaatatttgctgatggagtgtgcgggatggggttgaggtgtgggcagcagggaacagggcagtctcctggcccaacagatctttgtgcagacgcggtacagacccgggatttaggggcttatgctttcttctggctggcgccttatcctgtgtgaggacacaggaggctactcacagggctgtcagctttccatatgatgaactctgctttccagtttactctgtaactcattgctcactctgattctttgtgtacttttggagttttcctcccttcacttttttcttcttcactgtctttacttttcgtccgcttctgtttatggaggtcacaatcagccaagaaggcagggtcagttatgcacggggacatggttaaggaaaacaggcttactgtttctaaggaaattagaaggactccagctgaaccctgcgaggagaagttggcatttccttattctttctgccgtgtctccatattgccatgggtggctgattacctcttttccctggtgtccgattcctccccgtttttcatctttttcttttgggtggttcttcactgccttggttttgtagactttgggcttggtggccccttgcagtcagctgatgacatcctcagggtaaggttcagcctacacttgtgtactctgtagttctgcaggccaatttgtggatcaaagttttgatcccactcaggaaagatcccatcgacaagaagcttctcgtttgtatgtcctttaaacgggaggtgacctggggctccttgtcactcattgtgtatgtcaccacacactgaggtcttccttaactagatccttcaggacagctacagtggcatggacctcccactttctgttcttgttctctttctggttattcttcctcttcctcctcctactcttttaattcctcttctcttttttgttttcttactcttcctcctccatcttctcctcctcctcctccttcttctttccttctcctcttcttttgcctcttcttcttttttgtcttttgcttttgcctctgcttctctttttcccttcactttcagatcaggacagacaagtgttctaggagactgcttcttcttttgctccttggtgattcagcatgtctctctgcagtactaggcctagagaaagcttcacttttgttcttaatttagcactgatgaaggtcaccagtttagtctctctggtataccaaaaaccttcccacatgttgcttttaagtgaaatgtcatggtgaacagatcctttacccagttcctcatggcttgctgttatttcctgttctgttcgtggatgcactaggtgtgtaatcctgagccattaggaagtttggcaagttgtcccgtgtctccttttttttcagtccagccatgtgaacacattgatccggatttcagtttttgcagggtgtctccgccacatgcccatttgcccactctcactcacagaggcaggcacccacagaccacagacacagacacaatacatacactcacaagggaccccccaatcagaaattaaatcacaaacacacacgcacatggagactcatgcacacacagacacaaacacacacattaaacacgcctaagcggacacacacacagatacacacagacacacacacacacacagaagtaagctcacactagtacaaatgtgcgggtttaagcattatcgtacacagacacacacaacacctcaggcacgaaactgcccacaatgtcttccactcgggctgtaaatggggctgtaaatggtggcgtgtggccctcaaactgaggcgggacaagagaggaactccttgctggctcttggcctgccctcattcctaggatggcggcctgtctccacagctgtatgtaagaaagggcagtcggggcggccagccatggcttcccctggcagtctccagaaactgccgggcatgagtcgcccaacactcaacacgccgaagctcctttgtttcctgggtggataggggctttcttgccccactgtggccccagccaagggcatcccagaactgcccacaaaagagaccagattaaacggccccattttctggctgtcagtggccagtggcttcccttatgcgtatctcaaaatggctgctggtgcagctccactctgtgggctgacgggtcttcaggctgcctggctgatctgtctcggggcctctagagtagctgcttctccaagcggttccaatggcaggtacgatttgttctagggctctaaaccccagtcggggaaaccctggcttaggcagagtccacccagtcccgcacattttcgcggatctctgtgcctggcagaaggcaagtgtccctgcagcctgttgtcatgttcagaaacaccttccgctggatggcactgtggctccacagatgacagtcacgtcttttccttcccttcccttgcctttgtctttctccatttgttgcgaacagaataaaacaaaaacacacacacaaagcgaagaaacaaagaaagaaacgggccaaagagcacccacctcatctacagcagggctccccacctacgtggtcactttgggggaaggtgcaacagtaggagcgttctctgcctccctccttcttctggattcttctctgggcaggggtcccagtgaaccagaggagcctatcctcaatacatcccacccttatggctgtggcatggtgggggtaggtcgcactgggggcagtgtgagtgggtacagggggagaggtgtgtggatgtgtggccctgcatgcaggctgctgcagatttctctaggaatgtgctcagctccccctaggcaagagaccaggccgtatgctgaggtgcacgacacttgtccctaggtagcactcttcctcttggggaagggaccaaatcttgtatggaatgcagtccggtccaacaggcttccgcacattgttgacccatggagcagcaaggagtttggctggatgtttgttgggatgggactggactggaaggactcctgttggaggccttcagctccctctctctctctggagcccaggcactcatctgtgcccaggggtgggaggggtattccaggttgttttacaggtggctgtcctggagagaaagccacttgttatgtctgactgagcatgcgtgctcactggaacgtggtggttcaccagttatttgccccggcatcttggtcattctgcataagtgcatgggtagccaggttccagacagtgctcgccttctcctgggcctgtctttgttcctgttctgcgtgtggaagtagaggtggatcctggaatgtgttgggtgggatggtggtagggcaactgtgccttggtttgatacagagctctctggggtcctcaagctgaactctggtgcttgcgggatattcagccctaaaaatgaatgagtcggtcgaggacaaattttgccggctctttagggtttccaggcagacgtaagaaatcctgacgcgggccatcatacagcccgcttcttgggatgcgaagccatgaccgcgttgctctaaaggttacatatgctacccatgccgctcagtgcctgggcagcagcatggaacacacagctcttcaaatattgcaaatgttttctgtctttgcttgttacaaatcttcctggatgtgtaggccgcactgggaatgagcagagtttcataggacagaaaattcatgccacgggtaatgattctcacactcatgagagtgtgaaccactctcacaagaggaacatcaatctcgggtgtgggcctgcactcccagggcattccaggaagaagactcacatgaccatggaacaggagtcaccccctttctgtcacttgtcaacaaatgcggattcttttttcacatgtaggtagcatgcaccagggggtgcttctgccccttcctagggacaaagggagaagaaaagaatgcaggaagatttggactgtgtctttggggtggcattgcgactctgagtgtcagaggacctcgtttttaacttttaactcccatcacgcttcaactttttcccatcttcatctgtgcttccatagttcctcagacaaatacacgtatccccacgcacactcacaagtgtctggccagacaccttcattcacctccgggtacagtcgtctaggcaattctcagggggcagtttttcagctttccctttccttcttgtttacctttcttgttgtttcctgtctggcttcccaatatttgctgatggtgtgtgcgggatggggttggggttggggcagtagagagcagggcagcctcctgaaccaacaggcctctatgcagtcgcggtgcagactcgggcttaaggggctgacactttcttcttgctggtggctctttttctgtgaggacacaagaagtcactcacagggctgccagctattcatttggtgcactctgcattccagttccctctcaacctcattgatttctctgattctttgtgtacttttggagattccctcctttcacttttttctccttcactgtctttacattttgtccacttctgtttggggaggtcaggagcagcctggaagacagggttgactggttgcggggacaccctcagggaaaacaggcttacttttcctaaggaaattagaaggactctagctgaccccgtgaggaaaaattggcatttccctcccctttctgccctctctccatattgccatgggtggctgattccctcttttctctggtgtctgattcatccctgtttattatctttttttttggaggtggggtagggggtccttccctgctttggccttgtagacttggtgctgggtggccccttgtagtcggctgatgacatcctcagggcaaggttcagcctgcacctgtgtcctctgtagcttctgcaggcccatatgtggatcaaagttttgatcccactcaggagagatcccattgacaagaagcttcctagttgtttgtcctttaaagggctgtgactatggctctttgtcctttgttgtgtacatcaccatgcattgaggtcttcctgaactagatccttcaggacagctacagtggcgtgaacctcccactttctgttctttttctgcttctggttcttcttcatcttcctccttctaatcctcatctttaattcttcttctcctcttttttatcctcttgctccttctcttccaacatcctcttcttctccttctcctcctccttctcctccatcatctcctccctcctccttcttctttctcctccttctccttctttctgcttcttctttttcttcttcttcttcttcttgtgcctctgcctcctcctcctttgcctcttctttttttgcttttgcttctgcttcagctttttttccccccttcactgtcggatctgggcgggcaattgttctaggagactgcttcttcttttgctcttttgtgatgtgtgatgttcctctgcaacattaggcctggagaaagcttcactttcattcttaaaggagcacagattgaggtcaccagtttagtccttctggtccaccaaaaagctgccaacatgttacttttaaatgaaatgtcgtggtgaatgaatgcccccttcacccagtacctcatggctcactattatttcccgttctccttctggatgctctaagtgtgtaattctgagtcattatgagatttgtcaagttgtcatctctctccttttttccagtccagccatgtgaacacattgatccggatttcagtgtgtgcaggcagggtgtctctgcacgtccatttgctgactctcactaacaaaggtaggcacccacagaccacagacacagacacaatgcacgcactcacaagggaacatgaaccagaaatgaaatcacaaacacacatgcacacagacacatgcacacacagacacaaacacacacgttaaacaagcccaagcagacacacgcacacacacacacaaacacacagaagtaagctcacactagcaaaggggcgtgggcttaagcattgttgtacacagacacacaccaccacaggcctgaagctacccacaatctcttccacatgggctctaaatgtgcaaaggggaacgggggacaaacaagcattcctggctgcaggtgtgggtcatcatgccatttattgggcaactaaggccttcttctgaacataaatgcaggaagtctgttatcagattggcccaagcagcaggtgtgaaactggagcatcctgggtcaagctgcttaaaaagggaccccactttggggtaggggtagataaagtccccttgggatccttgtccttgtgtgatgccatgagaatctggtgtgtggtggccttccccagccaacctgtgccaccctcctctcacccttgcctgtgtgaaagcagagtcagacttgagtgaggtgttgagtgtcccctgtgaggagactctggcctcaggccctgtagctgcctgttgagtgggtggccccagtggcccattctggtgacctccatttatgatcccaagttggcaaactctacctgcagttccaggccttgggaagtctcctagtctgggggcaaatccttgtataagacagccgagtggccagcgcctcgtcctggagctgcagccctatgatcccagtcctcctgtggtttcccagaggccatgataatgtgttctttgtcttttactttctgcacctgcgggagccatgaaacctagagaggaccaaaggaagggcaaaggctggctgcctccatagcattcccgcagggtctccaggctactggtccttggtgctagagtcccctgagtttggttgtcagcctgggaccaggtggcttgttcctttctcttctccttatcttttttatttttttctccttcctctttattcacatgggagaaggcagagaccatcagcttagagaagcaaggttatggttgtagttggcatttgtggagccatactgccatcaagtggaaactgtttctggaaatgggagggagctgggcacaagtgctggggaaagcccaggggcacaaaacagatggtggcatggggcccccagactgaagcaggatgagagaggagctcctcactggcccttggcctgggctcattcccaggatggtgccctggctccacagctgcatgtaagaaagggcagttggggcagcccaccatggcttcccctggcagtttccaggaactgccgggcatgagtcgccccacactcagcaccccgtagctcctttttttttttttttaccaggaagataggggccttctggccttactgtggccccagccaaggagggcaagctgtaactgcccacagaagaaaccagagtaaaccacttcattctctggctgtcagtggccagtggcttcccttatgcgtatctcaaaatggctggggggcagcttcactgtgtggactgactcgtcttggggctgcctggctgccctgtgtcagggcctctagagtaactgcttctccaaggggtcccagtggcaggcactctttgttctagggctctaaaccccagttggggaaaccctggcttaagcagagtccacccagccccgcacattttcactgatctctgtgcctggcagaaggcgagtgtccctgcagcctgttgtcatgttcagaaacatcttcctctgggtggcactgtggctccgcaaatggcagtcacgtcttttccttcccccaccttgccttgtctttctccatttgctgccaacggaataaaacaaatgccaaaaacaaaaagcaaagaaacaacgaagaaactggccaaggatcacccacctcacctacagcagggatccccacctacgtggtcactttgggggaacctgcaacagtaggaggttctttgcctccctccttccctctggattcttctctgggcagggtacccagtgaaccagaggagtctgttctcatgaaatcccacccttagggctgtgtcatggtgggggtaggttgtactgggggcagtatgatggggtacaggagagggatgtgtgagtgtgtgggcctgcatgcaggccactgcagattcctctaggaattggcccaggtccccaaagcaagagaccaggcctcatgatggcatgcaccacacttgtccctaggtagcactcttcctcttggggaagggacaaaatcttggatggaaagcagccaggtccaacaggcatccacacattgttgagccatggagcagcagggagttgggtcggatgtttgttgagatgggactgcatgggactgactcctgttcgaggccttcagctacctctctctctggagcccaggcactcataggggtccaggggttggagggattttccaggttttttcacaggtggctctcctggagagagagccacttgtcatgtcttactgagcgtgcatgctcactggaacgtggtggttcaccagttatttgccttggcatcttggtcattcttcccatgtgcatgggtagccagagcccagacagtgcttgccttctcctgggccctatctttgttcctgttctgcgtgtcgaaatggaggttgagcctggagtgtgttggtggggggtgtggtggagtgtctgtgcctttgtttgatacagagctctctgaggtcctcaagctaaactctggtgcttgccggatattcatccagaaaaatgaatgagacagtcgaggacaaattatgctgcccctttagggtctccaggaagacataagaaagcctcacttgggccatcatacagagcccattttgggatgcgaagccatgaccgcgttgctctaaaggttacatatgctacccatgctgcttgatgcctgggcagcagtatggaacacacagctcttcgaatattgcaaatgttttctttctttgcttgttacaaatcttcctggatgtgtagaccacactgtgaacaagcagagcttcataggacagaaaattcaccccatgggtattgattcccacactcaggggtgtgtgaaccactctcacatcacaagagcagtgtcaatctcgtgtgtgggcctctactctcagggcattctgggaagaagacccacatgactatggaacaggagtcacccccttttggtcacttgtcaacaaatgcagattcttttctcataagtaggtagcatgcaccacggggcacctccggccctgcctaggtacaatgggagaagaaaagaatgcaggaagatctgactgcgtctttaggagtgacatggcaactctgagtttcagaggtcctcgtttttaacttttaactcccattacgtctcaacattttcctgtcttcatctgtgcttccaaaggtcctcagatacatacacatctcaccatgcatactaacaagcacctgcccagacaccattcactcccagatctggttgtctaggcaactcttaaggggcagtttctcagctttcaggttccctcttgttcacctttcttgtcgctttctgcctcacttcccaatatttgctggcagatcgtgcggatggggttggggtgggcgcagtggggagcatggcagcctcctggcccaacaggcctctgtgcagatgtggtgcaaacccagtcttaaggggctgacgctttctcttggctggtggctcttcttctgtgaagccacggaaggccactcacaaggctgccagctgtccacctgaggcactctgcattccagtttgctctcaacctcattgctcactctgtttctccgtgtacatttggagttttcctcccttcacttttttcttcttcactgtctttacgttttgtccacttttgtttggcaaggtcaggagcagcctggaagtcatggtctactgggggaggggtcacccttagggaaaacaggcttacttttcctaaggaaattaggataactctagctgacccctgtggggagaaattggcatttccctcccatttctgctctgtctccgtattgccattggtgggtgactacctcttttccctggtgtccgattcatccccatttattatcttcctcttttttggggggtccttccctgccttggccttgtagacttggggcagggtagctctttgcagttggctgatgacattctcagggcaatgttcaacctgcacctgtgtcctctgtagcttctgtaggcctatttgtggatcaaagttttgattccactcaggaaagatcccaacgaaaagaagcttcctgattatttgtcctttaagcggaacatgaccagtggctccttgttcctcattatgtatgtcaccatgcattgacgtcttcctgaactggatacttcaggactactacagtggcatggacctttctgttcttgttctccttctgatttttcttcctcttcctcctcctactttttttctttaattttcctttttttatcctcttgctcctcctcttccagttcatcttctcctccatcttcttctactcctatttttcctcctcctcctccttcttcttcttattgttgttgttgttcttcttcttcttcctcttcctcttcctttctttctccttcttcttcgtcctcctcctcctctgtctctttttttttctttttaatttttttttctttgcttttgcctcttcttatgcttctctttttcacttcacttttggatttgggtgggcaagtgttctaggagactgcttcttcttttgctccttggttatgctggatgtctgtctgcagcactaggcctggagaaagcttcactttctttcttacaggagcacagatgaaggtcatcagtttagtccctctggtccaccaaaaagctgcccacatgttatatttaagtaaaatgtcgtggtgaacgcacccttacctcgtacctcatgggttgccattatttcccattctccttaaggatgttggaagtgtgtaatcctgagccattaggagctttggcaacttgtcctctgtctcttttttttccagtcaagccatgtgaacacattgatctggatatcagggtgtgcaggcagggtgtctctgccacgtgttcatttgcctactctcactcacacaggcaggcacccacagaccacagacacaatgcacttactcacaagggaccctgcaaccagaaataaaatcacaaacacatgcacacaaagagacacatgcacgtgcagacacaaacattcatgtcaaatacgcccaagcagacacacacacacacaaacacacacaagttaactcacactagcaaaggggtgtgagctcaagcattattggacacagacacacacaccccaccacaggcccaaaactgcccacaatctcttccacactggttctaaatgtgcaaagcagaatgtgagacaggcgagcattcctggctccaggcctgggtcatcatgccatttattgggcaactagggccttctcctgagaatgaatgtgggaagtctgttatcagataggcccaagcagcaggtgtgaaactggagcatcctgggtcaagctgcttaaaaacggaccctgcaaccagggtaggggcagagaaagtcccctcaggagccttgtccctatgggatgccatgagaatctgtggcacgtggtggccttcctcagcctccctgagccaccatcctcccaccccgcctgtgtaaaagccaagacagcctgagcagagtcagacttgagtgagttgctgagtgtcccccgtgagggagactccgggattctggtgacctccatgtgccatcccaaggtggtaaactctacctgcagctccaggctttggaggaccctcagttctggggaaaattgttttgtaatccagctgagtggccagcgccttgtcctggggtggcagccctgtgatcccagtcctcctgtggtttcccagaggccatgattatgtgtcctttgtcttttactttctgcactggtgggagccataatacctggagaggaccaaaggaagggcaaaggctggctgcctctacagcattctgcaggatctccagtctacaggtccttggtcctagggtcccctaaatttggtggtcaacctgggaccaggtggctggttcctttgtcttctccttgtcttttttttctccttcctctttacttttttcacatgggaaagcatggagggcctcagcttggaggggcagttgaggtagtagttggcatttgtggagccatactgccatcaagcggaaactatttctggaaacgggaggcagctgggcacaactgctggggaaatccgaggggcacaaaagagatggtggcgtgtggcccccagactgaagctggatgagagaggaaccccttgctggcccttcgcctgggctcattcttaggatggcaccctggctccacagctgtctttaggaaagggcagtcaggccggctgtgagcaagcagagcttcataggacagaaaatggcttcccctggcagtctccaggaactgccaggcatgagtcaccccacactcagcatcctgaagctccttttcctcccgggagggtaggggctccctgttccccctgtggccccccaagggcacctcggagctgcccacaaaagagaccagggtaaacagccccattctcatccatcagttgccagtggcttcccttatgcacatctcaaaatggctgctggggcagctccaccctgtgggttgactggtctgcaggctgcatggctgctctgtctctgggcctctagagtagctgcttctccaaggggtcccaacggcaggtacgctttgttctagggctctaaaccctggtcggggaaaccctggctcaggcagagtccacccagccccgcatatttttgctgacctcggtgcctagcagaaggcaagtgtttccgcagcctgttgtcatgttcagaaacaccttctgctggatggcactgcgactccacaaatggcagtcatgtcttcttcttcccccactgtgccttcgtctttctccatttcctgccaactgaacaaaaccaacacaaaaaaacaaaagcaaagaaacaaagaaagaaactgtccaaggagtacccacctcacctatagcaggtctccccacctacgaggtcactttgcggaaacctgcaacagtaggagggttctctgccttcccccttccctctagattcttctctgggcaggggtcccagtgaattagaggatcctatcctcaatacatcccacccttaggcggtggcatggtgggggtaggttgcactgggggcagtgtgagggggtacagggggaggggtgtgtgggtgagtgggcctgcgtgtgggcccctgccgattcctctatgaatctgcacaggtctcctaagaagagaccaggccgaatgctggtgcacaccacacttgtctctaggcagcagtctttttcttgctgaaaggttaaaagcttggatggaaagcagccagttcaaacaggtatccatacattgttgacccatccagctgcagggattcgggccagatatttcttgtgatgggactggatgggagggactcttgtctgagaccttcagcgacctctctcactggagcccaggcactcattcgtgcccagaagtgggaggggtatttctgggtgaatttcacagttggctcttctggagagagagccacttggcatgtctgatagagcatgcatgcttactggaacgtggtggttcaccagttagttgttctggcatcttggtcattctgccaaagtgcatgggtagctcgctttcacctgggcctgtctgtgttgctgtgctgcgtgtgaaaggagagattttatgtggagtgttttaatttgtggttgggcaattgtgccttggtttgatacagagctctctggggtcctcaaggtaaactctggtgcttgctggatattcatcccagaaaatgaatgagatggtcgaggacaaattatgccggccctttagggtctccaggcagacataagaaagcctgacgtggtccatcatacaaagcccatgttgggatgcgaagccatgaccgtgttgctctaaaggttacatatgctacccatgctgctcagtgcctgggcagcagcttggaacacaatgctctctgaatattgcaactgttctctgtctttgcttgttacaagtctttcttgatgtgtaggctgcactgggaacaggcagagtttcacaggacagaaaatttaccccatgggtaatgattcccacaatcaggggtgcgtgaaccactctcacaagaggaacgtcaatctcgtgtatgggcctgcactctctgggcattccgtggagaagacccacatgaccatggaacaggcttcacccgatttcttttaattgtcaacaaatgcaggtccttttttcatatgtaggtagcatccaccacgggcgcacctctggccctgcctagggaaaacgcgagaataaaagaatgcaggaagatctggactgtgtctttaggggtggcattgtgactctgagtttcagaggttctcgtttttaacttttaacccccattatgtctcaactttttcctgtcttcatctgtgcttgcataggtcctcaggcacatccatgtatccccacccatgctcataagtgtctgcccagacaccttcattcacacctgtgtctggtcctctaggccgctctcagtgggcagtttttcaggtttccggttccctcttcatctttcttgtccctttctgtctgacttcccagtatttgttggcataatgttcaggatggggttggggtgggggcagcggggagcagggcagccccctggcctaacaggcctctgtgcggatgtggtggagatctgggattatgggactgactctttctcctggctgatggctccctctctgtgagcccacaggaggccacttgggctgccagctgcccacctggagcactctgcattccagttcactctcaacttcattgctcactctgattctttgtgtagttttggaggttttctcccttcacttttttcttctttactctttttacttttcattcacttttgtttggggaggtcaggatcagcctggaagtcagggtcaactgggctagggaacacccttagggaaaacaaacttatttttcctaaggaaattagaaggaccccagctgatccctgcaaggagtgattggcatttccctttcctttctgccctctctccatattgccatttgtggctgattatctcttttccctgatatatatttcctccccgtttttcatcttcctctctttttgggggtccttccctgccttggccttgtaggcttggggctcagtggttccttgcagtctgctgatgacatcctcagggcactgttcagcctacacctgtgtcttctgtagctcctgcaggactatttgtggatcaaagcttttgatcccactcaggaaagatctcattgacaagaagcttctcggttgtgtgtcctttaagtgggacatgaccggtggctccctgccactcgttgtgtatgtcatcacacattcaggtccccctgaactagatccttcaggagagctacagtgtcatggacctcccacttcctattctttttctccttctgtttcttcttccttttcctactcctgctcctcttctttattgttcttttcctcctttcctcctcctcctcctccaactccctctccttcttcttctttttctttccctcttcttctttcttcttcttcttcctcttcttccccttccctccttctccttcttcttcttcctcttcctcttcttctctccttctttccttttcctcctccttctccttcttcttttcttctttgacttctctttttgccttctttttctttctctccttcttttctatttctccttctacatctttttttctacttttcttctccttcttcttctacttgttcttctttctttcctttttttttcacttttggatttctgcatgcaaatgttctagcagattgcttcttcttctccttggtgatggggaatgtccttctgcagctctaggcctcaagaaatgcttcacttttcttcttaaaagaacagcgatgaaggtcaccagttcagtccttcttttccaccaaaaagctgtcctcgtgttacttttaagtgaaatgtcatggtaaacacaccctgtacctagtaccttatagcccaccattctttcctgttctccttgtggactctctaaatgtgtaaacctgagtcagtaggagcctcagcaatttgttacattgttcccctattgcctttccttccagtcaggccaggtgaacaaaacgatacggatttcagtgtgtacagtcaggctgtctctgccatgtgccaatttgcccactctcactcacacaagcaggaactcacagaccacagacacagaacacatgcacacactcacaagaaaccccacaaccagaaatgaaattacaaaacccatacacacatggagatacatgcagatgcagacacaaacacacatgcagacacacacacgcaggcacactgacacataaagtcacacatacacaaccagaccaataaacaggtaacctcacatgggcacaggggttggggctcaagcattctcacacttagaggtaaacaaacacacaaagccacaggcatgagactgcccacactgtctcatacgggctcttaatctctgacaagcaatgggctatgggcaagcattcctggcttcaggcctgggtcctcatgccattgattgggcaacttggctttctcccaaaaatgaatgcgggcaatcttttatcagaaaggccacagcagcagatgtgaaactggagcatcctgggtcaacccgcttaaaaacagactcccctttcagatagaggcagagagagtcctgttgggatccttagccctttgtgatgtcatgggaatctgtggcaacgtggtggcctttttgagtccccctaagccacatcctcccacccctgcctgtgtgaaagccaggacagcctgtgcagagtcagacttgcacgagttgctgagtgtgctttctaagggatacacctgcctcaggtcctgtggctccctgttgagcagtctgcccgttctggtgacctccatctgccagcccaaggcggtaaactacctagagcctttgggaggactcctagtcctgcagtaaaaccttgtgtaagccagctgagtgaccagcaccttgtcttggaacggcagccctttaatcccaagcctcttgtgtcccagtgcccatgattatctgtcatttgtcttttactttctgcaggagcaggagacatgaaacctggagaaggccaaagaagggcaaagactggctgcctaaacagtattcctgcagggtctccagcctactggtccttggtcattgggacctgtgagttttggtggtcaacctgggaccagttggctcgttcctttctctccctcctgtctttttctcgttctccttcctatttgcttttttcacattggaaaaggtggaggccctcagggtggaggagcagggttacaactgtacttggcgtttgtggagccatagtgccatcaagtggaaattgtttctggaaatgggaggcacctgagctcatgtgctgaggaacgctcgggagtgccagacagatggtggtgtggagcccccaggctgaagctgggagaggaactcctgtctggcccatggtctatgctcattcccaggatagcgccctggctccacagctctctttgtaagaatggacaggcaggggcggcccaccatgggttcccctggcagcccccagagactgcttggcatgagttgccccaccccagcatcccaaaacttctttgttcccagggaggatagggtgcccctgtccctgcgtggccccagccaagggcacccctgaactctccacaaaagagaccagagcaaatggccccagtctcggcagtcagtgaacagtggtttctcttaaacccatttcaagatggggaagctccgcccactgggctgactggtcttggggctgccagactgttctgtccccgggcctctagcttagctgcttcttcatggagttccaatggcaggtacacttccttaagggctctgaaccccagtgggggaaaccctggcttgggcctagtctacccagcctggcacatcctcgctgatatctgtgactggaagaaggcaagtgtccttgtagtctgttgtcaagaaacaccttccgccggatggcactgtgactccacaaatggcaatcaccccttttccttcctccactttgcctttctctccttccttttgctgccaaccaaacaaaacaaacacacacaaaaaaaacaaagaaacaaagaaactgcccaagcagcacccacctcatcttcaacagggctccccacctatgtggttactttggggaaacttgcaacagtaggagtgatgtctgcctctcctaccctctggattcttctctgggcagggggtcccagtaatccagaggagcctatcctcaagaaatgctatgcttttgctgtggatttgtagcaccgggggcagtgtgagggggtaaagggggaggggtgtgtgggtgtttaggcctgtgtgtgggccgctgcagattcttctatgaatctgcacaggtctcctcagaaggagactggtgcctgcctagggaaaacataggaagaaaagaatgcaggaagatctggactgtgtccttaggggtggcaaggtgactttgagtgtcagaaatcctcatttgtaatatttaactcccatctcatctaacttttttcctgtcttcatctgtgcttctatatgttctcaggcacatacatgcatccccaccaatactcactaaaaggtgtctgcccaggcacctgtgctcacactcagatccccacatctaggtaactctcaatgggaagggttcttcagcttcccggttttctcttattcatttttgttctccctttctgtctggcttcccagtatttgctggtggagtgtgtgggatggtgtgggggtgggggcagtgtggagcagcgcagtctcttggctccactggcctctgtgtggacccagtacaaaccctggcctaagggtctgatgcttttctctggtaggtgactcttcttgtacgaaggcacaagaggccatttgggcagccacctttccacctgggatatcctgcatttcagttcactctcaacctcattgctcaccctgattctttgtgtacttttggagtttttcttccttcacttttttcttcttcactctttacttttcatcaatttctggtttagggagttcaggatcagcctgcaaaagcagggtcgggtgggcacaggaatgtccttagggagagtaagcctacttttcctaaggaaatcagaaggacccgggctgaaccctgggggtgtaagcagcatccccctcccctatctgccttctgtcagtgttgccataggtggctcattacctcctttctctggtatccatttcctccccgttttacatctctcctcccacccatttccggggtacttccctacccaggccttgtagattagaagcccgtggccccttgcagtgcgctgatgacatctggagggcatggctcagcctgcacctctgtcctctgtagcttctctaggcctacttgtagatcaaagcccttgataccactcggaaaagaacccatcaacaagaagcttcttggtgttgtgtcctttcaccgggacatcacaggtttctctttgcctcttgttgtgtatgccaccatgcagtgaggcacccctgaactaggtccttcaggacagctgctgtggcgtgaagctgccacttcttgttcttattgtctttctggttcttcttcctcttcctcctcctcctcttttttctttttctttttcttctactccttctccttctccttctcatttttctcttctttcttctctttttcctttcacttttggctcttggcgggtcaagcattatactgagactgcttcttcctctgctcctggtgatgcaggatgcccctttgcagaacaaaagtgagaaaggcctcatttgttcttaaaggagcagatatgaaggtcaccagttcagtccctctggtgttccacaaaggcgccaatgtgttacttttcatgaaatgtcaccatgaacccaccccttaacctgttcctcatggctcaccattctttcccattctctttgtggatgctctaaatgtgtaatcctgagccagcaggagccttggcaagttgtccccctttgtcttttctttcaatccagccatgtgaacacaacgatccagatttcagtgtgtataggcaggctgtctctcccacgtgcccatttgcccactctcactcacacaggcaggcacccagagaccacagacacagacacaaccacatggactcacagggaaaccccgacaaccacaaatataatcacaaacacacatgcacagggagatacacacacagacacaaagacatacactaacacatgcacactcacaaactcatagacacacacacacacacacacacacacacacacacacacaaatcctcacacaggcccaggggtgcgggctcaagcattcacccacacagacgcacacacacatgtgtcgccatagccaccagactgcccacgaactctcccataaaggctctcagtcggccacaggcaatgggctatgggtgaggattcctggctccaggcctgggtcattatgctgttgattgggcacctaaggccttctcctgagaatgaatgcgggaagtctgttatcagataagccccagcagccagtgtgaaactggagcctcctgggtcaacctgcttaaaaagggaccacaccttgggtagaggcagacagtccccttgggacccttggccctctgtgatgccatgggaatctgtgttgcgtggtggccttccccagttcccctaagccaccctcatgtcacccctcccccccaccccatgtgaaagccaggacagcctgcacagagtcagacttcagtcagttgctgagtatcccctctgagggagattcctgccacacgccctgtgactgcctgttgagctgttcgctcattttggtgacctccatgtgccagcccaaggtggtaaactctatctggagctccaggctttgggagaaccaccagtcctgcagcaaaaccttgggtaattcagctgggtgaccagcaccttgtcctggggcggcagccccatgatcccagtcttcctgtggtttcccagtggccatgattatgtatcatttgtcttctatttttctgcatgagcatgagccatgaaacctggagagggccaaaggaaaagcaaaggctggcggcataaagaggatttccgcagtgtctcctgcctactggtcctaggtcgtagggtcccttaagtttggtggtcaacctgagaccaggtggctggctcctttttatcctccctgtcttttttttgtttctctttcccttttctttttttcacattggaaagggtggaggccgtcggattggaggggcagggttaagcttgtagttggcctttgtagagccatagtgccatcgagcggaatctgtttctggaaactggaggcagctgggcatgagtgctggagaaatcccaggagcacgaaagagatggtggcggtgtggggcccccaggctgaagctggacgagagaggaactcctggctggccctttgcccttgctcattaccaggatggcacccgggctccacagccctctccgaaaaaagggcaggaaggggcggccctccatgggttcccctggccatctccaggaattgccgggcaggagtcgtcccgcccacagcaccccacagctccttggttcactgggaggataggggacctctggccccagcgtgattccaggcaagggcaccccagaactccccacaaaagagaccagtgtaaacgaccccagtctcggccgtcagtagtcagtggcttcccttaagcccacctcaagatggctgccagggcacctccgcactctggactgactggtcttggggctgcctggctgctctgtccctgggcctctagattagctgcttctccgtggggtccaaatggcaggcacacttccttcaaaggtttaaaaccgcgatgggggaaactctggcttagtcagagtccacccagcccgacatattctcgctgaagtctgtgcctgtcagaaggcaagtatccctgcagccggtcgtgttcagaaacaactgccgctggatggcagtgtggctccagaaatggcagtcacttatttcccttgcttttctctttctccttttgcttccaacaaaacaaaacaaaacaaaaagaaaagaaagaaagaaagaaaccggccaaggagcgctcacctcatctacagcaggactccccacctacatggtctctttggggaaacctgcaacatgcgaaaggctctctgcctccctccttccctctggattcctctctgggcaggggtcccagtgagccagaggagcctatcctcaagaaatcccacccttggggctgtggcatggtggggataggtcgcactgggggcaatgtgaaggggtatgggggaggggtgtgtgagtgcatgggcctgcttgtaggccactgctgattacttctctgaatttgcacaagcctcctaaggagaccaggctgcctgcttgtgagcactacgcttgtaaatagggaacacactgtttcttggggaagggacaaaagcttggatcaaaagcacccaggtccaacaggcatccatagattgttgacccttctagcagaagaaggtcgggccaggtgtctgtcaggatgagactcgacagattggacacctgtcccaggccttcagctacttttctcactggagcccaggcactcatccatgcccaagagtaggaggggtattctgggtggcttccacaggcggctctcctagagaaagccacttggcatagctgatggagcatgtgtgctcactgaatgtgatggctcaccagttaattccccgggcatcttagtcattctgccaaatacatgggtagccaggccccagccatgctcactttcgcctgggcctcctctgtgttcctgtgctgggcatggaagtgaaggttgaggctggcgtgtctttgcagatggtgaggtggctgttccttggtttgataccgagcactctgggctcctcaagctgaattctattgcttgtcagattattcagcctggaaaatggatgagacagtggaggacaaattgtgccaccccttttgggtctccaggcagaaatgggaaagccatgcatgggtccttcatacagaacacttgttgagatgcaaagctgtggcctcattgctctaaaggttgcatgtcttacccatgcctctcagtgactggagagcagcatggaacacaaccatctcagaatattgcaaatgttttctttcttcgcttgttacaagtcttcctggatgtgtaggctgcactgggaacgtgcagagctttagaggagagaaaattcaccctacaggttatgattcccacactcagaggggtatgacctactctcacgaacgtcagtttcatgcatgggcttgcactctcagggcattccaggaagaagggcaacagtaccatggaacaggaatcactccctttctgtcacttgtcaacaaatgtggatccttttctcatgtgtagtaatcaccatgggggcacctccagtgcctgcataaggaaaatgcaagaagaaaggaatgcaggaagatctggacagagttcttcggggtggcattgggagtctgaatgtcagaggtcctcatttttaacatttaactcccatcacatctcacctttttcctgtctttatctgtgcttccatacatcctcaggcacatacatgtatcctcacccatagtcactcaaaagtgtaggcccaggcacctcccgtaaaacctggatcccattgtctagacaactctaactgggcagggttcctcagcttccaggttctcttttgttcatctttcttgtccctatctgtgtggctttccaatatttgctggcagaggatgcaggatggggtggtggtgggggcagtggggaccagggcagcctccaggcttgccaggcctctgtgccaatgtggtgcagacctgggactaaggggctgactctcttggctgatggctcttcctcctctgtgaggccacaggaggccacttgggctactacctgtctacttggtacactctgcattccaattcactctcatcctcattgctcactctaattctttgtgtacttttggagtttttctcccttcactttttttttattatacttaaagttctggggtacatgtgcagaacacgcaggtttgttacatagatatagacgtgccatggtggtttgctgaacccatcaactcgtcacctacattaggtatttctcttaatgctatccctcccctagctccccaccccatgacaggccccggtgtgtgatgttcccctccctgtgtccatgtgttctcattgttcaactcccacttatgagtgagaacatgtggtgtttggttttctgttcttctgttagtttgctgagaatgatggtatccagcttcatccatgtctctgcaaaggacatgaactcatccattttatggctgcatagtattccatgatgtatatgggccacattttctttatccatcttatcattgatgggcatttgggttggttccaagtctttgcttttgtgaacagtcccgcagtaaacatatgtgtgcatgtctctttagagtagaatgatttataatcctttgggtatgtacccagtaataagattgatgagtcaaatggtatttttagttctagatgcttgaagaattgccacactgtcttccagagtggttgaactaattgacactcccaccaacagtgtaaaagcattcttatttctccacatcctcttcagcatctgttattttctgactttttaatgatcaccattgtaacgggcatgaaatggtatctcattctggttttgatttgcatttctctaaagcccagtgatgatgagcttttttatatgttcattggctgcataaatgtcttctcttgagaagtctctgctcatatctttcgcccactttttgatggggttgtttttttcttgtaaattggtttaagttctttgtagattctggatattagccctttgtcagatgggtagattgcaaagagtttctcccattctgtaggttgccttttcactctgatgatagtttcttttgctgtacagaagctctttagtttaattatatcccatttgtctattttggcttttgttgccattgcttttggtgttttagtcatgaagtctttgcccacgcctgtattctgaatggtattgcctaggttttcttctaggttttttatggttttaggttttaggtttaagtctttaatccatcttgagttaatttttgtataaagtgtaaggaagggttccagtttcacctttctgcatatggctagccagttttcccagcaccatttattaaatagaaaatccttccccatggcttgttattgccaggttcatcaaatattaggtggctgtagatgtgtggtgttatttctgaggcctccattctgttccattggtttatatatctgttttggtaccagtatcatgctgttttggttactgtagccttgtagtgtagtttgaagttaggcagcgtgatgcttccagctttgttctctttgcttaggattgtcttggctatttgggctcttttttggttccatttgaactttaaagtagtttttttctaattctgtgaagagagtcaggggtagcttgatggggatagcattgaatctataaattaccctgggcagtatggccattttcatgatattgattcttcccatccatgagcatggaatgtccttccatttgtttgtgtcctcttttatttcattgagcagtagtttgtagttatccttaaagaggtccttcacatcccttataagttggattcctagggattttattctctttgtagtaattgtgaatgggagttcactcatgatttggctctgtgtttgtctgttcttggggtataggaatgcttgtgatgtttggacattgattttgtatcctgagactttgctgaagtagcttatcagcctaaggagattttgggctgagacgatggggttttctaaatatacaatcatgttatctgcaaacagagacaatttgacttcctctttttctaattgaataccctttatttctttctcttgcctgattgccctggccagaacttccaatactgtgttgaataggagtggtgagagagggcattcttgtcttgtgccagttttcaaagggagtacttccagttttttcccattcagtatgatattggctgtgggtttgtcatgaatagctcttattgttttgagatacattccatcaatacctagtttattgaaagtttttagcatgaaggctgttgtatttgtcggaggccttttctgcatctattgagataagtgtgtggttttttgtcattagttctgtttatgtgatggattaagtttattgatttgaatatgttgaaccagccttgcatcccagggatgaagccgacttgatcgtggtggataagctttttcaaatgctgcctaaaatcctctttctttgttgtgtctctgtcaggctttggtatcaggatgatgctggcctcataaaagttggggagttagggaggattccctctttttctattgtttggaatagtttcagaaggaatggtaccagctcctctttgtacctctggtagaattcgtctgtgaatccgtctggtcctggactcttttttggtcagtaggctattaattgctccctcaatttcagagcctgttattggtctattcagggattcaacttcttcctggttttgtcttgggagaaggtacatgtccaggaacttatccatttcttcaagattttctagtttatttgcatagaagtatttatagtattctctgatggtagtttgtatttctgtgggatcagtggtgatatcccctttatcattttttatcacatctatttgattcttctctcttttcttctttattaggctggctagaggtctatctattttgttgatcttttcaaaaaacgagctcctggattcattgatttttttgatgggtttttcttgtctctgtattcttcagttctgatttgatcctagttatttcttgccttctgctagattttgaatttgtttgcttctgcttctctatttcttttaaatgtgatattaggttgttgattttagatctctcctgctttctcttgtgggcatttagtgctataagtttccctctccacactgctttaaacgcatccctgagattctggtacgttgtgtctttgttctcattcattcaaggaacatatttatttctgcctttatttcgttatttacgcagtagtcattcagatgcaggctgttcagttttcatgtagctgtgcggttttgagtgagattcttaatcctgagttgtaatttgattgcactgtggtcttagagactgttataatttccgttcttttgcatttgctgaggagtgttttacttccaattatttggtcagttttagaataagtgcaatgtgctgctgagaagaatgtatattttgttgatttggggtggagagttctgtagatgtctattaggttcacttggtccagagctgagttcaagtcctggatatccttgttaattttctttctcgttgatctatctaatattgacagtggggtgttaaagtctcccactgtttttgtgtgggaatgtaagtctctttgtaggtctctaagaacttgctttatgaatctgtgtgctcctgtattgagtgcatatatattgaggatagttagctcttcttgttgcattgatttatttaccattatgtaatgtccttctttgtctcttttgatctttgttcatgtaaactctgttttatcagagactaggattgcaacccctgctttttttggctttccatttgcttggtaagtattcctccatctcttttgttgagcctgtgtgtgtctttgcatgtgggatgggtctcctgaatacagcacaccaatgggtcctaactctttatccaatttgccagtctgtgcttttaattggggcatttagcccatttacatttaaggttaatattgttatgtgtgcatttaatcctgtcgttatgatgctagctggtttttttgcctgttagttgatgcagtttcttcatcatgttgacagtctttacaatttagtatgtttttgcagtggctggtactggttgatccttccatgtttagtgcttccttcaggagctcttgtaaggcaggcctggtggtgacaaaacctctcagcatttgcttgtctgtaaaggattttatttctcctttgcctatgaaacttagtttggctgaatatgaaattctgggttgaagattcttttctttaagaatgttgaatattggcccccactcttttctggcttgtagggtttctcccgagagacctgctgttagtctgattggcttcccttgtaacccaacctttctctctgtctgcccttaatattttttccttcatttcaaccttggtgaatctgacaattatgtgtcttggggttgctcttctcgaggagtatgtttgtggtgttttctgtatttcctgaatttcaatgttggcctgccttgctagattggggaagttctcctggataatatcatgaagagtcttttccaacttggttccattctccctgtcactttcacgtacaccaatcaaatgtagttttggtctttccacatagtcccatatttcttggaggttttgctcatttcttgttactcttttttctctaatcttgtcttcttgctttattttattgagttgatcttcaatctctgatatcctttcttctgcttgatccattcagctattgatacctgtgtatgcttcacgaagttcttgtgctgtgtttttcagctccatcaggtcatttatcttcctctctaaactggttattctagttagcaattcatctaaccttttttcaaggttcttagcttccttgcattgggttagaacatgttcctttagcttggaggagtttgttattactcaccttttcaaggctacttctgttaatttttccaactcattctctgtccagttttgttcctttgctggtgaggagttatgatcctttggaggagaaaaagtgttcggtttttggaattttcaacctttttgtgctggtttctccccatcttcatggatttatctacctttggtctttgaagttggtgaccatcagctgaggtctctgattggatgttctttctgttgatgttgatactattcctttctgtttgttagtttttcttctaacagtctggctcctctgctgcaggtctgctggagttttgctggaggtccactccagaccctgtttgcctgggtatcactagcggaggctgcagaccagcaaagattgctgcctgttctttcctctggaacctttgtcccagagagacacctgccagatgccagccagagctcttctgtatgaggtatctgtcagttcctactgggaggtgtctcccagtcaggatacatgagtgtcagggattcacttgaggaggcagtctgtcccttatcagagctcaaacgctgtggtgggagatctgctgctctattcagaggtaccaggcagggacgtttaaatctgctgaagctgcacccccaactgttccttcccccaggtgctctgtcacaaggaggtgggggttttatctataagtccctgactggaactgctgcctttttttcagagatgccctgtgcagagaggaggggatctggagaggcaggttggccacagtggccttgctgagctgcggtgggctccacccagttcgaactttccagcagctttgtttacactgtaagggtaaaactgcctacttaagcctcagcaatggcatatgccactccccccaccaagctccagggtcccaggtcaagctcagagtggtgtgctagcagcaagaatttcaagccagtagatcttagcttgctgggctccatggggttgggacccgccgagccagaccggttggccccctggcttcagcctcctttccaagggagtgaatggttttgtctggctggacttctgagtgccactgaggcatgaaaaaaaaacaacttttgtggctagcttggtgtctgcccaaacggccacccagttttgtgctagaaacccagggccctggtggcatgggcactggagtgaatctcctggtctgcgggttgtgaagaccatgggaaaagtgcagtgtctgtgctggagtgcatggtatagtccctaatggcttcccttggctaggagagggagttccctgacaccttgcactttcttggtgaggtgacacccctaccctgctttggctgaccctccttgggctgcacccactatccaaccagtcccagtgagatgaacctggtacctcagtttgaaatgcagaaatcacccatcttctgcatcgatctcgctgggagctgcagactggaactgctcctattccaccatcttgccagcttcccacttttttttatcttcactgtctttacttttagtccacttgtggtttggggagggtcgggtgggcacaggcacatcattagggagaacatgcttacttttcctaagaaaattagatggatcctggctgacccctgaagtgcataatcagaatccccctcctctttctgccctccctattgccataggtggctgattacctctttttcttggtgtccggtttctccccatttttcatctctcctcccatttccagagtccttccctcccttggccttatgtactagggacttgatggccccttgaagtgtgctgatgatattcagagggcaagattttgcctgtacctttgttctcttttgctcctgcaaggctacttgtggatcagagcccttgatcccactcagaaaggaccccatcaatgagaagcttttcagtggtgtgtcctttcacccggacgtcactcatatctctttgtcacttgttgtgtatgtcaccacgcagtgatacacccctgaactagatctttcaggacagctttggtgacacgaagctgccacttgttgttgttctttttctcctctttctttcttcttcttcttcctttttcctttcactttcagctctctgcgggacaaatgttctatcgagactgcttcttctgctcattggtgatgggtgtgtccccttgcagcaccaggcctggaaggaggcttcactttcatttttaaagaagcagagatgaaagtcaccagttcagtttctctggtgaacaatgagaacacttggacacagggtggggaacatcacacaccggggcctgtcttgctgtgaggggagggggagggatagcattagagatatacctaatgtgaatgatgagttaatgggtgcagaacaccaacatggcacatgtatacatatgtaacaaacctgcacattgtgcacatgtaccctagaacttaaagtatatatataaaacaccacccaggagttacttttaagtgaaatgtcatcgtgaattcatggatttcccagtacctcttggctcgctgtttgtccccattctttttgtggactctgtaaatgtccaatcctgagccagtgggagccttggcaagttgtgtcctgttgcctttctttccagcccagccatgtgaacacaacagcgatccacatttcagtgtgtacaggcaggctgtctctgccacgtgcccattttcccactctcactcacacaggcagatgcccacagaccacagacacacccacacacgcactcagaagggactccacaccccaaaacataatcacaaacacacaagcagagaaacacacaagaaacttgacacgggcacaagggtgtgggcccaagtgttcccccacacagacatgtacgcacatgcacccccacaggcataacactgcccacaaactctcccatacaggctctgaatcaccacttgcgatgggcatgcttttttgtctccaggcctgggtcatcatgccattgattgggtaacttgggcgttcctttgagaatgaatgcaggaagtctgttatcagataggccccagcagttggtgtgaaactggagctttcttggtcaaactgcttaaaaacttacactcggaaaggatcccatcatcacaaagcttcttggttgtgtgttttttcacggggatgtcactggtgtctctttgccactcccgttcattgtcattgcttcttctcagtctgattcttttgtctttttttttgtttttcattttttattttcactgctttacattatttttaacataattggtatcagtttcagtttttttcttttgtgtttttcaatttgttcttttacttttttatttagtactttcagattgtaattgatttttgcattttctttctatcaatttttctggaccgaaggtagtcattttaggtggtgaatttttcttcttcccagtggtggattcatagtgatatcttatcttcttttaatttcatggtttttgagtctttttttattgagttgtttttgagtggttattgaatggctttattgaatgttatatgaaatattttttctccatttattttactctgtaacttttttttttcgtggcttatcagggcatttaagaaacagttttattaaagttgattatatatcaattagggattattaagtcattattttaagaagatcatttctcttttgcatcatatgttttaattttcttttgcttattgtttaagtgacccaagttatgaaccacatttttttttttttttctgagagggagtctcgctctgttgtctaggctggtgtgcagtggtgtgaccttgactcattgcaacctccacctcccaggttcaaccgattcttctgcctcaggctcctgagcagctaggactacaggtgcatgccaccatgcccagctgattttttggtacttttagtagagatggtgtttcaccatgttggcccggatggcctccatctcttgacctcgtgatctgctcacctcggcctcccaaagtgctgggattacagacctgagccaccatacctggtgaaccacatcttctcttccgctgttcaccttagactcttgatcatattttggggtatttctttttttttttaatttgatcaaatgtgatagtaagaaatgtcatattttatgtgtcattaatagctaatagagaatatatttttggaatatatatttaacctttacttcattctataatgctttttacatttctgtcatatcttatacacaatttttactacactgagaaatttattcttaaagtagtgataaatcaactcattttaatataaattcatgattttatagactatatgacttggcttaaatagatctttctgagaaatcaggaaaatttgaaagccatcaataaattatttactctttgataatgaaaatattttaataaaaatgctaaaaacacttaattttaaaccaaaatacagtatagtatctggtaaagagatttaaacctatgttgcaaagatgattaaaatgattcatacgcaatgaccctttatagagattcatttaaattaaaatttatttttctacatcaaaatgaggagatcatcatgactaagaaattttggattactaaattcttaaaaaattgtccacttttaaaattctattaaggtacaataaatcaaacatatactatgttttctttatcatttatagaaatttaaagtatgataacaggtatttcttgttgaggtgattagcttgtctctcatacattggtgtttggagaattgtttactgaaacatttgaaatggtaatccacaaattgtttaacttttttattataccatctgagaatatgtttgcatatttgtgaaaacaattggaaactgtctcagttatgttcattttgagaattactatgttttggtggacacatttgctggaattttgtgcagatatttttaaaatatttaagtttatgtggttactatgagatattattaaataaataaaacatgttcggagtaatgtgtataatacaaactcattttttgtaacaacaaacagaaagagttacatgttggtaagtatatgtgtctttgattggttatggaaaaaattattaggcatttattccatacttttaacatcttttaacctccacagatttagaattgtttttctggaagaaattgttaatcttctcttttatacatttcatgttgttttcctcattttaatgccttcgtattatatttctaaatataattttcttttataaaacatgcaaattttatacgaagaaaaacagcataagtaaacttaaagactatttatatacaatgtggttccatttaaaagatagataatggatgccattaattcatagaatatataatacatttctttatgttaatacagaaacaaagcctgatagaaatatagtcaaagaacaggcaattcataggagacaaaaatatatggccaataataataataaatatagttgactttaatattaggtcatcatatttgccacaatcaaaaaagtctccagaattctcagttttagaaaggatttggttaaatatctactgtctataaaattgtacgtttctaaagtattttatctctatcgtaattttaatgtttgtaagttttgacttgtgttttatttgtagaatatatggaaataattctacatatcaataaattggcttgcttgtagtaaaaatgttgcaagcatattaaatatctttcaacagaatttgaacatctttcaacagttaaaattatactgtaacacgatgcaatattttgaagccattgaaatattgagactgatctatttttatattaaaaattattaagacatttataagtgaataaaaacaaattgccgaagtgtatgctaggatgatctaatttatattataaactccaaatctaaattattatattattataaatactatatatgtgtacatttaaatagaaataaaaaggtctagacagaattgataactatgttttcttctgtaaataggagaaagactgaggaatggtaaaagtttagcagtaagaagaattatgtctatgttgtttgaattatatacagttagattgtattcatgtatttattcatgtattatttgtgtaaataaataaataaatataaaatttccaaggaatataggagtttgtcaaggggctatgagggaacaatgaggctgattgattagttttggaagcctaataaaacaagagtaatagcggtagacatccctgtactttttgggggagaaatatgcctaagataatagaaacatctggtccacctaacagataaattattttgcattcaaatacattagataccaaaaagatgcaggttattgacattgtatgcctttgatttaatatttattaagcactcatctaataattttgcattctctttaacttgcttaatagggaaattggggtgttttctgctcaacagacatatctgacctgtatgataatggaatttctcattataagtcaataaacttttgttctttctgtatctttcagtcttatgatgtaatcagcgcgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaagcgctgtgttagatctatatgactacatctagtaaattgtgaattttaagtaaatattttataagaactcctatgtaaagcattactaaaattagtgttgaaatatgaccttcttcctacatttattcatttatttatgtctatttattcatttattttagtgaaaaatataaggaaagtagaggaaggttaaatccaaaaaagaattgtttccagtacactttctttaatttgctgtcagtttttgcatggaatctacatctttttatgctaatcctcatcctagtattttacatcttaactatttttttctgactgaaatggttgatgtgcttgttttttgtaattttctactttccttctaaaatgcttagtattgaacaaatagaatatcctaattaaaaacagtaataaatattatggtgaaaaaatacaagtaaaatgggaaaacattagatagcagctttcaatatttcatatagttcataaatgtttcaggaattacaaggttatagaaaaaaatttatagactataataatttccagggatataaaaaaataaagcttctacctttgaattgtaataataaaagataaacagacttgaaagcatatattatatctgaaaatgtcagataaacttggcttataaattaaaatataaaataataatacaatttgttcaaataagtaattaaagcttacattgtaaaatgaatatttagagagattgtgaaacctgagtattttacccaatcctctgaaattagtccctagcatcagaattaaagaatctgaaaaatcacaaa

SEQ ID NO: 4637 - DNA, 88206 bp, human
aacaggaggaagccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccaggtcagattctttctcatctaggacatctaggctctttgaaacttatttatgcattctcacaaatttccttccccttttccctgttctttccatgatttcaaaatagaaaaaataacatgcagggattaagcagctctttcacaaaatatgcttgaatgaaatgatggatatttaacgacattaaataattatttgtaatattttagatgaaataattgtagttatattttctaagaaatagacttgaatcttttgatttgcttgaaagtaagtcattggtgccaaggtggagggaaagtgtaataaaaatgctcatgagttgataatttaaagctgggtgatgtatatgtagggatttattatattattctctctacttttgcgtgcattggaaaatttttttgttaaaaaaaaaaaggctggttcaaggccaataaaaagcatctgttgaaggccagccttcagaagtgtatgtctttctctgtgtaaggcaggagagttgaatttttttttttaaagctacaatgtgatagtcaaatccaagtgccataatgtttgcttgttcaaggtattcaggaagggtggaggatggaccaagtcactgcctggtagtaatcatgagccatcaaaaaggaggagtaggggggcggacgcggtggctcacgcctattatcctagcactttgggatgccgaggtgagcagatcaggtcaggagttcgagaccagcgtggccaacacggtgaaaccccgtctctactaaagttacaaaaattagccaggcgtgatggtggacgcctgtaatctcagcaactcgggaggctaaggcaggacaatcatttgaacctggaaggcagaggttgcagtgagccgagatcgcgccattgctctccagcctgggcgacaatagcaaaaaactacgtctcaaaaaaaaaaaaaaaaaaaaaaaaaaaaaaaaaggaaggaggaactttgggtgggccttaaaggttgagtgacatctgccatgtggaggggcagggaatgcttttcaggccgagggtttccagagaaaaggcagaattcttctggaaacagcttggctataattttgaatctacaagaaggactaggaggtgaagataaagtgcttcagggccttaaatgttatgctgagcatatacttcattccaatatccatcaagtgctactatttgtattttaagattcctattcttactatcagaaaaggaatctctgatatttagatgaactttatagaatgcaaattataaaactgaatctgacccaagttttatagatccttttaattcaaaggagagaagcatcttttcttcattcgtgcagtaaacctttatgaagcccttgcaatgggtaggaattattctgagagctgtaggggatggatggccaaggcatagtgcctagtacataataggagtgaaacagatatttcaataaataaatcaatgaatgatgggacaactttggcgaccaaaaaagttttagacattgggtttggtggtaatgcatagaaaaaaaaaaatagaaatctattttacttgaaagcatctccctgtcattccatacagttttacttctcacatgtttacctctattcaaaggggtagtggagtggaaggttgcagggagtagggagaaaattgctcagatagaaaacaaaagagcagccgggcgcagtggctcacgcctgtaatcccagcactttgtgccgctgaggtgggcagatcacctaaggtcaggagttcgagaccagcctggccaatatggcgaaaccccatctctactaaaagtaaaaaaaaaaaaaaaaaaaatagccggtcatggtgttgtgtgcctataatcccagctactcgggacgctgaattaggagaatcgcttgaatccaggaggcagagattgcagtgagccgagatcatgccactgcactccagcctgggcgacagaccgggactcggtgtaaaaaataaataaataaataattttaaaaaataaaaaggaaaaagaaaagaaaacaaaagaacaaaacaataagtgcagtagctacataatttcccctccaagtgattcaaatcactgataattgtaataatagccaatatttactgaagatttatgtgccaattttctaaagggctttgcatgttataatttatttaatcacaactctactagagaagtttgtatagaccaagggaagttgtatgacttgccacaagttacacagcaagaagtagctgagctgagctttgaacccagaacacctgattccagagtttatgctctaaacttctatataatacatcccttctaatactatgtatacaactgttttataggaataaatcattgaaatagaggtatgggaaggataatgatttgaggagaccaagggacaaagagatggacaaaaacagaaaaaatgatgccacaatattttttactatttttcagtctttgagtgattgcagtatgactccatttccctggtgcattcatataatagttcacctggtgaaaacaatgaagattatttacaatgctaccctgctttttctggtgtcctgaacctggaagttgtgctttttaaggtaatctctttaccaaaaattattaagaggaggaagagaaaaaaaagagttggttttgacacattaaaaagtagccaaacaaaactcaaaaagatagcagcaaatgataaaattgaaactatattctacattatatgaaaacatattcataataatagtgtaatctgaagaaatgttttgttagattcacttgtacttatagtttctattattactgtgaaatatatcatctttttaactacattttctaattgtttctagtaaatgggaacatgattgatatttttgtatatttattttatatgctggagccttcttaaattctgtttattctaataatgtatagattttcttggattatctgttaattaattatattttgaataatgacagtttctttacaatatttctttaccttatattactgtgctagctaggatcttcagtacaaagaggaacaacagcattggtagaggatttccttattttgttcctaaattctacaaaagtttcaccttttttagtagattgtctttctcaagttaaggaactttcttaatgttcctagtttgctgagaggttttattacaaatattatgaagttttttcccgtctatatgtactgccactttcatatcctttcttcaccattaatatcacagtgtgaccatgtgataaattacaataatcaattttctaatgtatttcttgcttttgctttcatcgagcctcgtcattggatatttggttcctattttaatcattttgacttttatttttatattgaactttcttctactttccttttattgttctttttctaatttattgagttgaatctttagcatcttaattttcaatgttcttctgtaaaataagaatttagaactataaattttcttctaccactttagaaatatttcacagacttttatatatagtatttttatcattcaatatttattatttttaaatttctcttatgatttttttgacccatggtttgttttttttcaatttctaatcatatgggattccttttttaaaaaatatattatgaaatcattacattattcccattctagtttaactttatcttatttttcttttttaattttttttacatctatagactttattagatgttctttatacagtcatctggtatgtataaagagtgaacaatcatataaaaggaaatatggtcataactgattgaattaataaaatcctgaaactaaataactcataattcattgcacaacatatattaggtttcattagatcagtatatagcttagtagtaaactctcctgatggccataaacctctaaggtgttgtcatcctgaaaaatgaaggaggggagggagctggtggggtgcagaatggagaaaccttccatagtgctggtgtgatgtaccctaagttgtaaagttatagggcatcgccacctagtggcagaatttcatgccttgttctaattaagggactttccttgttttccaaagagcaatgtgtcttgttcactttctaaccatccctctctgatgctgtccttcctaaaatccatgcctcctcccatacagtgtaaacccatctgcttttcatccatcaagctgtcaaggatttggttatgacaatttttatgttcacctaactttttagttccaagtacttcggttattttcaaagctacacacaggatgcccatatttttataactccatcttatttgtgaaggattattactttgtgctttggcctagtttttattcttactgctgaatcttttcataagttaaagttattgcagagttaatgctttaaaaggcagtccttagagtaaatagctaaatgaaatcattaccaaaatgtacactttggatttattaagattctagaatttaaaaacaggaaaaggtgccattagtgaaaattccatcactaacattttggtaccactcgtagagcatcacataaatattcagaccgtgataactcagtgcaggaatgttatcaaatatgtccatgcaatctggaactaggaccagagttggcaattgggggtctgaaggcccaacatcccttacactgcttcctacaccttgacaacaggaaggctgagtgatactaggtagtgcactacaacagtgaacataagccagccatctgttttttgcaaagtataataaaatagaaaaacagaacatagaccacttcagagcaaacaaacatatccttcttcaagatgtaggaaaaccatatattcaaaaccaatctcaaactttaaacaataaaagatatcaaacattttaaactgtacaaagcaaattagcaagattttaatgttggcagttttaaaatgtcacccatccaaaacacaaaacagggagataaccaagtcttagctccatcctaatcaaagctgtcatgcagatccagttccactcttctcatctccagcaggtacttcactcaaggaggtaacacccaaggggagtagatggaccaaaaacaagagtgccacatagaaggaagagaggggaccttggactttagctactggttagctattcaactttgatgatattcagtgttttcccaagttattttttctcgcttctcatcacataatttacattatgcatactatgtgccagagactgtttgacatgtagtcagttaattttcacaactgtgtaaagttggtttctatcattagctctatcttagggccaaagaaactgaagcacggagaggttaaattgtattcctaaagcactacacagtgagcaaatagattcagacctgtgcagtctaacccagaattagctctgaatcactctaccattctgtctacaggacaacaagcctgtgtgtttcaggtactttcatggtgatttttcacacaggacagcttttgataatagaaaggccctctctttcaaatgaaaggacttcactgatggattaacaaattctcaccttttcacctatgtgagccaaatactagatctactttcttagtcttcataacaagcaggacgataaccataatttataatgaacacaaaacattgatatagtgttcaaagaacttttgcacacttggtctcgtttggaagaatgaagtaatctggaaacatagaataggcatacactgtgactttaggaagaactctcacaaaatcagaggttgccctatgtaatatcacactttttaccttgagcaggtggatagcctgggagttcttgttatacctcaatcttggtccattctatttgttcccctgtccttcagcagtgcccttaggcttgctttaaacattaacagcattcataagcatggtttctagggtcagagcccagcctccctccacccacccggctccctacacaccttgacagtgctctttgagatgcctcagttctagtctccttgtaattgtgcacagtagatgtctgaacaaatagaccagagtcctgcaaaagtgatcttgaaatcacaattaaaagagactttggagagatctactcaggaaaattttctgaatagacaaatgcttttaaagggggttctagacagtccgtcttttctgcctccttctgcgaagtagggctacactaaaaccttgtcacaatgtgacctgagcaaaaccattatcaagtgatttagttgtcttgaaccagacaaaagaaaattgacatgatttcaagataggtttagaaaaataatctgactagcaaaaaaaaaaaaaaaaatggggggtggttcctagggaatatgagacttgatattttagcaaaaatttaaatatgctctttatgatacacacatttctcgttgctttacaaattttaaatgtaacacaaatttgtttttcacactgttttgttagttgaggtaaggcattcctgccgcacgcagcaatgactcgtcctggaaaaccagggaggctgcatatcctactgttccttctctactagctgtggctccacactctcacctccaccaaagaaagcatttcagaatttaggggtggaaatgatgacaacattgaataattctatttttttcttttttttgagacagagccactgtcgctcaggctgaagtgcagtggcgcaatctaggcccactgcagcctccgccccccggggtcaagcaattctcctgccgcagcctcccaaacagctgggaccaccggtgcccgccaccatgcccggccaattttccgcatccctagtagagacggggtttcaccatgttggtcaggctgatctcaaattcctgacctcaggagatctgcctgcctcggcctcccaaagtgctgggaccacaggcgtgagccaccacgcccggccaatgattctaatttatatttttaaaaattaccttataatcttaaaacttttaactgatgagtatccaacccttaaactttataacaatcatttccaaagtggaaaagtcactgggatatggggaaaagtatgatttgtttttgtacttctatttttctaatgtctactttttgttttctagtctacatgttagcacaggagtatatatattacttaagtatacctatgttggagtgcatacagaatttctttttaaatgataggatgcaaaatcaaatctatttggatagcagtgaagaggctgtttttcaatcctggcaaactagggggtgcatacccccttttttatttagtagcttccataaggctataactcatggaagttacatccttacataaactgatgggctatccaaccagtgaggaaaactgataaagtggcctctgagctccaggaagtagttaaacactactaaaaacatcttgaaaatttggaaaaaaatttaacagtaaatggattcagtagttattcagtataaggtttggaataactccagccattacaatagacatttatttaaagtaaaacatctgcagaccaaataattcttaaaattgtttgtttcaagtttaaccatcttcataacagctgcatccacagacttcaactacatgattacttctttgcccattcttctctttcttttctttcccgaataacctcttgcacatacagttcaaggtagaaattttcctcttcatatttggtccactgctctttaggcaagatctgatgcttcatggtcaggtccaatgcactcttaatgtgacacatcctgtcattataaaggttctcaggaagccttcttatggcttcttttatgtcttcatcctcatatattgtatcatctctcattaaccccagtttattgaatcctgcagtattgtaataccattttcgaataccatccagccacttgcctgatgctgaaatggcctgcttgccagccattttgacctgctttaattttttttaatccttcttataacaagatacaaaaattatacactggctgctcatcccaacagaatttggcaatataaaacattttctttcattaaatacatagaaaaagtgtggttattgatatttattgatgtagttattattgaattttatatttgtgtttttaaaatttttatttttatttaatttcacacttgaaaaaccaggaatattacaaagaactcccagaatgtcctttacccagattcaccaattaacattttatcacgtttgccttatcattctgtttttctcttcctctcctccttctcctatttgacagtagtttgcaaatatcattctcctttacctcttaatatgtcagtgtgtatttcctcagaatgatgatttcctcttatacatcctcagtaaatgtgtcacaatcaagaaatttgacattgtttcaatatcataatctacgccatattccaatgttatcagttgtcccaataatgtcttttgtggttattttctttccttggtcaaagtgctaatccaagatgatgcattacatttacttgtcatgtctcttcagtttttaatatggaacaattccttgacctttctttgtcttttatgtttatagaaaaacaaacttagtttctctcattatattctcacaaccccacttctgacactgattgtgtggaaaaaaagtttttctttggctcttgtaccacagcaaccaacacagaaagcttgtgaacaaatgtattgggattttttctcaccgacaggcaagtaaacaattctgcagtggacaccagctgggtgttctccaatccaattcaattctgaagctatctccctacagaaagtatcagatcccacagattgagggcttagtcccacgagactgcctcaactttagacatcagtttcaaatctgggcctctggaacttttaactgaccagcttcaagttagggttcccgcaacctctctctttaggctcaaataatttgctagaacaacacacagaactcagggaaacacttacttacatttacccattaacagccagatgaagagatacatagagtgaggtctggaaggctactgagcacaggagcttccattcctgtggagttagggtgtgccaccctcctggcatgtggatgagttatttgtcacctttctgaaatcctccacaaattcagctgtactttgtcctcttgtgctttttatgaagactttatctgataggcactaatgaagcatgaacaaccatgtagaaatgtgactggactaaagggtatgatctaataccaatagacttggtggagaaacccagcaaggcttgtctgttcagattcttcttggtttctctgtgcagcattccttcctcctgggtatggggcaggactctttctgaaatgggagtcttatgacccacagtcaaactaggtaggtcagagaatttctttacgaccagctccaagccagaaagctgggtgaagattagagtatatttttagtttctatggcttgcctttgggagaaaaaaaaagcaggtaaaaggagggcaggagaaagtcagagagagattctgttttgtgaagcctaaagtgccccaacattatacatatatatgtgtgtttgtgtgtgtatatatatatatatatatatatatgtatgtatatatatatatttttatatatatatatatagagagagagagagagagagaaactgtctctcacttttatttctctgaagctgtttcaaagctgcttcaggaaccaaagacaaaagaccaaatactttaacaagagatatgcttatttctttagtcacttaggaaataacaagagatttgggagttataagccaggaaccatggacaaaaaccaatatatatatatcacaatatcacacatcgacaattgacacttgggtaaatacaggacacttatttcatagattgtcctttaatttaaatttgtgtgccatttccccattattcagagtacgcatattagcaaaagcaccacagaagtaatgtattgttctcagggcatcataatggtggtacatgatgctggtttgaccctttagtagtaaagttaactttgattacttggttaatgtggtgaatagttgctagattaatccactttacagttatcattttcctctttataattaatgattttgctggggatactttgagactatgtaaatatcctgttcctcattaaattatcatccactggttttcaaatccattgataattcttgactgaatcagatattgctatgatgaatgcaaaatggtaattttcaaactccatcatttttagtacatttattagtttatattctacatcaaggtagagctttttctccatttatttgtttattaattactttggacacatagatttttactttattttaaaaataccctattgttattatttattttaatacccaaattgtctcagatttagtgactggctgcccattcaagttggctcccctgtcttttgacatgtgtcatcattcttaaacacactttttacttactttaaaatttttttacttccttactttcaagcttgtcttgtacttcctaccccattaatcatttctctatagacctctgttatcttttatggagacagtatttagaaactaagtcattgtatatagctgttttttagcttaacattttgtcattgttttccatttaaaagacaatattgcttatgtgataatgattatttagtgtttgttgaaacttgctttatgtcctagagaacatgatcaactagtgttttatgtgtgcctggaaagattgtgtatctaatttttgcgtgtagtgttctgttcattaaatttaactgtgttgtttaaatcttctctattcctaagttttttgtttgctggacctatcagttaccaagagagttaaaatctcccactgtatttgtgtatttgtcaaattcttacacttttgacaatttttgctttgtatacttgaggcattgttagtatgtacatacaagtctagaatagatacatattttacaattttaggaactctttttatctttttgaatgtaaattttttttgtttgctgggtctttttaattttgtaaaatctttctgggtacctagtagttgtatacatttatggggtatatgagatgttttgatacatgcaaagtgtaataatcacatcatgtacaatggggtatccatcatttcaagcatttatcctttgtgttacagacaatttaattatacagttatattattattgactatagtcaccctgctgtcctatcaaataataggtcttattcattctttttgtatacccgttaaccatccccactctcccccaccacccattacccttcccagcctctggtaaccatctttctactctccatctccatgagttcaattgttttgatttttagattccacaaataagtgagaacatgtgatgtttgtctttctgtgcctggcccatttcacttaacataatgatatccagttccatccatgctgttgtaaataactagatctcattcttttttatgactgattagtactccactatgtatatataccacattttcttcgttcatgtatctgttgatgaacccttaggttgcttctaaatcttagctgttgtaagcagtgctgcaacaaacatgggagtgcagatatctctttgataatactgatttcctttgtttggggtatatacccagcagtgggattgctgggtcatatggtagctcaatttttagttttttgaggaatcttcaaatcgttctccattgtggttgtactaatttacattcccatcaacagtgtacaagcattccctcttctccgcattcttgccagcatttgttattgcctgtcacttggatataagccattttaattgaagtgagataatatcccattgtagttttgatttgcatttccctgatgatcaactacaatgagtactttttcacatgcctgtttgccatttgtatatcttcttttgagaaaggtctattcaaatctttgtcacaattttgatcaaattattagattttttcctattgagttgtttgagctccttatatattttggttattaatttcttgtcaaaagtgtagtttgcaaatattttctcccattgcacctatactttatagactgtttgctttgctgtgcagaagctttttacttgatgtgatcccatttgttcatatttgctttgattgcctttgcttgtggggtattaattaagaaatttttgcccagatcaatgtcctggagatttttcccatattttcttgttgtagtttcatagtttgaggtctttgacttaagtctttaatacattttgatttgatttttgtgtatggcaaaagatagctatctagtttcattcttctgcatatggatatccagttttcccagcaccaattattgaagagactgtcttttccatagtgtatgttcttggcacctttgtggaaaatgagtttgttaggtgtgtggatttgtttctgggttctcagttatctttcattggtctatgtgtctgtttttgtgacaataccatgctgttttgattactgtagttctgtagtataatttgaagtcaggtaatatgattcctccagttttgttctttttgcttaggatagctttggttattctgggtcttttgtggctccatataaattttaggattgttttttctatttctgtgaagaatgttttttgtatttttataagtattgcattgaacctgtagattgctttttgtggcatggacgttttaacaatattgattctttcaattcatgaacatggactatctttccattttttggtgtcctcttcaatttctttcatcagtgttctacagtttttattaaagagatctcccacttctttggttgagttaattgctaggtatttaattttatgtttggccattgtaagtggaattacttttaaatttctttttcagattgcccaatgttggcatgtggaaatgctactgattttcgtatgttgattttgtatcctgcaactttactgaatttatcagttcttatagtttttgtggaatctttatgcttttccaaacacaagatcaaatcctctgcaaacaacggtaatttgacttcttcctttccaatttggatgcccttaatttctttctcttgtctgattgctctaactaggacttgcagtactatgttgaataacagtggtgacaatgggcgtccttgtcatgtttcagatcttagaggaaaagctttcagtttttccctatttggtatgatactagctgtgggtctgttatatatgggttttattatgttgaggtatgttccttctatacccatttttgaaggtttttatcatgacggcatgttgaactttatccaatgctttttcagcatcaagtgaaatgaccatatggtttttgtcctccattgtgttgatactatgtatcaccactgttgaaccatccttccatcccagggataaatcccacttggtcatgatgaataatctttttaatgtattgttgaatttgatttgctagtagtgtgttgaagatgtttgcatcaatatttatcagagatattggcctgtttttttttaatttgtttctgtctgattttggtatcaggcctcatggaattagtttggaagtatcccttcctcctgtatttttcagaatagttcaggtaggattgatattagttcttctttaaatatttggtagaattcagcagtgatgccatcaggtcccaggcttttctttactgggagactttttattatggctttttattggtcttttcaggttttggattatcttcatggttcagtcttgatatgtcatatgtgtagaggagtttctctatttagtctagattttccactttattggcatatagttgctcatagttgccattaatgatcctttgaatttctgcagtatcagttgtaatgtgtcctttttcatctctggttttatttatttggatcttccctctttttttcttagtctgggtaaaggtttgccaaatttgtttcacatttcaaaacaccaactttttatttcatttacttatttattttgtattgttttcttcattccaatttcatttatttcggctctggtgtttattatttcttttcttcctctaattttgagtttagttttctcttgcttttctagttctttaagattcattattggtttctttattttaagttttactttttttttatttaggcactaaataactaaacttatatataactaaactttatagctataaacttccctcttagtactgcttttgctttatcccgtaggtttttgtatgttgtgtttccattatcatttgtttcaagaaatttttcaattttcttcttggtttcttcattgacccactgcttattcaggaacatactgtttaatttccaggtatttgtatagtttccaaaattcttcttgttattgatttctatttttattccattgtggtcaaagatgcttcatattatttcaatttttttgaatgttttaagacttgtattgtgacctaacatatggtcatgtgacctaacatggtggctttagagaatgatccatgtgctgaggaaaagaatgtatattctgcagccgttggatgaaatgttctgtaaatatctgttaggtccatttggtctacagtacagattaagtgtgatgtttctttgttgattttctgttcggaagacctgtccaatgtttccttgctgttaacatagctactccacctttccttttttggtggtatttctttttccattgttttactcattcacttttttctttcttttatcttttacaaaatgttctgccaaaaaatcaatgcattgatttgtttgtttctgaatttaccaatagaatttataattagtattaaggataagctttatatatccaaacattatctttctttactaattttttattttatagaatttaaactctacagaaaagtcaaaagatatctttcatgtattgtagtgccattcttttccaagggagatacattccaaaatccccagtggatgcctggtaacatgaagagtaattaatcctatataaactatgtttttttcctatacatacatatgtatgataaagttaaatttataagttaggcacaatacaagattaacaacaacagtaataaaatagaacaattattacaatattcatagtttcatggatagaagactcattcttaccataggtcttagcaacttcaacacatgatttttttcttcccttattaagttgaaaacttcctccttttcacttaaaggaagcattttacagcttctctttagcatatgtgaactgccagcattatcattcttgcactttggggttactattaagtaaaataaggattacgtgaacataagcactgtgatactgcaacagtttattggataaccaagatggctagcaagtgactgatgggcgggtaaggaatacagcgttgatgtgctggacaaagggatgattcacatctggagcaaacatgagatttcatcacactactcacagtggtgtgaaatttaaaacttatgagtcgtttatggaattttccatttactgttttcagactgcagttaatcatgggtaactgaaactgtggatgaggggggaccactttagattcatcagggcatcaatttggctacatatggcttatctctttttctaaatactatatacatatatgtatatatacatacacagatttttttgctgagccattgggaagtaacttgcagatatcatgacacttcaaccctaaacactaaatcatatatctcttaagaacaattaaattactattacacccagagaaatttaacattgatacaatactattatctaatatactatccatatcaagttctcacaattttcctaacaatatcctttatagctttttatttgttttggtccaggatccagtcaggggtcatgcattgtatttagttgtcatgctcctttttagtctttttaaatctagaatagcaccctccctttttttttcttgtcctttttttgtgacgttgccatttttgatgagtccaggtagttttcctctatatgtctcacagtatgaaatgtgtctgattgttttcccatgattagtttaagcgtttttagcaagaagactacatgggcgatgttctgtccttcttaggcacaaaattctagtttatcccaagagcatagatacctttggggattttacagatagctaggtgggtattttttacttcccccttaagaaagttacttttctggacacgggtcaaattatggtttataatttgcaccatattccatgtctaggttacctgtttacagaaatgctcagcatgaagaggagtttctatatctgttctgccatcacattttcctacttcagagcatttacttagtccggttggttgtctgtctgtgtattcacaaactttcacaatcaactcaatagggaataaagttttttttttcagcagcttcatgtgcagtctccttaagtactttttcctatgacttggtcacttttctccctctcattgtataaagactttctcatactactctatattgatcatttttaagaggcaaatatgatatgatcgagttcctctcctgttattcttacctcctgacatgttatcatagcatctgggtcttctgtctctgggaagataagccagattttattgcatggattctgtattagttttatatttctaccataacaaaatgatcacaaatttagaaatttaaaagaacatatttattatagttctggaggccagaagcctgctatgggtctcatcagacctgatgagaagtcaagctgttggctggctgcattcctttctagaggctctggggggatatgtcctgctcatttggttattggcagaattccgttccttgccactgtagatctgagatctgtagatctcagttccttgccactgtagatctgtagatctgagatccctttcttgctggctatgagctaagagctgttcctagcttctagaggccacccaaattccttagattgtcatctcttttctccatcttcaaagccaaccatggcaaattgagtccctctcatacttagaatttctccattttcttttgtcattacatctttcactgactcagatgatatgcttttaaagatatatgcaattagagtatgcccacccaaataattcagaatattctcccccatctcaagatccttaacttaatcacatcagtaaagttccttttgccttgtaaaataacatagtcatggattcttgtaattgtggtgtggacatctttgggtggccatcattttgcctaccacagattttattatagcagcaagccataacctgacaccgagtgtgtgattcatccattcttttattcaaccaacacaaatattaaagaatgcctattaaattgagcatgtattaaattccaggcattgttttatgtgccagggttacaaaaatataacatctaactcaccaaggagttcataaactggtttggtaagttctgtagatagagattggcacagagttctataagagaatacaagaaggcacatgagcaagactagaagagccaggaatggcctcctgtattgatcaatatctaagctcagtctttgaaatgaaatgaggtactaagtaaggatggatgattgtagatgggtaaagaacttcaagcagtgagaaaataatgaccaaagttacagaactcgaggtaggctggtttttggaggaggtgagatgtatggtaggtagttttcctggagtggagagatggagctagatcagcaagctgaagcataaacatgaagactttgtgcactacaaaggctcaagatagatctgtaggaaatgggatgtgactgacaatcttgaaagagagtgctgtgttcacatttatattttatataggtcatactagtggccatgtggaggatagtatagtagagcaagattggggtaagaagatcatttaagatgcttgtatgaaaatcccgacaaaaagtgatgaaggcttgaactcagccaatggtagttgggatggagcacagatcagtgaatttgagaaagttttatgaagtattattgattagatggtgtatcaatcagggttcaaccagagaaatagaaccagtaggagatatatattaagaaatgtattataaagaattggcttgtgggggctgtgtaggcaagcctgaaatctgtggagtgggctttcaggaaggacagactggaactcctggacatgggctgaagctgatgtcctcaggttaaatttattcagggagaccttagctctggtcttaaggtccatcagctgattgaatcaggtctacccaaattatttaggataatctcctttacttaaagttaactgattatagacagtaatcacatctacaaaatagcttcacagcaaaacctagttaaattgaataactgaggactctagcctagccaaattaacacatcaaaagacaatcacagatgggatgtcaagggaaacagaataatagagggtagttctcaagtatgtggcttgagtattacatgaaatcactaactgagttatagaatacaagaaaaagagcaggttttcaacattttcagtaagatacctagatggaggttcctggcaagcaggtaaagatctgagattgcaagagaagtgttgtccatataaatatatttagataaccatcagcataaaggtgatagataaaaccaggagagtaaattaaataatctagaagaaggtatatatagagaaaagttatggattgagaaggaaattctggggaccactaacatttaaggattatctagagaaagatgaacagataaaggagtaataggatgagggggaaacctgaaaaagtctgatgccgattaagaaaaatgtagtgaacagcaacataatatacattagagggttcagtactgaaaaatatttattaatttgtaaattaagtttattggtgaatttagcattaacggtttccgtgttgtgagagcagaggccagattacagtgggttgaagagttactaggaagtgccaagttgagggtagctggcatacgagatgggatgagaatggaggataaaaattggacaatattttataattaaatgataactgtaagaagattaagagccaagggagtattaaaaaataatggtaggaacttgcagttttattgacttaaagtaacaagaaaaggggtagagactgaagatataggacataagagaattcaaagttactgagaaataaaagaaataggcctggttgttagagagggtgcagtgacaagagaaggacttgttttattctttggataagactagggtattggtactcaatggaggtagtataatcctgagagggtgattggaaagtttgtgaaaggcatttaagataatcattattgaagtgcttcctgacatattgtgggcagggtcagtattgctaaataacctgcaatatgcaagacagcctgcacaatgaaattttctatatcccatacaacttttaaatatatcatcagattaaacacttatttttgttaatctagaccttgaattgaactccattctatatatatataagcaagtttttaatacacactaacttttccaggaatgtaactaccatgtaatccaaggtaaaaacctttgttttgttcagaatcttatcaagaatgtttatcattttggaaaatcgtgatacctacaaaaacgctgctcttggatatttgaaatccagataacaacacacatgcatcagtcagtaattatagctgccacctttacaggcattctctgtatattttttgcatacttcattgtcttctagtgttgtcatgtccccacatttgcatcctttttttttttttttgagacagggtctcactctgacacccaggctcgagtagagtgtcacagtcccatctcactgcagcctcgacctcccgggttcaagcgatcctcctgcctcaaccccccaagtagctgggaccacaggcacatgccgtcatgcccagctaatttttgcgtttgttgtagaaacggggttttgccatgttacccaggctggtctcaaactcctgagcttaagtgattgtccgattcagcctcccaaagtgctaggattacaggcatgaacctccatgcctggctgcacatttacgtcttaaaatacattatattttattataaattactttcttgttatttctatttcatattatagatgttttgaaatttttatcttaatataataaagcattaaaatatttaagaaagggagccagatagaattggaaaccattggcacaggagaaataagataagaatgagtgaaaatgccgatttttaaacaacaatgaagagatttgtgagaatggctaatgcattatgctttgtggaagaggttaccatagttctaattcccaaatccaatgactggattttgggttttatcttgatccttctgcaacgtttaaaattctctgctttcttccattctacaacattcttctcttctagttctccttttacatatctggccattgtttctaactatttttttctgagtacctcctcagcctagatccttaaattgagtggttcctgaatcttcctatttcaatcctcacttcttcttggcaatctcacccactgtcctgggttaaataaaaaaaatatatgcagacgacttccaaatctgtatttctagcacaagctttatgccaggctcaaactcatatagtcacctgcctgctctttctgtgtgattgccttatcaccttagactgaatgttaccaaaactgaactcttcatcaccccaccagcagcaccacaaacctctttattctttattgtttgtactagtacttctaaggcaaaaactagggtatatgtcatgtttcttctctcttacctccactttttaatctgtcaccaagtcataatggttatttcttcaaaatattccatgattttttcttctatctttcatttccaaaactctagtcccattccccggtttggaccctcaacatttttctcctgaatgacaataatagttttctaactgatctcctgcctccagtactgtgtactgactcttggcacagcctttagaatagcctctaaaataaatatctgatcacattgctcccctacttaaaatcctttaatgattttttgcttcctatgaaaatcctttaatgatttcttgctttctatgataatgtctaaagtcttagcatgacctaaaagattctgtatggcatacctcttaatcaagccttatctgttgccaccaattcctacacctcatcccaaactcacacaactttttttttttttggattttatgtgccactagggttttcttgaacatactattatttcatgcagatttctttgtacatttgactccctctaacatctttacacccttgtttacctagtgaacttcattcttcaaattcctgctcatttgtcatagcctcaatattttttttcctcatcctctgtcttcagcctctaaaaataattgcttcctctttactatttctgtgcctggtatttgtctattattgcacatgtcaaacaataacttggtgaatgtacattgaattctcagtgtagtacctttccatctggttgattaggaattttaaaaagaattacaatgcacaacagaagttacttcatttgtttctaggtttttgctttttatggtggtataagtcatagtaaagtacataaatcttaagtatatagctcaatgaatttgtacatatacttatatactagtgtaaacaacacctagatcaaaatataaaacacttccaataccctagaaagcacatttgtgtccttttcaagttaacattcacaaaaagtaaccactattctaacatctgtcaccattgattagtttcgcatattcttgaactttatttaagtggaatcacagaatatgtactctttttaaaattttaactattattttacttgtaggggctacatacgcaggtttattacatggatgtattgcactgacatccattccctcctgcctctagtaatctgcagtgtttattgctcccaagtttatgtccatatgtgttcaatgtttagatcccacttataagtgagaacatgtggtattaggttttctgtttctgcattaattcatttaggattatggactccagctccatccatattgctgcagaggacataatttcattgttttctgtggctgcatagtattccatggtgtacatgaaacacattttcttcatccagtctaccactaatgggcacctaggttgatttaatgtctttgctattgtgaatagtacagtagtgaacatacgagtgcttgtgtctttttggtataatgatctatttattatcagttatgtatacagtaatgggattgctggatcaattggtagctctgttttaaaaatttctttgagaaatctaaactgctttccacagtggctgaactaatttacattcacaccagcaatgtatacgtgttcccattgctccacagcctcaccagtagctattgttttttgactttttatagtagccatcctgattggtgtgagattttttttattgtggttttgatttgcacttcacaagactgtactcttttgtcagataggtttttatttgaagccttatcagtaccttagaactctgctgcaccctaatgatatctgtgaggaaagagatattgaaacagctcttgaggggatgctccaagaggaaggcaagacttcaacaactctttttatttttattttatttatttatttttttgagatggagtctcactctgttgcccactctggagtgcagtggcaagatctcagctcactgcaacctccacctcccaggttcaagtgattctcctgcctcagcctccgagtagctgggattacaggtgcacaccactatgcccagataatctcttgtatttttagtagagacgggggtttcaccatgatggccaagctggtttcgaactcctgacctcaagtgatccacctgcctcggcctcccaaagtgctaggattacaggcatgagccaccgtacccagccagcaactattgaatcataaaaatcagaaagcctatgattatttggatgggtgtcctcacagtgaaatagaatgtttatctaatgtgttatctacttgaaggcaaaatgaaatatccagaaatttgaagagactgtggaagaagagatcttaaacgtttccaagaaagaaagggtgttaatttgaaattaactcagttctattcagtcaacacttactgaacacttgctgtgttaggcactatatgagacaaaggggacacccagattactaaaccatgcacctgttcttgaagactactcagtctaatgctggagacaagatctttctgtaaggaagaagctaaagctaggaagcacaaaggatagatagtgatcccagacacagaaggcttcttggaagatatagggcttgaattaaacttacattataaataggaggcattcaggtgaagaaagttagcaaggtatttagttttcagtcatgtgaatttgaggtacctgtgagacattcaagtgaagatgtccactagaatgtcagaaatataggcaaagaatgcagacttgaatgataatcagcatataggtgagagttgtcatcatatagatgagagttgaagccatgggaaagtgtatattgtgagaagaaaaagtggtcaagaagaaaattttgaagaacacaaacattgaaatgactgggagaggaagtgggtcctggaaaggaaactgaattgacaaaaaaaagtaaaaaaggtaagcagaaaatgaggattcctgaaacctaagggaagaaactatctcaagaaagagggtgtggttaacagtgtcaaatatttttataagagaaggatttaaaagcatccattggtgatggggacagaagggaaggaaaaaaaaacattgagtctatcaaaggaggtcctgtattagtgactttggtaagagaagatttattggcatagaagggacagaaaaaagattgtagtggattgaagagtgcatggaggagtgtgaggaagtgggtgaagatagggaagacattgcttccaggaatttgagctgtgatgagtagcaaaaggggaagaaagttataataggaggggaacaaggttaaaggaaccatcttttaagatggaaaagacttaaacttgtttaaatgtcagtaggaaagatcaaataaagaggaatagctgaagagagaggaaaaagtgagtataatgaatagttcgaaggaagtgagattatatgggatccagagcagaggtggaagagtatgccttaggagaggaggagaattgaagggagaaataaacagttccacaataatagttggagacttaaataccttactttcaataatggataagacatgtaaacagaagatcaataaagcgatagtgaacttgaacagcactgtaaaccagtagatctaacagactgtaaagacctaacagcactgtcccatagacctaacaggcatgtatagaacacttcatctaacaacaggaatatacacatttttctcaagtgccatggaacattctccaggataggccatatattaggccacaaaacaagcttcaataaatttaaaaagatgaaagtcatacaatatcttctacaatgacaatggaaggaatctaaaaatcaataacagaggaaaactggaaaatcatataacatttttaataaatggttcaaagaagaaatcttaagggaaattagacaaaattgtgaaataaatgaaaatgaaaacatgccagaacttaagggacacagtaagatcagtgctcagagggaaatttgtagctgtaaatgtcaacattagaaaagcagaaagatcttgaaacctgactctacacctagaggaacaagaaaaataatagcaaaacaaacccaaaactagaagaaggaaggaaataataaagattagagtggagataaacaaaacagagaatagaaaaacaataaagggaaaaacaaaccaaaagttgatttttttgaaaatatcaacaaaattgacaaaacgttaccaaatacctgaaataataagtaaatcagaaatgagaatggagccacatatctacaaccatctgatctttgacaaacctaacaaaaacaagaaatggggaaacaattccctatttaataaatggtgctgggaaaactggctagccatatgtagaaaactgaaactggatcccttccttacaccttatacaaaagttaattcaagatggattaaagacttaaatgttagacctaaaaccataaaaaccctagaagaaaacttaggcaataccattcacgacataggcatgggcaaggacttcatgtctaaaacaccaaaagcaatggcaacaaaagccaaaattgacaaatgggatctaactaaactaaagagcttctgcacagcaaaagaaactaccatcagagtgaacaggcaacctacaaaatgggagaaaatttttgcaatctactcatgtgacaacgggctaatatccagaatctacaatgaactccaacaaatttacaaggaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccgtctcacaccagttagaatggaaatcattaaaaagtcaggaaacaacaggtgctggagaggatgtggagaaataggaacacttttacactgttggtgggactgtaaactagttgaaccattgtggaagtcagtgtggtgattcctcagggatctagaactagaaataccatttgacccagccatcccattactgggtatatacccaaaggactataaatcatgccgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcataaggacaaaaaaccaaacactgcatgttctcactcataggtgggaattgaacaatgagaacacatggacacaggaaggggaacatcacactctggggactgttgtgaggtggggggaggggggagggatagcattacgaaatatacctaatgctaaatgacgagttaatgggtgcagcacaccagcatggcacatgtatacatatgtaactaacctgcgcattgtgcacatataccctaaaacttgaagtataataataataaaataaataaataaataataaaatggttaaatttataatatattaatttatccacagctaaataaaaaacaattaaaagatccatttggaaaaggatacaccctattaaagtaagcctgatacatgaaacaacagctaaaaaagaaaaaaaaaaagtaacacaattgacaacctaaataaagaaaatacttacactgaaagaaaacataaacaagaccaagatcaggttataaaaaaagagttagtgtataatgtacttaaaaacattgcctctgtcaatgaataaaaagaataacatattagcgaagtgcattaaggaaggcaacagacgaataggaaaaataatgtgcaagatttagtaaataaatataggaaaactaaaatggccaggcacagttgctcactcctgtaatctcaatgttttgggagggcaagctgggcggatcacttgaggtcaggagtttgagactaggctgtccaacatggtgaaaccctgtctctacaaaaaattagcggacttggtggtgcatgcctataatcccagtgaatctggaggctgaggcatgagaatcacttgaaccaggaggcgggggttgtagtgagccgagattgcgccactccactccaccatgggtgacaaagtgagactctccctgaaaaaaagaaaagaaaagaaaagaaaatgaccctagacacattttagtatttacataatgtaaattatttaacacaacagtactgattaaactgtaataacaacgataaataatattgactggcttttgataagtataattctcaaatatgatcagaattagaatatattgctaaagaactttaggaaggtgttaattgaaaattctaattgtgagaattcagtgtccacaagagacatgttctatttcataatacattaatatatttccttatattagatttttctgaaggtttgtagaagtgcatcttgtactctgcagaggaataggatgacaaatgaactcagggttaattggaataattttaaaatgcacgttgattaaataagaaggcagcattgatttcacagcaactatatataactattcattgtggtttcataaacaacaaaaattgtaaccactaaacacactaattctgggcatcccttccttcgcttcgtgcaccatcaattcagtggccctttgcagtgagcacttgacatccgaaaaacaaaagaaaacctaaaaaacaaaatgaggaaccaactaaggtacacccttctcacttcagcagggctccccccacttgaccacattggggaaacctgcaaaagtaggaggattctctgcttccatcattccttctagattattctctcggaaagggaaaaagaagagaagagaagggaaagagaagggaacgggaggggaggggaggagaaagggagcggggaagggaaggtttgtcttcaaaaaatccaaccattggggctgtagcatggtggggggagcttgtaggaaggaaggaaggaatgcttgtcttcaaaaaatacaaccactggggctgtagtatggtgaggggagcttgtatttccgggaaacaggggaggtgtgtgtgggtattggaggagggtggctacagaatcctctatgaacctgctcaggtctcataaacaggaaaacaagccacttgcttgtgtgcaccacacttgtccctaggcagcacactccctcctgggaaagagatcaaagtttggattaaaagcagccaggtccgctaggcatggtggcccacacctgtaatctcagcactttgggaggccaaggtgggcagattgcttgaggccaggaatttgagaccagcctggcaaatatggtgaaaccctatctctactaaaattacaaaaattagcatgtaatctcagctactttgggaggctaaggcaagagaattgcttgaactcaggagacagaggtttcagggagccgagattgtgccactgcactccagcctgtgtgacagagtgagactctgtctcgaaaaaaaaaaaaaaaaagaaagaaaaaaagaaaggcagccaggtccaacaggcatctgcacattgttgacccatccagcagaacagggtcgagaaaggcatctgtcgggatggggcaggacaggacgagacagactattgtctgaggcatttggctacctctctgactggaacccaggcactcatatgtgcccaggaatgggtgggatattccggatgggttccacaggtggctctcctagagagacccacttggcatatttgatgatggagcatgcaggctccctggaacgtgatggctcactagttagtacccccggcatcttggtcattctgctgaagtgcatgggtagccaggcccccggcagtgctcagtttctcctgggcccctctgtgttcctgtggtgggtgtggaagtggaggttgaggctagagtgtctttgagggtggtggggcagctgtgccttgatttgatacagagctctctgggctcctcaagctaaactctggtgcttgccagatactcagctcagataatgaatgagacggtggaggacaaattattttgcccctttagggtctccaggcagacatgcaaaagcctggtgcagggccttcatacagagcccatgttgggtgcaaagccatgaccccgttgctctaaaggttgcatgtcctacccataccgcttggtacctggagagcagcatggaacacaatgctctcagaatattgaaaaggttttctgtgtctccactgagggatactcctgcctcaggccctgtggctgcctattgagccatcagcccattctggtgacctgcatgtgccaggacaatgtggtaatctcaaccaggagctccaggtttacataggcccccagtccttgggtaaatccttgtgtaagccagctgggtggctcccactttctcctggaatggcagccctatgatcccagtccacctgtggtgtcccagtggccatgattatgtgtcctttgtcattactttctgcactagaagcagccacaaaacctggagagggccaaaggaagggcaaaggctggatgccgaaacaggattcccacagggtctccagcctaccaggccttggtcattgggacccctgagtttggtggtcaacctgggacctagtggctgttttctttttctccccactttttctctttctccttcctatttttttttttcacatgggaaaaggcggaggacctcggggtggaggagcagggttacagttatagttagtgtttgtggagccctactgccatcaagcagaaacagtttctggcactgggatacagctgagcaccagtgctggggaaagcccaggagtgctaaacagatggcgacaagccgtccacaggctgaagcaggaggagagaggaactcctgactggcccttggcctgtgcttattcccaggatggcgccttggctccacagctctctctgaaagaaagggcaggcaggggcaccccaccatgggctcccctggcagtctccagggacttccaagcatgaatcgccccgcccccagcaccccgaagttcctttgttcccagggagaataagaaccccttggccccagcttggacccagccaatggcaccttggaactccccacaaaggagaccagagtaaacagccccagtctcgaccatcagtgcccagtggcttcccttatgcccatcacaagacagggtgtctctgcccactgggtagactggtcttgaggctgccgggttgttctgtcccagggcctctagagttgctgcttctccatgaggtcccaatggcaggtacacttccttcaagggctttgaaccccggtggggggaaaccctgccttgggctgagtctacccagcctggcacatcctcactgtttgttgtctgtgcctggaagaaggcaagtttccttgcagcctgtagttcagaaacaccttccactggatgtcactgtggctccacaaatggcagtcaccccttttctttcccccaccttgccttcctctccctccttttgctggcaaccaaacaaaacaaagaccagaaaacagaaactggggctgggtgcggtggctgacgcctgtaatcccagcactttgggaagccgaggcaggcagatcacttgaggtcaggagctcgagaccagcttgaccaacatggagaaaccctgtctctattaaaaatagaaaattagctgggcgtggtggcacatgcttgtaatcccaactacggggaggctgaggcaggagaatcgcttgaacccgggagacggaggttgtggtgagccgagattgcaccattgcactccagcctgggcaataagagtgaaactctgtctcaaaaaacaaacaaacaaacaaaacaaaataaaaaaaacaaagaaacaaaccggccaaagagcacccacctcatcttcagcattgctcctcacctacatggtcactttggggaaacttgccttcctccttccctctggattcttctttgtgcagggggtcccaatgaaccagcctatcctcaagaaatcccacccttggggctgtggcatgatgtggggaggttgcactggggaaggtgtgaggggctacagggtggcgggtgtgtgggtgtgtaggtctgcattccagccactgcagatttctctatgaatctgcataggcctcctaagaaggagactggcgcgtgcctagagaaaaagcaggaagataagaatgcaggaagatctggactgcatccttaggggtggcattgtgactctgattgtcagaggtctccgtttttaacgtttaactcccatcacatctcaactttttcctgtcttcacctgtgcttccaaatgtcctcaggcacatatatgtgtccctactcatactcactcacaagcgtctgcccaggcacctccactcatacctgggtcctgttgtgcaggcaactctcagagggcagggttcttcagcttcccggttccatcttgttcatcttcctcatcccttgttgtctggctgcccaatatttgctggcggagggtgcgggatgtgttgggggtggagacagcagggagcagggcagcctcctggcccaacaggcctctgtgcacatgcagtgcagacctgggcataaggggctgacactttctcctggctggttggtggctcttcctctgtgaagccacagaaggtcactcgggttgccacctgtccatctgggacattctgcattcttgttcgctgtcatcctcattgctcacgttgattcttagtatacttttggagtttttcttccttcacttttttcttcttcactgtctttacttctcgtccacttctggtttggggaggtcaggattcgcctggaaggcagggtccggttggcaagcgaacatatttagggagaacacgccttcttttcctcaggaaattagaaagacctcagttgactcctgccagatgtaatcggggtgcccctctcctttctgccctctctccctagtgccataggtggctgattacctcctttccctggtgtccttttcctctccgtttttcctctctcctcccatttctggggtcctacccttcattggccttgtagactaggggctcgtggccccttgcggtttgcagatgacatccagagggtatggtttagcctgcatctttgtcctctgtagcccctgcagacctatttgtggatcaaagcttttgatccgactcacaagggatcccatcaacaagaagcttcttggtggtgtgtcctttcactgggatgtcactgttgtctctttgtcactcgttatgtatgtcaccacgcattgaggcacccatgaactctatccttcaggacagctgaggtggcatgaagctgccatttcttgttctttttctccatctggttcttcttcctcttcctcctcttcctctttctttctcttttcttttcttttctttctttctttccacctcctcctcctttttcttcttcttttcttccctcctcctcctcctcctctctcttttcctttcactttcagatcttggcgagacaaatgttctatggagactgcttcttctgctccttggtaatgggggatgtccctctgcgtgctaggcaaggagaaagcttcacttttgttctgaaaggagcagagatgaaggtcacatgttcagttcctctggtcctctaaaaaaccacccatgtgttacttttaagtgaaatgtcattctgaatgcacttcctaccagtacctcacgattcatccttctaccttgttctccttgaagacgatctaataatgtaatcttggccagtaggagcctcagcaagttttcccccatttcctctccttccagtcaagccatgtgaacacaactatccggatttcagtgtatacaggcaggctgtctctgccatgtgccagtttacccactctcacacaggaaggcacccacaaaccatagacacagatacacatacacacactcactagggacctcagaaatgaaatcacaaacacacccgcacacagagacacatgcagacacacacaaacacacacatagacacacaaacaagaaacctcacaggggcacaggggtgcaggcccaagcattctcccacacagacacatacacaccaccacaggcacgagactgcctacaatttctcccacacaggttctaaatgtgcaaagggaacaggagacaggggagaattcctgactccaggcctgggccatcatgccattgattgatgggcaactctcgccttctcctgagaatcaatgtgggaagtctgttaacagataggatccagcagctggtgtaaaactggagcatcctgggtcaagctgcttaaaaaggaacctcactttgtgttagagacagagagagttcccttgggagccttggccctgtgtgatgccataagaatctgtggtgtgtggtggcattccccagcacccctgagccaccctcctcccacccccatctgtgtgaaacccaggacagcctgagcagagtcagacttgagcaagttgctgagtgtcctctctgagagatactcctgcttcaggccctgtggtttccagttgagcagtccacctattttgatgacctccatgtgtcagcccaaggcggtaaactctacctggagctccaggctttcgtaggacccccagtcctgcagcagaaccttgtgtaagccagctgggtgaccagcaccttgtcctggggcagtagccctatgatcctagtcctcctgtggtgtcccagtaatgatcatgttttttgttgtttactttctgcacgggcaagagccatgaaacctgcagagagccaaaggaagggcaaaggctggctccctaaacaggattcccacaggatctccagcctactggtcctggtccttggtcacacggtcccatgagtttggtgatcaatctgggaccaggtgactgattcctttcactcctctgtctttttttttgtttctctttcctctttaccttttttcacatgggaaaaggcggaggccctggagttgaagtggcagggttacagttgtagttggcgtttgtggagccatactgccatcaagcggaaactgtatctagaaaccggaggcagctgggcacaagtgctggggaaaccccacgagcgcaaaagagatggcggcatggagcccccaggctgaagcaggacaagagaggaactccaagctggcccttggcctgtgctcattcccaggatgcctccctggttccacagctctctccgaaaaaaagggcaggtaggggcgacccaccatgggttcccctggtcatctccaggtactgctggtcctgggttgccacgtctccagtatcccgaagctcctttgttccccgggaggatcggggcccccttgccaacacgtggctccagccaagggaaccccggaactccccacaaaagacaccagagtaaacggcccccgtctcggccagtggcttcgtttatgtccatctcaacatggctgccgggccagctccgccctctgggctgactggtcttggggctgcctggctgttctgtcctggggcctctagagtagttgcttctccaaagcgtcccaatgccaggtacacttccttcaagggctcagaaccccggtgggggaaacccaggcttagacatagtctaagcacatcctcgctgatctctgttcctggcagaaggcaggtgtccgtgcatcctgttgtgttcagaaacaacttccactagatggcaatgtggctccacaaacagcagtcttgtctttcccttcccccattttctttccctctttctgtttttggtgccaaaaaccaaaacaaacaccaaaaaaaaaaaaaaaaaaaagaaactggcctaggagcacccatctcacctacagcagggcttcccatctatgtggtcactttgggggaaccggcaacagtaggatggggtaggggtgggggccacagggagcagggcagcttcctggcccaacaggcctctgtgcccacgcggtgcagacccgggcttgaggggctgatgctttctcctggctggtggctcttcctctgtgaggccacaagaggccactcatagtgctgccagctgtccatctgaggcactttgcattgcagttcgctgtcaatctcattgctcactgattctttgtgtacttttggagtttttctcccttcacttttttcttcttcattctctttactttttctccacttctgctccaggagcagactggaaggcagggtcagctgggcgcggggacaccgttagggaaaacaggcttacttttcctaaggaaattagtaggactctagctgacccctgcgaggagaaattggcgtttccctctcctttctgccctgtctccatattgcagtgggtggctgattatctcttttccctggtgtccaattcctccccgtttttcatcttattcttttttgggcggtccttccctgccttggccttgtagccttggggcttggtagccccttgcagtcagctgatgacatcttcagggcaaggttcagccagcacctgtgttctctgtagcttctgcaggcctacttgtggatcaaagcttttgatcttactcaggaaataccccatcaacaagacgcttcctggttgtgtgtcctttaagccggatgtcagaagtggctccgtgcccctcgttgtatgtcaccacgcgttgaggccctcctaaactagatccttcgggacagctacagtggcatggacctctcacttcctgttctccttctgattcttcttcctcttcctcctcctacccctcttctttaattcttctccttctcctccttctcctcttgctcctcctcctccaactccttcttatcttcctactcctcctttttctttttcttctttttcctccttctactcctcctccccctccccctgcacttccttctcctttgcctctttttctttttttgcttttgcttctgcttctgattctgcttctgtttttcctttcacttgcggatctgggtgggcacgtgttctagcagactgcttcttcttttgctccttggtgatgtgggatgtccctctgcagaattaggcctggagaaagcttcacattcgttctttaaggagcacagatgaaggtcatgagtttagtccctctggtccaccaaaaggctacccacgtgttacttttaagtgaaatgtcatggtgaacgcaccctttacccaatacctcatggctcattgttatttcccattctccttctggatgctgtaagtgtaatcctgagccagtaggagccttggcaagttgtttcctaactcctttttttccagtcaagccatgtgaacacatcaatctgaatttcagtgtgtgcaggcagggtgtctctgccacgtgttcatttgctcacatttcagtgtgtgcaggcagggtgtctctgccacgtgttcatttgcccactctcactcacacagggaggcacacacagacacacatgcaggcacttacaagagacccccagaagaagaaataaaatcacaaacacacacacagagatacatgcacacccagacaaaaacacgcttacacatacccacacaaacacacacatacacacacataaagtaagctcacaaaatcaaaggggtaggggcccaagcattatgggacacaaacacacatcgccacaggcatgcgactgcccacattctcttcgacaggggttcgaaatatgcaaaggggaaagggagacagaggagcattcctgcctccaggcctgagtcattatgccatttattgggcaactagggccttctcctgagaatgaattcgggaagtctgttatcagataggctcaagcagcaggcatgaaactggagcatcctgggtcaagctgcttaaaaagggcccccaagccttgtccctgtgtgatgccatgagaagctgtggtacttggtggccttccccagcctctctgagccaccctcctcccaaccctacctctgtgaaagccgagacagcctgagcagagtcagtcttgagtgagttgctgaatgtccccgctgagggagactcctgcctcaggccctgtggctgcctgttgagctgtctatccgttcttcggacctccatgtgccatcccaaggtggtaaactctaactgcaactccaggctttgggaggacccccaattctccagcaaaaccttgtgtaagccagctgggtggccactgccttgtacttgggcggcagccctgtgatcccagtccttctgccgttttccagtagccatgattatacgtcctttctcttttactttctacaccagcgaaagcgatgaaacctggagaggtccaaaggaaagtcaaaggcttgctgcctccacagcgttccgacaaggtctccagcctactgatccttgatcctagggtccccttaagaggtgaaagtctgatggcagccctggcagccctcgctcgctctcggcgccccctcggcattggcgtccactctggccgcccttgaggagcccctcagcccgccgctacactgtgggagcccctgtctccactggccaaggtcggagccggctccctcagcttgcggggaggtgtggagggagagccgcgggcggtaacacgagctactcgccgcgcttgcgggccaccgggagttgccggtcggcatgagctcggcgggccccgcactccgagcagccagttggacctgcctgcccagggcagtgaggggcttagcaactgggccagcagctactgtgctccacttctcgcctatctcttctccttaactttcttttataattatgttttctccttcctctttgcttttttcacacgagaaagggcggaggccctcggattggaggggcagggttgtggttgtacttggcatttgtggtgccatactgccatcaagcggaaaccgtttctggaaaccggaggctgtagggcacaagtactggggaaaggccaggagcccaaaagggagggtggtgtgggaccccagactgaagcgagacgagagaggaactcctcgctggcccttggcctgggctcattcccaggatggcgccctggctccgcagctgtatgtaagaacgggcaggcggggcggcccgccatggcttcccctggcagtctccaggaactgccaggcatgggtcgccccacactcagcactccgaaacttttttatttcccggcaagatagaggctttctggccccactgtggccccagccaagggcatcgcggagctgcccacaaaagcgaccagagtaaacggccccgttctctggctgtcagtggccagtggcttcccttatgcgtatctcaaaatggctgccggggcagctgcaccctgtgggctgactggtcttcgggatgcctggctgatctgtctcggggcctctagagtagctgcttctccaaggggtcccaatggcaggtccgctttgttctagggctctacgcccgggtcggggaaaccctggcttaggcagagtccaccccgccccgcccatcctcactcttctcggtgcctggcagaaggcaagtgtccctgtccctgcagcctgttgtcatgtccagaatcaccttccgctggatggcactgtggctccgccaatggcggtcacgtcttttccttcccccaccttgcctttatctttctccatctgctgccgacagaataaaacaaacgccaaaaacaaaaaaagccaagaaacaacgaaagataccggccaaggagcacccacctcacctacagcagggctctccacctaggtggtcactttggggaagcctgcaacggtaggagggttctctgcctccctccttccctctggattcttctccgggcagggttcccagtgaaccagagaacgtcaagaaattccacccttagggctgtggctcggtgggggtaggtcgcactgggggcagtgtgagggggtacagggggagggatatgtgggtgtgtgggtctgcatgcgggccgctgcagattcctctaggaatctgcgcaggccgcctgagcaagagaccaggctgcatgcctgtgcgcaccacacttgtccctaggtagcactcttcctcttggggaagggatcaaagttggatggaaagcagccaggtccagcaggcatccgcaccttgttgagccatggagctgcagggagtcgggccggatgtttcttgggatgatgggactggacgggacggactcctgtctgaggccttcagctccctccctctctggagcccaggcactcgtctgtgcacagtggtgggaggagcatgccgggtgggtttcacaggtggctctcctggagagagagcctcttggcatgtctgacggagcacgcgtgctcagtggaacgtggtggttcaccacttagttgccaggcatcttggtccttgtacccaagtgcatgggtagccagggcccagcctgccccacttcgcctggaccccgtctgatttcctgtgctgcgtgtggaggtggaggttgagccttgagtattttgggggagaaggggctcgggcggggggctgtgttttggtttggtagagggctcactgggctctcgagctaaaccctggtgcttgccggatattcagcccagaaaatgcatgagaccgtcaaggacaaattatgccgcccataattagggtctccaggcagacataagaaagcctgatgcgggacatcatacagtgcccatgttgggatgcgaagccgcgaccgccttgctctaaaggttgcataggctactcatgccgctgggtgcctggacagcagcatggaacacaacgctccccgaatattgcaaatgttttctgtcttggcttgttacaaatcttcctggatgtgtaggccaccctggggacgagcagcccttcttagggcagaaaattcaccccacgggtgatgattcccacgctgggggtgtgtgaaccactctcacaaggaggaatgtcaatctcgtgagcgggcctgcactctcacggcattccgggcagaagaaccacatgaccatggaacaggagtcaccccctttctgtcacttgtcaacaaatgcggatttttttttttttttttttttttttttcctcatatgtaggtagcatgcaccagggtgcgcctctggcggtgcctagggagaacgcgagaagaaaagaatgcaggaagatctggactgcgtctttagggttggcactgggactgtgagtgtcagaggtcctcggttttaacttttaactcccatcacatctcaactgtttcctgtcttcatctgtgcttccacaggtcctgaggcaggcccgtacacgtatccccacccatactcacaagcgtctgcccagacaccttcattcacagccggggccggtcatctaggcaactctcaggggggcaggttttcagctttcgggttccctcttgttcacttcaccttccttgtcgctttctgcctggcttcccaatatgtgctgacggagtgtgcgggatggggttgaggtgtgggcagcagggtgcagagccgcctactggcccaacaggcctctgggcggacgcggtgcagacccgggcctaaggggctgatgctttctcctagctggtggctctttttctgtcaggccactcacagggctgccagctgtccagctggggcactctgcattccacttcgctctcaacctcattgctcactctgattctttgtgtactttcggagttttcctcccctcacttttttcttcttcactttctttacttttcgtccacttctgtttggggaggtgagaagcagcctggaaggcagggtcgactgggcgcggggataccgttagggaaaacaggcttacttttcctaaggaaattaggaggactctagctgacccctgtgaggagaaattggcatttccctcccctttctgccctgtctccatattgccgtgggtggccgattacctcttttccctggtgtctgattcctccccgtttattaccttcctctttttggggggggggctcttccctgccttggccttgtagacttggggttcggtgacccttgcagtcggctgatggcatcctcagggcaaggttcagcctgcacctgtgtcctctgtagcttctgtaggccgatttgtggatcaaagtttcggtcccactcaggaaagatcccatcgacaagaagcttcctggttgttcgtcctttaagcgggacgtgactggtggctccttgtccctcgttgtgcatgtcaccatgcattgaggtcttcctgaactagatcctccaggacagctacagtggcatggacctccctctttcttgttcttctgattcttcttcctcttcctccttcttcttcttcttctctacttttattcttccctttctcctctattttacctcttgctcctcctcctccaacttcctctcctcctcctcatgctcctcctttttgtcctcctcctcctcctccttcttctcgttctcgttctccttttccttcttctttttcttctcatttttcttcttcttcttaatctttttctgcctcctcctcctcctcctcctcctcctcctcctccgcctcctcctcctcctcctcctcctcctcctcctccttttcctcttcttctttttctgcttttgcttctgctttttcttccctttttcccttcacactcagatctgttcgggcaagtgttctaggagactgctgctgcttttgctttttggtgattcgacatgtccctctgcagcactaggcctggaggaagcgtcacttttgttctcaaaggagcactgatgaaggtcaccagtttattccctctggtccaccaaaaagctgcccacgtgttacttttaagtgaaatgtcgtggtgaacccaccgtttacccagtacctcatgtctcaccgttattccccattgtccttgtggatgctctaagtgtgcctttctgagccattaggagctttggcaagttgtcccctgtctcctttttctccagtcaagccatgtgaacacatcgatccagatgtgtgcaggcagggtgtctctgccacgtgttcatttgcccactgtcactcacacaggcaggcacccacagaccgcagactcaggtacacaggcacgcaatcatatgggatccggcaacccaaactgaaatacacgcgcacacacagacacatgcacacgcagacacaaacgcacacgttaaacacgcccaagtagacacacgcatacatacacaaacacacgcacgtgcgcacacacgtcagctcacactagcaaaggggtgtgagctcaagcattatcggacacagactcctacacaccgccactggctcgaaagcgcccacaacctcttccacgctggctctaaatgtgcaaagcagaacgggagacaggcgagcattcctggctccagtcctgggtcatcatgccatttattgggcaactagggtcttctcctgagaatgaatgcgggatgtgtgtcatcagataggcccaagcagcaggtatgaaactggatcatcctgggttatgctgcttaaaaagggaccccactttggaggaggggcagagacagtccccctggagtcttggctctgtgtgatgctatgagtatctgtggcgcggggtggccttcccaggcctccctgagccgcccccctcccaccctctcctgtgtgaaagccgagacagcctgagcagagtcagacttgagtgtgttgctgagtgtctcctgtgagggagactcctgcctcagccctgtggctgcctgttgagccttcggccccgttctggtgacctccgtgtgccatgccaaggtggtaaacactacctgcagctccaggccttgggaggacccccggtcctggggcaaatccttgtgtaagccagctgggtggccagcgccttgtcctggggcggcagccctatgatcccagtcctcctgtggtttcccagaggcggtgattatgtgtcctttgtcttttacttcctgcaccagcgggagccaaaatccctgaagagggccaaaggaaaggcagaggttggctgcctccaccgcattcccgcaggttctccagccggctggtcgttggtcctagggtcccctgagtttggcggtcaacctgggaccaggtggctggttcctttcccttctccgtgtctttcttttattattatgttttctccttcctctttgcttttttcacacgagaaagggcggaggccctcggattggaggggcagggttgtggttgtacttggcatttgtggtgccatactgccatcaagcggaaaccgtttctggaaaccggaggctgtagggcacaagtactggggaaaggccaggagcccaaaagggagggtggtgtgggaccccagactgaagcgagacgagagaggaactcctcgctggcccttggcctgggctcattcccaggatggcgccctggctccgcagctgtatgtaagaacgggcaggcggggcggcccgccatggcttcccctggcagtctccaggaactgccaggcatgggtcgccccacactcagcactccgaaacttttttatttcccggcaagatagaggctttctggccccactgtggccccagccaagggcatcgcggagctgcccacaaaagcgaccagagtaaacggccccgttctctggctgtcagtggccagtggcttcccttatgcgtatctcaaaatggctgccggggcagctgcaccctgtgggctgactggtcttcgggatgcctggctgatctgtctcggggcctctagagtagctgcttctccaaggggtcccaatggcaggtccgctttgttctagggctctacgcccgggtcggggaaaccctggcttaggcagagtccaccccgccccgcccatcctcactcttctcggtgcctggcagaaggcaagtgtccctgtccctgcagcctgttgtcatgtccagaatcaccttccgctggatggcactgtggctccgccaatggcggtcacgtcttttccttcccccaccttgcctttatctttctccatctgctgccgacagaataaaacaaacgccaaaaacaaaaaaagccaagaaacaacgaaagataccggccaaggagcacccacctcacctacagcagggctctccacctaggtggtcactttggggaagcctgcaacggtaggagggttctctgcctccctccttccctctggattcttctccgggcagggttcccagtgaaccagagaacgtcaagaaattccacccttagggctgtggctcggtgggggtaggtcgcactgggggcagtgtgagggggtacagggggagggatatgtgggtgtgtgggtctgcatgcgggccgctgcagattcctctaggaatctgcgcaggccgcctgagcaagagaccaggctgcatgcctgtgcgcaccacacttgtccctaggtagcactcttcctcttggggaagggatcaaagttggatggaaagcagccaggtccagcaggcatccgcaccttgttgagccatggagctgcagggagtcgggccggatgtttcttgggatgatgggactggacgggacggactcctgtctgaggccttcagctccctccctctctggagcccaggcactcgtctgtgcacagtggtgggaggagcatgccgggtgggtttcacaggtggctctcctggagagagagcctcttggcatgtctgacggagcacgcgtgctcagtggaacgtggtggttcaccacttagttgccaggcatcttggtccttgtacccaagtgcatgggtagccagggcccagcctgccccacttcgcctggaccccgtctgatttcctgtgctgcgtgtggaggtggaggttgagccttgagtattttgggggagaaggggctcgggcggggggctgtgttttggtttggtagagggctcactgggctctcgagctaaaccctggtgcttgccggatattcagcccagaaaatgcatgagaccgtcaaggacaaattatgccgcccataattagggtctccaggcagacataagaaagcctgatgcgggacatcatacagtgcccatgttgggatgcgaagccgcgaccgccttgctctaaaggttgcataggctactcatgccgctgggtgcctggacagcagcatggaacacaacgctccccgaatattgcaaatgttttctgtcttggcttgttacaaatcttcctggatgtgtaggccaccctggggacgagcagcccttcttagggcagaaaattcaccccacgggtgatgattcccacgctgggggtgtgtgaaccactctcacaaggaggaatgtcaatctcgtgagcgggcctgcactctcacggcattccgggcagaagaaccacatgaccatggaacaggagtcaccccctttctgtcacttgtcaacaaatgcggatttttttttttttttttttttttttttcctcatatgtaggtagcatgcaccagggtgcgcctctggcggtgcctagggagaacgcgagaagaaaagaatgcaggaagatctggactgcgtctttagggttggcactgggactgtgagtgtcagaggtcctcggttttaacttttaactcccatcacatctcaactgtttcctgtcttcatctgtgcttccacaggtcctgaggcaggcccgtacacgtatccccacccatactcacaagcgtctgcccagacaccttcattcacagccggggccggtcatctaggcaactctcaggggggcaggttttcagctttcgggttccctcttgttcacttcaccttccttgtcgctttctgcctggcttcccaatatgtgctgacggagtgtgcgggatggggttgaggtgtgggcagcagggtgcagagccgcctactggcccaacaggcctctgggcggacgcggtgcagacccgggcctaaggggctgatgctttctcctagctggtggctctttttctgtcaggccactcacagggctgccagctgtccagctggggcactctgcattccacttcgctctcaacctcattgctcactctgattctttgtgtactttcggagttttcctcccctcacttttttcttcttcactttctttacttttcgtccacttctgtttggggaggtgagaagcagcctggaaggcagggtcgactgggcgcggggataccgttagggaaaacaggcttacttttcctaaggaaattaggaggactctagctgacccctgtgaggagaaattggcatttccctcccctttctgccctgtctccatattgccgtgggtggccgattacctcttttccctggtgtctgattcctccccgtttattaccttcctctttttggggggggggctcttccctgccttggccttgtagacttggggttcggtgacccttgcagtcggctgatggcatcctcagggcaaggttcagcctgcacctgtgtcctctgtagcttctgtaggccgatttgtggatcaaagtttcggtcccactcaggaaagatcccatcgacaagaagcttcctggttgttcgtcctttaagcgggacgtgactggtggctccttgtccctcgttgtgcatgtcaccatgcattgaggtcttcctgaactagatcctccaggacagctacagtggcatggacctccctctttcttgttcttctgattcttcttcctcttcctccttcttcttcttcttctctacttttattcttccctttctcctctattttacctcttgctcctcctcctccaacttcctctcctcctcctcatgctcctcctttttgtcctcctcctcctcctccttcttctcgttctcgttctccttttccttcttctttttcttctcatttttcttcttcttcttaatctttttctgcctcctcctcctcctcctcctcctcctcctcctccgcctcctcctcctcctcctcctcctcctcctcctccttttcctcttcttctttttctgcttttgcttctgctttttcttccctttttcccttcacactcagatctgttcgggcaagtgttctaggagactgctgctgcttttgctttttggtgattcgacatgtccctctgcagcactaggcctggaggaagcgtcacttttgttctcaaaggagcactgatgaaggtcaccagtttattccctctggtccaccaaaaagctgcccacgtgttacttttaagtgaaatgtcgtggtgaacccaccgtttacccagtacctcatgtctcaccgttattccccattgtccttgtggatgctctaagtgtgcctttctgagccattaggagctttggcaagttgtcccctgtctcctttttctccagtcaagccatgtgaacacatcgatccagatgtgtgcaggcagggtgtctctgccacgtgttcatttgcccactgtcactcacacaggcaggcacccacagaccgcagactcaggtacacaggcacgcaatcatatgggatccggcaacccaaactgaaatacacgcgcacacacagacacatgcacacgcagacacaaacgcacacgttaaacacgcccaagtagacacacgcatacatacacaaacacacgcacgtgcgcacacacgtcagctcacactagcaaaggggtgtgagctcaagcattatcggacacagactcctacacaccgccactggctcgaaagcgcccacaacctcttccacgctggctctaaatgtgcaaagcagaacgggagacaggcgagcattcctggctccagtcctgggtcatcatgccatttattgggcaactagggtcttctcctgagaatgaatgcgggatgtgtgtcatcagataggcccaagcagcaggtatgaaactggatcatcctgggttatgctgcttaaaaagggaccccactttggaggaggggcagagacagtccccctggagtcttggctctgtgtgatgctatgagtatctgtggcgcggggtggccttcccaggcctccctgagccgcccccctcccaccctctcctgtgtgaaagccgagacagcctgagcagagtcagacttgagtgtgttgctgagtgtctcctgtgagggagactcctgcctcagccctgtggctgcctgttgagccttcggccccgttctggtgacctccgtgtgccatgccaaggtggtaaacactacctgcagctccaggccttgggaggacccccggtcctggggcaaatccttgtgtaagccagctgggtggccagcgccttgtcctggggcggcagccctatgatcccagtcctcctgtggtttcccagaggcggtgattatgtgtcctttgtcttttacttcctgcaccagcgggagccaaaatccctgaagagggccaaaggaaaggcagaggttggctgcctccaccgcattcccgcaggttctccagccggctggtcgttggtcctagggtcccctgagtttggcggtcaacctgggaccaggtggctggttcctttcccttctccgtgtctttcttttattattatgttttctccttcctctttgcttttttcacacgagaaagggcggaggccctcggattggaggggcagggttgtggttgtacttggcatttgtggtgccatactgccatcaagcggaaaccgtttctggaaaccggaggctgtagggcacaagtactggggaaaggccaggagcccaaaagggagggtggtgtgggaccccagactgaagcgagacgagagaggaactcctcgctggcccttggcctgggctcattcccaggatggcgccctggctccgcagctgtatgtaagaacgggcaggcggggcggcccgccatggcttcccctggcagtctccaggaactgccaggcatgggtcgccccacactcagcactccgaaacttttttatttcccggcaagatagaggctttctggccccactgtggccccagccaagggcatcgcggagctgcccacaaaagcgaccagagtaaacggccccgttctctggctgtcagtggccagtggcttcccttatgcgtatctcaaaatggctgccggggcagctgcaccctgtgggctgactggtcttcgggatgcctggctgatctgtctcggggcctctagagtagctgcttctccaaggggtcccaatggcaggtccgctttgttctagggctctacgcccgggtcggggaaaccctggcttaggcagagtccaccccgccccgcccatcctcactcttctcggtgcctggcagaaggcaagtgtccctgtccctgcagcctgttgtcatgtccagaatcaccttccgctggatggcactgtggctccgccaatggcggtcacgtcttttccttcccccaccttgcctttatctttctccatctgctgccgacagaataaaacaaacgccaaaaacaaaaaaagccaagaaacaacgaaagataccggccaaggagcacccacctcacctacagcagggctctccacctaggtggtcactttggggaagcctgcaacggtaggagggttctctgcctccctccttccctctggattcttctccgggcagggttcccagtgaaccagagaacgtcaagaaattccacccttagggctgtggctcggtgggggtaggtcgcactgggggcagtgtgagggggtacagggggagggatatgtgggtgtgtgggtctgcatgcgggccgctgcagattcctctaggaatctgcgcaggccgcctgagcaagagaccaggctgcatgcctgtgcgcaccacacttgtccctaggtagcactcttcctcttggggaagggatcaaagttggatggaaagcagccaggtccagcaggcatccgcaccttgttgagccatggagctgcagggagtcgggccggatgtttcttgggatgatgggactggacgggacggactcctgtctgaggccttcagctccctccctctctggagcccaggcactcgtctgtgcacagtggtgggaggagcatgccgggtgggtttcacaggtggctctcctggagagagagcctcttggcatgtctgacggagcacgcgtgctcagtggaacgtggtggttcaccacttagttgccaggcatcttggtccttgtacccaagtgcatgggtagccagggcccagcctgccccacttcgcctggaccccgtctgatttcctgtgctgcgtgtggaggtggaggttgagccttgagtattttgggggagaaggggctcgggcggggggctgtgttttggtttggtagagggctcactgggctctcgagctaaaccctggtgcttgccggatattcagcccagaaaatgcatgagaccgtcaaggacaaattatgccgcccataattagggtctccaggcagacataagaaagcctgatgcgggacatcatacagtgcccatgttgggatgcgaagccgcgaccgccttgctctaaaggttgcataggctactcatgccgctgggtgcctggacagcagcatggaacacaacgctccccgaatattgcaaatgttttctgtcttggcttgttacaaatcttcctggatgtgtaggccaccctggggacgagcagcccttcttagggcagaaaattcaccccacgggtgatgattcccacgctgggggtgtgtgaaccactctcacaaggaggaatgtcaatctcgtgagcgggcctgcactctcacggcattccgggcagaagaaccacatgaccatggaacaggagtcaccccctttctgtcacttgtcaacaaatgcggattttttttttttttttttttttttttcctcatatgtaggtagcatgcaccagggtgcgcctctggcggtgcctagggagaacgcgagaagaaaagaatgcaggaagatctggactgcgtctttagggttggcactgggactgtgagtgtcagaggtcctcggttttaacttttaactcccatcacatctcaactgtttccttgtcaacaaatgtgtgtccttttctcataagtgtataccatccacctcggggcccctccttttgtgccttgggacatcgggtgaagtaaggaacgcaggaactttggtgttgttagttttagtgtcagaggttcttgtttttacctttgaacatcaatcacgtctgaactatatcctgtcttcatctgtggttgcataggtcctcaggcacatacaagtatcttctccagtaatgacaagcttctgcctagacaccttcattcacaactgtttcccgtcatctaagcaaccctcaggaggtagttgttaagctttcacgttccctcctgttcatttttcttattgctttctctctgccttcccaatatttgctgatggagtgtgcgggatggggttgaggtgtgggcagcagggaacagggcagtctcctggcccaacagatctttgtgcagacgcggtacagacccgggatttaggggcttatgctttcttctggctggcgccttatcctgtgtgaggacacaggaggctactcacagggctgtcagctttccatatgatgaactctgctttccagtttactctgtaactcattgctcactctgattctttgtgtacttttggagttttcctcccttcacttttttcttcttcactgtctttacttttcgtccgcttctgtttatggaggtcacaatcagccaagaaggcagggtcagttatgcacggggacatggttaaggaaaacaggcttactgtttctaaggaaattagaaggactccagctgaaccctgcgaggagaagttggcatttccttattctttctgccgtgtctccatattgccatgggtggctgattacctcttttccctggtgtccgattcctccccgtttttcatctttttcttttgggtggttcttcactgccttggttttgtagactttgggcttggtggccccttgcagtcagctgatgacatcctcagggtaaggttcagcctacacttgtgtactctgtagttctgcaggccaatttgtggatcaaagttttgatcccactcaggaaagatcccatcgacaagaagcttctcgtttgtatgtcctttaaacgggaggtgacctggggctccttgtcactcattgtgtatgtcaccacacactgaggtcttccttaactagatccttcaggacagctacagtggcatggacctcccactttctgttcttgttctctttctggttattcttcctcttcctcctcctactcttttaattcctcttctcttttttgttttcttactcttcctcctccatcttctcctcctcctcctccttcttctttccttctcctcttcttttgcctcttcttcttttttgtcttttgcttttgcctctgcttctctttttcccttcactttcagatcaggacagacaagtgttctaggagactgcttcttcttttgctccttggtgattcagcatgtctctctgcagtactaggcctagagaaagcttcacttttgttcttaatttagcactgatgaaggtcaccagtttagtctctctggtataccaaaaaccttcccacatgttgcttttaagtgaaatgtcatggtgaacagatcctttacccagttcctcatggcttgctgttatttcctgttctgttcgtggatgcactaggtgtgtaatcctgagccattaggaagtttggcaagttgtcccgtgtctccttttttttcagtccagccatgtgaacacattgatccggatttcagtttttgcagggtgtctccgccacatgcccatttgcccactctcactcacagaggcaggcacccacagaccacagacacagacacaatacatacactcacaagggaccccccaatcagaaattaaatcacaaacacacacgcacatggagactcatgcacacacagacacaaacacacacattaaacacgcctaagcggacacacacacagatacacacagacacacacacacacacagaagtaagctcacactagtacaaatgtgcgggtttaagcattatcgtacacagacacacacaacacctcaggcacgaaactgcccacaatgtcttccactcgggctgtaaatggggctgtaaatggtggcgtgtggccctcaaactgaggcgggacaagagaggaactccttgctggctcttggcctgccctcattcctaggatggcggcctgtctccacagctgtatgtaagaaagggcagtcggggcggccagccatggcttcccctggcagtctccagaaactgccgggcatgagtcgcccaacactcaacacgccgaagctcctttgtttcctgggtggataggggctttcttgccccactgtggccccagccaagggcatcccagaactgcccacaaaagagaccagattaaacggccccattttctggctgtcagtggccagtggcttcccttatgcgtatctcaaaatggctgctggtgcagctccactctgtgggctgacgggtcttcaggctgcctggctgatctgtctcggggcctctagagtagctgcttctccaagcggttccaatggcaggtacgatttgttctagggctctaaaccccagtcggggaaaccctggcttaggcagagtccacccagtcccgcacattttcgcggatctctgtgcctggcagaaggcaagtgtccctgcagcctgttgtcatgttcagaaacaccttccgctggatggcactgtggctccacagatgacagtcacgtcttttccttcccttcccttgcctttgtctttctccatttgttgcgaacagaataaaacaaaaacacacacacaaagcgaagaaacaaagaaagaaacgggccaaagagcacccacctcatctacagcagggctccccacctacgtggtcactttgggggaaggtgcaacagtaggagcgttctctgcctccctccttcttctggattcttctctgggcaggggtcccagtgaaccagaggagcctatcctcaatacatcccacccttatggctgtggcatggtgggggtaggtcgcactgggggcagtgtgagtgggtacagggggagaggtgtgtggatgtgtggccctgcatgcaggctgctgcagatttctctaggaatgtgctcagctccccctaggcaagagaccaggccgtatgctgaggtgcacgacacttgtccctaggtagcactcttcctcttggggaagggaccaaatcttgtatggaatgcagtccggtccaacaggcttccgcacattgttgacccatggagcagcaaggagtttggctggatgtttgttgggatgggactggactggaaggactcctgttggaggccttcagctccctctctctctctggagcccaggcactcatctgtgcccaggggtgggaggggtattccaggttgttttacaggtggctgtcctggagagaaagccacttgttatgtctgactgagcatgcgtgctcactggaacgtggtggttcaccagttatttgccccggcatcttggtcattctgcataagtgcatgggtagccaggttccagacagtgctcgccttctcctgggcctgtctttgttcctgttctgcgtgtggaagtagaggtggatcctggaatgtgttgggtgggatggtggtagggcaactgtgccttggtttgatacagagctctctggggtcctcaagctgaactctggtgcttgcgggatattcagccctaaaaatgaatgagtcggtcgaggacaaattttgccggctctttagggtttccaggcagacgtaagaaatcctgacgcgggccatcatacagcccgcttcttgggatgcgaagccatgaccgcgttgctctaaaggttacatatgctacccatgccgctcagtgcctgggcagcagcatggaacacacagctcttcaaatattgcaaatgttttctgtctttgcttgttacaaatcttcctggatgtgtaggccgcactgggaatgagcagagtttcataggacagaaaattcatgccacgggtaatgattctcacactcatgagagtgtgaaccactctcacaagaggaacatcaatctcgggtgtgggcctgcactcccagggcattccaggaagaagactcacatgaccatggaacaggagtcaccccctttctgtcacttgtcaacaaatgcggattcttttttcacatgtaggtagcatgcaccagggggtgcttctgccccttcctagggacaaagggagaagaaaagaatgcaggaagatttggactgtgtctttggggtggcattgcgactctgagtgtcagaggacctcgtttttaacttttaactcccatcacgcttcaactttttcccatcttcatctgtgcttccatagttcctcagacaaatacacgtatccccacgcacactcacaagtgtctggccagacaccttcattcacctccgggtacagtcgtctaggcaattctcagggggcagtttttcagctttccctttccttcttgtttacctttcttgttgtttcctgtctggcttcccaatatttgctgatggtgtgtgcgggatggggttggggttggggcagtagagagcagggcagcctcctgaaccaacaggcctctatgcagtcgcggtgcagactcgggcttaaggggctgacactttcttcttgctggtggctctttttctgtgaggacacaagaagtcactcacagggctgccagctattcatttggtgcactctgcattccagttccctctcaacctcattgatttctctgattctttgtgtacttttggagattccctcctttcacttttttctccttcactgtctttacattttgtccacttctgtttggggaggtcaggagcagcctggaagacagggttgactggttgcggggacaccctcagggaaaacaggcttacttttcctaaggaaattagaaggactctagctgaccccgtgaggaaaaattggcatttccctcccctttctgccctctctccatattgccatgggtggctgattccctcttttctctggtgtctgattcatccctgtttattatctttttttttggaggtggggtagggggtccttccctgctttggccttgtagacttggtgctgggtggccccttgtagtcggctgatgacatcctcagggcaaggttcagcctgcacctgtgtcctctgtagcttctgcaggcccatatgtggatcaaagttttgatcccactcaggagagatcccattgacaagaagcttcctagttgtttgtcctttaaagggctgtgactatggctctttgtcctttgttgtgtacatcaccatgcattgaggtcttcctgaactagatccttcaggacagctacagtggcgtgaacctcccactttctgttctttttctgcttctggttcttcttcatcttcctccttctaatcctcatctttaattcttcttctcctcttttttatcctcttgctccttctcttccaacatcctcttcttctccttctcctcctccttctcctccatcatctcctccctcctccttcttctttctcctccttctccttctttctgcttcttctttttcttcttcttcttcttcttgtgcctctgcctcctcctcctttgcctcttctttttttgcttttgcttctgcttcagctttttttccccccttcactgtcggatctgggcgggcaattgttctaggagactgcttcttcttttgctcttttgtgatgtgtgatgttcctctgcaacattaggcctggagaaagcttcactttcattcttaaaggagcacagattgaggtcaccagtttagtccttctggtccaccaaaaagctgccaacatgttacttttaaatgaaatgtcgtggtgaatgaatgcccccttcacccagtacctcatggctcactattatttcccgttctccttctggatgctctaagtgtgtaattctgagtcattatgagatttgtcaagttgtcatctctctccttttttccagtccagccatgtgaacacattgatccggatttcagtgtgtgcaggcagggtgtctctgcacgtccatttgctgactctcactaacaaaggtaggcacccacagaccacagacacagacacaatgcacgcactcacaagggaacatgaaccagaaatgaaatcacaaacacacatgcacacagacacatgcacacacagacacaaacacacacgttaaacaagcccaagcagacacacgcacacacacacacaaacacacagaagtaagctcacactagcaaaggggcgtgggcttaagcattgttgtacacagacacacaccaccacaggcctgaagctacccacaatctcttccacatgggctctaaatgtgcaaaggggaacgggggacaaacaagcattcctggctgcaggtgtgggtcatcatgccatttattgggcaactaaggccttcttctgaacataaatgcaggaagtctgttatcagattggcccaagcagcaggtgtgaaactggagcatcctgggtcaagctgcttaaaaagggaccccactttggggtaggggtagataaagtccccttgggatccttgtccttgtgtgatgccatgagaatctggtgtgtggtggccttccccagccaacctgtgccaccctcctctcacccttgcctgtgtgaaagcagagtcagacttgagtgaggtgttgagtgtcccctgtgaggagactctggcctcaggccctgtagctgcctgttgagtgggtggccccagtggcccattctggtgacctccatttatgatcccaagttggcaaactctacctgcagttccaggccttgggaagtctcctagtctgggggcaaatccttgtataagacagccgagtggccagcgcctcgtcctggagctgcagccctatgatcccagtcctcctgtggtttcccagaggccatgataatgtgttctttgtcttttactttctgcacctgcgggagccatgaaacctagagaggaccaaaggaagggcaaaggctggctgcctccatagcattcccgcagggtctccaggctactggtccttggtgctagagtcccctgagtttggttgtcagcctgggaccaggtggcttgttcctttctcttctccttatcttttttatttttttctccttcctctttattcacatgggagaaggcagagaccatcagcttagagaagcaaggttatggttgtagttggcatttgtggagccatactgccatcaagtggaaactgtttctggaaatgggagggagctgggcacaagtgctggggaaagcccaggggcacaaaacagatggtggcatggggcccccagactgaagcaggatgagagaggagctcctcactggcccttggcctgggctcattcccaggatggtgccctggctccacagctgcatgtaagaaagggcagttggggcagcccaccatggcttcccctggcagtttccaggaactgccgggcatgagtcgccccacactcagcaccccgtagctcctttttttttttttttaccaggaagataggggccttctggccttactgtggccccagccaaggagggcaagctgtaactgcccacagaagaaaccagagtaaaccacttcattctctggctgtcagtggccagtggcttcccttatgcgtatctcaaaatggctggggggcagcttcactgtgtggactgactcgtcttggggctgcctggctgccctgtgtcagggcctctagagtaactgcttctccaaggggtcccagtggcaggcactctttgttctagggctctaaaccccagttggggaaaccctggcttaagcagagtccacccagccccgcacattttcactgatctctgtgcctggcagaaggcgagtgtccctgcagcctgttgtcatgttcagaaacatcttcctctgggtggcactgtggctccgcaaatggcagtcacgtcttttccttcccccaccttgccttgtctttctccatttgctgccaacggaataaaacaaatgccaaaaacaaaaagcaaagaaacaacgaagaaactggccaaggatcacccacctcacctacagcagggatccccacctacgtggtcactttgggggaacctgcaacagtaggaggttctttgcctccctccttccctctggattcttctctgggcagggtacccagtgaaccagaggagtctgttctcatgaaatcccacccttagggctgtgtcatggtgggggtaggttgtactgggggcagtatgatggggtacaggagagggatgtgtgagtgtgtgggcctgcatgcaggccactgcagattcctctaggaattggcccaggtccccaaagcaagagaccaggcctcatgatggcatgcaccacacttgtccctaggtagcactcttcctcttggggaagggacaaaatcttggatggaaagcagccaggtccaacaggcatccacacattgttgagccatggagcagcagggagttgggtcggatgtttgttgagatgggactgcatgggactgactcctgttcgaggccttcagctacctctctctctggagcccaggcactcataggggtccaggggttggagggattttccaggttttttcacaggtggctctcctggagagagagccacttgtcatgtcttactgagcgtgcatgctcactggaacgtggtggttcaccagttatttgccttggcatcttggtcattcttcccatgtgcatgggtagccagagcccagacagtgcttgccttctcctgggccctatctttgttcctgttctgcgtgtcgaaatggaggttgagcctggagtgtgttggtggggggtgtggtggagtgtctgtgcctttgtttgatacagagctctctgaggtcctcaagctaaactctggtgcttgccggatattcatccagaaaaatgaatgagacagtcgaggacaaattatgctgcccctttagggtctccaggaagacataagaaagcctcacttgggccatcatacagagcccattttgggatgcgaagccatgaccgcgttgctctaaaggttacatatgctacccatgctgcttgatgcctgggcagcagtatggaacacacagctcttcgaatattgcaaatgttttctttctttgcttgttacaaatcttcctggatgtgtagaccacactgtgaacaagcagagcttcataggacagaaaattcaccccatgggtattgattcccacactcaggggtgtgtgaaccactctcacatcacaagagcagtgtcaatctcgtgtgtgggcctctactctcagggcattctgggaagaagacccacatgactatggaacaggagtcacccccttttggtcacttgtcaacaaatgcagattcttttctcataagtaggtagcatgcaccacggggcacctccggccctgcctaggtacaatgggagaagaaaagaatgcaggaagatctgactgcgtctttaggagtgacatggcaactctgagtttcagaggtcctcgtttttaacttttaactcccattacgtctcaacattttcctgtcttcatctgtgcttccaaaggtcctcagatacatacacatctcaccatgcatactaacaagcacctgcccagacaccattcactcccagatctggttgtctaggcaactcttaaggggcagtttctcagctttcaggttccctcttgttcacctttcttgtcgctttctgcctcacttcccaatatttgctggcagatcgtgcggatggggttggggtgggcgcagtggggagcatggcagcctcctggcccaacaggcctctgtgcagatgtggtgcaaacccagtcttaaggggctgacgctttctcttggctggtggctcttcttctgtgaagccacggaaggccactcacaaggctgccagctgtccacctgaggcactctgcattccagtttgctctcaacctcattgctcactctgtttctccgtgtacatttggagttttcctcccttcacttttttcttcttcactgtctttacgttttgtccacttttgtttggcaaggtcaggagcagcctggaagtcatggtctactgggggaggggtcacccttagggaaaacaggcttacttttcctaaggaaattaggataactctagctgacccctgtggggagaaattggcatttccctcccatttctgctctgtctccgtattgccattggtgggtgactacctcttttccctggtgtccgattcatccccatttattatcttcctcttttttggggggtccttccctgccttggccttgtagacttggggcagggtagctctttgcagttggctgatgacattctcagggcaatgttcaacctgcacctgtgtcctctgtagcttctgtaggcctatttgtggatcaaagttttgattccactcaggaaagatcccaacgaaaagaagcttcctgattatttgtcctttaagcggaacatgaccagtggctccttgttcctcattatgtatgtcaccatgcattgacgtcttcctgaactggatacttcaggactactacagtggcatggacctttctgttcttgttctccttctgatttttcttcctcttcctcctcctactttttttctttaattttcctttttttatcctcttgctcctcctcttccagttcatcttctcctccatcttcttctactcctatttttcctcctcctcctccttcttcttcttattgttgttgttgttcttcttcttcttcctcttcctcttcctttctttctccttcttcttcgtcctcctcctcctctgtctctttttttttctttttaatttttttttctttgcttttgcctcttcttatgcttctctttttcacttcacttttggatttgggtgggcaagtgttctaggagactgcttcttcttttgctccttggttatgctggatgtctgtctgcagcactaggcctggagaaagcttcactttctttcttacaggagcacagatgaaggtcatcagtttagtccctctggtccaccaaaaagctgcccacatgttatatttaagtaaaatgtcgtggtgaacgcacccttacctcgtacctcatgggttgccattatttcccattctccttaaggatgttggaagtgtgtaatcctgagccattaggagctttggcaacttgtcctctgtctcttttttttccagtcaagccatgtgaacacattgatctggatatcagggtgtgcaggcagggtgtctctgccacgtgttcatttgcctactctcactcacacaggcaggcacccacagaccacagacacaatgcacttactcacaagggaccctgcaaccagaaataaaatcacaaacacatgcacacaaagagacacatgcacgtgcagacacaaacattcatgtcaaatacgcccaagcagacacacacacacacaaacacacacaagttaactcacactagcaaaggggtgtgagctcaagcattattggacacagacacacacaccccaccacaggcccaaaactgcccacaatctcttccacactggttctaaatgtgcaaagcagaatgtgagacaggcgagcattcctggctccaggcctgggtcatcatgccatttattgggcaactagggccttctcctgagaatgaatgtgggaagtctgttatcagataggcccaagcagcaggtgtgaaactggagcatcctgggtcaagctgcttaaaaacggaccctgcaaccagggtaggggcagagaaagtcccctcaggagccttgtccctatgggatgccatgagaatctgtggcacgtggtggccttcctcagcctccctgagccaccatcctcccaccccgcctgtgtaaaagccaagacagcctgagcagagtcagacttgagtgagttgctgagtgtcccccgtgagggagactccgggattctggtgacctccatgtgccatcccaaggtggtaaactctacctgcagctccaggctttggaggaccctcagttctggggaaaattgttttgtaatccagctgagtggccagcgccttgtcctggggtggcagccctgtgatcccagtcctcctgtggtttcccagaggccatgattatgtgtcctttgtcttttactttctgcactggtgggagccataatacctggagaggaccaaaggaagggcaaaggctggctgcctctacagcattctgcaggatctccagtctacaggtccttggtcctagggtcccctaaatttggtggtcaacctgggaccaggtggctggttcctttgtcttctccttgtcttttttttctccttcctctttacttttttcacatgggaaagcatggagggcctcagcttggaggggcagttgaggtagtagttggcatttgtggagccatactgccatcaagcggaaactatttctggaaacgggaggcagctgggcacaactgctggggaaatccgaggggcacaaaagagatggtggcgtgtggcccccagactgaagctggatgagagaggaaccccttgctggcccttcgcctgggctcattcttaggatggcaccctggctccacagctgtctttaggaaagggcagtcaggccggctgtgagcaagcagagcttcataggacagaaaatggcttcccctggcagtctccaggaactgccaggcatgagtcaccccacactcagcatcctgaagctccttttcctcccgggagggtaggggctccctgttccccctgtggccccccaagggcacctcggagctgcccacaaaagagaccagggtaaacagccccattctcatccatcagttgccagtggcttcccttatgcacatctcaaaatggctgctggggcagctccaccctgtgggttgactggtctgcaggctgcatggctgctctgtctctgggcctctagagtagctgcttctccaaggggtcccaacggcaggtacgctttgttctagggctctaaaccctggtcggggaaaccctggctcaggcagagtccacccagccccgcatatttttgctgacctcggtgcctagcagaaggcaagtgtttccgcagcctgttgtcatgttcagaaacaccttctgctggatggcactgcgactccacaaatggcagtcatgtcttcttcttcccccactgtgccttcgtctttctccatttcctgccaactgaacaaaaccaacacaaaaaaacaaaagcaaagaaacaaagaaagaaactgtccaaggagtacccacctcacctatagcaggtctccccacctacgaggtcactttgcggaaacctgcaacagtaggagggttctctgccttcccccttccctctagattcttctctgggcaggggtcccagtgaattagaggatcctatcctcaatacatcccacccttaggcggtggcatggtgggggtaggttgcactgggggcagtgtgagggggtacagggggaggggtgtgtgggtgagtgggcctgcgtgtgggcccctgccgattcctctatgaatctgcacaggtctcctaagaagagaccaggccgaatgctggtgcacaccacacttgtctctaggcagcagtctttttcttgctgaaaggttaaaagcttggatggaaagcagccagttcaaacaggtatccatacattgttgacccatccagctgcagggattcgggccagatatttcttgtgatgggactggatgggagggactcttgtctgagaccttcagcgacctctctcactggagcccaggcactcattcgtgcccagaagtgggaggggtatttctgggtgaatttcacagttggctcttctggagagagagccacttggcatgtctgatagagcatgcatgcttactggaacgtggtggttcaccagttagttgttctggcatcttggtcattctgccaaagtgcatgggtagctcgctttcacctgggcctgtctgtgttgctgtgctgcgtgtgaaaggagagattttatgtggagtgttttaatttgtggttgggcaattgtgccttggtttgatacagagctctctggggtcctcaaggtaaactctggtgcttgctggatattcatcccagaaaatgaatgagatggtcgaggacaaattatgccggccctttagggtctccaggcagacataagaaagcctgacgtggtccatcatacaaagcccatgttgggatgcgaagccatgaccgtgttgctctaaaggttacatatgctacccatgctgctcagtgcctgggcagcagcttggaacacaatgctctctgaatattgcaactgttctctgtctttgcttgttacaagtctttcttgatgtgtaggctgcactgggaacaggcagagtttcacaggacagaaaatttaccccatgggtaatgattcccacaatcaggggtgcgtgaaccactctcacaagaggaacgtcaatctcgtgtatgggcctgcactctctgggcattccgtggagaagacccacatgaccatggaacaggcttcacccgatttcttttaattgtcaacaaatgcaggtccttttttcatatgtaggtagcatccaccacgggcgcacctctggccctgcctagggaaaacgcgagaataaaagaatgcaggaagatctggactgtgtctttaggggtggcattgtgactctgagtttcagaggttctcgtttttaacttttaacccccattatgtctcaactttttcctgtcttcatctgtgcttgcataggtcctcaggcacatccatgtatccccacccatgctcataagtgtctgcccagacaccttcattcacacctgtgtctggtcctctaggccgctctcagtgggcagtttttcaggtttccggttccctcttcatctttcttgtccctttctgtctgacttcccagtatttgttggcataatgttcaggatggggttggggtgggggcagcggggagcagggcagccccctggcctaacaggcctctgtgcggatgtggtggagatctgggattatgggactgactctttctcctggctgatggctccctctctgtgagcccacaggaggccacttgggctgccagctgcccacctggagcactctgcattccagttcactctcaacttcattgctcactctgattctttgtgtagttttggaggttttctcccttcacttttttcttctttactctttttacttttcattcacttttgtttggggaggtcaggatcagcctggaagtcagggtcaactgggctagggaacacccttagggaaaacaaacttatttttcctaaggaaattagaaggaccccagctgatccctgcaaggagtgattggcatttccctttcctttctgccctctctccatattgccatttgtggctgattatctcttttccctgatatatatttcctccccgtttttcatcttcctctctttttgggggtccttccctgccttggccttgtaggcttggggctcagtggttccttgcagtctgctgatgacatcctcagggcactgttcagcctacacctgtgtcttctgtagctcctgcaggactatttgtggatcaaagcttttgatcccactcaggaaagatctcattgacaagaagcttctcggttgtgtgtcctttaagtgggacatgaccggtggctccctgccactcgttgtgtatgtcatcacacattcaggtccccctgaactagatccttcaggagagctacagtgtcatggacctcccacttcctattctttttctccttctgtttcttcttccttttcctactcctgctcctcttctttattgttcttttcctcctttcctcctcctcctcctccaactccctctccttcttcttctttttctttccctcttcttctttcttcttcttcttcctcttcttccccttccctccttctccttcttcttcttcctcttcctcttcttctctccttctttccttttcctcctccttctccttcttcttttcttctttgacttctctttttgccttctttttctttctctccttcttttctatttctccttctacatctttttttctacttttcttctccttcttcttctacttgttcttctttctttcctttttttttcacttttggatttctgcatgcaaatgttctagcagattgcttcttcttctccttggtgatggggaatgtccttctgcagctctaggcctcaagaaatgcttcacttttcttcttaaaagaacagcgatgaaggtcaccagttcagtccttcttttccaccaaaaagctgtcctcgtgttacttttaagtgaaatgtcatggtaaacacaccctgtacctagtaccttatagcccaccattctttcctgttctccttgtggactctctaaatgtgtaaacctgagtcagtaggagcctcagcaatttgttacattgttcccctattgcctttccttccagtcaggccaggtgaacaaaacgatacggatttcagtgtgtacagtcaggctgtctctgccatgtgccaatttgcccactctcactcacacaagcaggaactcacagaccacagacacagaacacatgcacacactcacaagaaaccccacaaccagaaatgaaattacaaaacccatacacacatggagatacatgcagatgcagacacaaacacacatgcagacacacacacgcaggcacactgacacataaagtcacacatacacaaccagaccaataaacaggtaacctcacatgggcacaggggttggggctcaagcattctcacacttagaggtaaacaaacacacaaagccacaggcatgagactgcccacactgtctcatacgggctcttaatctctgacaagcaatgggctatgggcaagcattcctggcttcaggcctgggtcctcatgccattgattgggcaacttggctttctcccaaaaatgaatgcgggcaatcttttatcagaaaggccacagcagcagatgtgaaactggagcatcctgggtcaacccgcttaaaaacagactcccctttcagatagaggcagagagagtcctgttgggatccttagccctttgtgatgtcatgggaatctgtggcaacgtggtggcctttttgagtccccctaagccacatcctcccacccctgcctgtgtgaaagccaggacagcctgtgcagagtcagacttgcacgagttgctgagtgtgctttctaagggatacacctgcctcaggtcctgtggctccctgttgagcagtctgcccgttctggtgacctccatctgccagcccaaggcggtaaactacctagagcctttgggaggactcctagtcctgcagtaaaaccttgtgtaagccagctgagtgaccagcaccttgtcttggaacggcagccctttaatcccaagcctcttgtgtcccagtgcccatgattatctgtcatttgtcttttactttctgcaggagcaggagacatgaaacctggagaaggccaaagaagggcaaagactggctgcctaaacagtattcctgcagggtctccagcctactggtccttggtcattgggacctgtgagttttggtggtcaacctgggaccagttggctcgttcctttctctccctcctgtctttttctcgttctccttcctatttgcttttttcacattggaaaaggtggaggccctcagggtggaggagcagggttacaactgtacttggcgtttgtggagccatagtgccatcaagtggaaattgtttctggaaatgggaggcacctgagctcatgtgctgaggaacgctcgggagtgccagacagatggtggtgtggagcccccaggctgaagctgggagaggaactcctgtctggcccatggtctatgctcattcccaggatagcgccctggctccacagctctctttgtaagaatggacaggcaggggcggcccaccatgggttcccctggcagcccccagagactgcttggcatgagttgccccaccccagcatcccaaaacttctttgttcccagggaggatagggtgcccctgtccctgcgtggccccagccaagggcacccctgaactctccacaaaagagaccagagcaaatggccccagtctcggcagtcagtgaacagtggtttctcttaaacccatttcaagatggggaagctccgcccactgggctgactggtcttggggctgccagactgttctgtccccgggcctctagcttagctgcttcttcatggagttccaatggcaggtacacttccttaagggctctgaaccccagtgggggaaaccctggcttgggcctagtctacccagcctggcacatcctcgctgatatctgtgactggaagaaggcaagtgtccttgtagtctgttgtcaagaaacaccttccgccggatggcactgtgactccacaaatggcaatcaccccttttccttcctccactttgcctttctctccttccttttgctgccaaccaaacaaaacaaacacacacaaaaaaaacaaagaaacaaagaaactgcccaagcagcacccacctcatcttcaacagggctccccacctatgtggttactttggggaaacttgcaacagtaggagtgatgtctgcctctcctaccctctggattcttctctgggcagggggtcccagtaatccagaggagcctatcctcaagaaatgctatgcttttgctgtggatttgtagcaccgggggcagtgtgagggggtaaagggggaggggtgtgtgggtgtttaggcctgtgtgtgggccgctgcagattcttctatgaatctgcacaggtctcctcagaaggagactggtgcctgcctagggaaaacataggaagaaaagaatgcaggaagatctggactgtgtccttaggggtggcaaggtgactttgagtgtcagaaatcctcatttgtaatatttaactcccatctcatctaacttttttcctgtcttcatctgtgcttctatatgttctcaggcacatacatgcatccccaccaatactcactaaaaggtgtctgcccaggcacctgtgctcacactcagatccccacatctaggtaactctcaatgggaagggttcttcagcttcccggttttctcttattcatttttgttctccctttctgtctggcttcccagtatttgctggtggagtgtgtgggatggtgtgggggtgggggcagtgtggagcagcgcagtctcttggctccactggcctctgtgtggacccagtacaaaccctggcctaagggtctgatgcttttctctggtaggtgactcttcttgtacgaaggcacaagaggccatttgggcagccacctttccacctgggatatcctgcatttcagttcactctcaacctcattgctcaccctgattctttgtgtacttttggagtttttcttccttcacttttttcttcttcactctttacttttcatcaatttctggtttagggagttcaggatcagcctgcaaaagcagggtcgggtgggcacaggaatgtccttagggagagtaagcctacttttcctaaggaaatcagaaggacccgggctgaaccctgggggtgtaagcagcatccccctcccctatctgccttctgtcagtgttgccataggtggctcattacctcctttctctggtatccatttcctccccgttttacatctctcctcccacccatttccggggtacttccctacccaggccttgtagattagaagcccgtggccccttgcagtgcgctgatgacatctggagggcatggctcagcctgcacctctgtcctctgtagcttctctaggcctacttgtagatcaaagcccttgataccactcggaaaagaacccatcaacaagaagcttcttggtgttgtgtcctttcaccgggacatcacaggtttctctttgcctcttgttgtgtatgccaccatgcagtgaggcacccctgaactaggtccttcaggacagctgctgtggcgtgaagctgccacttcttgttcttattgtctttctggttcttcttcctcttcctcctcctcctcttttttctttttctttttcttctactccttctccttctccttctcatttttctcttctttcttctctttttcctttcacttttggctcttggcgggtcaagcattatactgagactgcttcttcctctgctcctggtgatgcaggatgcccctttgcagaacaaaagtgagaaaggcctcatttgttcttaaaggagcagatatgaaggtcaccagttcagtccctctggtgttccacaaaggcgccaatgtgttacttttcatgaaatgtcaccatgaacccaccccttaacctgttcctcatggctcaccattctttcccattctctttgtggatgctctaaatgtgtaatcctgagccagcaggagccttggcaagttgtccccctttgtcttttctttcaatccagccatgtgaacacaacgatccagatttcagtgtgtataggcaggctgtctctcccacgtgcccatttgcccactctcactcacacaggcaggcacccagagaccacagacacagacacaaccacatggactcacagggaaaccccgacaaccacaaatataatcacaaacacacatgcacagggagatacacacacagacacaaagacatacactaacacatgcacactcacaaactcatagacacacacacacacacacacacacacacacacacacacaaatcctcacacaggcccaggggtgcgggctcaagcattcacccacacagacgcacacacacatgtgtcgccatagccaccagactgcccacgaactctcccataaaggctctcagtcggccacaggcaatgggctatgggtgaggattcctggctccaggcctgggtcattatgctgttgattgggcacctaaggccttctcctgagaatgaatgcgggaagtctgttatcagataagccccagcagccagtgtgaaactggagcctcctgggtcaacctgcttaaaaagggaccacaccttgggtagaggcagacagtccccttgggacccttggccctctgtgatgccatgggaatctgtgttgcgtggtggccttccccagttcccctaagccaccctcatgtcacccctcccccccaccccatgtgaaagccaggacagcctgcacagagtcagacttcagtcagttgctgagtatcccctctgagggagattcctgccacacgccctgtgactgcctgttgagctgttcgctcattttggtgacctccatgtgccagcccaaggtggtaaactctatctggagctccaggctttgggagaaccaccagtcctgcagcaaaaccttgggtaattcagctgggtgaccagcaccttgtcctggggcggcagccccatgatcccagtcttcctgtggtttcccagtggccatgattatgtatcatttgtcttctatttttctgcatgagcatgagccatgaaacctggagagggccaaaggaaaagcaaaggctggcggcataaagaggatttccgcagtgtctcctgcctactggtcctaggtcgtagggtcccttaagtttggtggtcaacctgagaccaggtggctggctcctttttatcctccctgtcttttttttgtttctctttcccttttctttttttcacattggaaagggtggaggccgtcggattggaggggcagggttaagcttgtagttggcctttgtagagccatagtgccatcgagcggaatctgtttctggaaactggaggcagctgggcatgagtgctggagaaatcccaggagcacgaaagagatggtggcggtgtggggcccccaggctgaagctggacgagagaggaactcctggctggccctttgcccttgctcattaccaggatggcacccgggctccacagccctctccgaaaaaagggcaggaaggggcggccctccatgggttcccctggccatctccaggaattgccgggcaggagtcgtcccgcccacagcaccccacagctccttggttcactgggaggataggggacctctggccccagcgtgattccaggcaagggcaccccagaactccccacaaaagagaccagtgtaaacgaccccagtctcggccgtcagtagtcagtggcttcccttaagcccacctcaagatggctgccagggcacctccgcactctggactgactggtcttggggctgcctggctgctctgtccctgggcctctagattagctgcttctccgtggggtccaaatggcaggcacacttccttcaaaggtttaaaaccgcgatgggggaaactctggcttagtcagagtccacccagcccgacatattctcgctgaagtctgtgcctgtcagaaggcaagtatccctgcagccggtcgtgttcagaaacaactgccgctggatggcagtgtggctccagaaatggcagtcacttatttcccttgcttttctctttctccttttgcttccaacaaaacaaaacaaaacaaaaagaaaagaaagaaagaaagaaaccggccaaggagcgctcacctcatctacagcaggactccccacctacatggtctctttggggaaacctgcaacatgcgaaaggctctctgcctccctccttccctctggattcctctctgggcaggggtcccagtgagccagaggagcctatcctcaagaaatcccacccttggggctgtggcatggtggggataggtcgcactgggggcaatgtgaaggggtatgggggaggggtgtgtgagtgcatgggcctgcttgtaggccactgctgattacttctctgaatttgcacaagcctcctaaggagaccaggctgcctgcttgtgagcactacgcttgtaaatagggaacacactgtttcttggggaagggacaaaagcttggatcaaaagcacccaggtccaacaggcatccatagattgttgacccttctagcagaagaaggtcgggccaggtgtctgtcaggatgagactcgacagattggacacctgtcccaggccttcagctacttttctcactggagcccaggcactcatccatgcccaagagtaggaggggtattctgggtggcttccacaggcggctctcctagagaaagccacttggcatagctgatggagcatgtgtgctcactgaatgtgatggctcaccagttaattccccgggcatcttagtcattctgccaaatacatgggtagccaggccccagccatgctcactttcgcctgggcctcctctgtgttcctgtgctgggcatggaagtgaaggttgaggctggcgtgtctttgcagatggtgaggtggctgttccttggtttgataccgagcactctgggctcctcaagctgaattctattgcttgtcagattattcagcctggaaaatggatgagacagtggaggacaaattgtgccaccccttttgggtctccaggcagaaatgggaaagccatgcatgggtccttcatacagaacacttgttgagatgcaaagctgtggcctcattgctctaaaggttgcatgtcttacccatgcctctcagtgactggagagcagcatggaacacaaccatctcagaatattgcaaatgttttctttcttcgcttgttacaagtcttcctggatgtgtaggctgcactgggaacgtgcagagctttagaggagagaaaattcaccctacaggttatgattcccacactcagaggggtatgacctactctcacgaacgtcagtttcatgcatgggcttgcactctcagggcattccaggaagaagggcaacagtaccatggaacaggaatcactccctttctgtcacttgtcaacaaatgtggatccttttctcatgtgtagtaatcaccatgggggcacctccagtgcctgcataaggaaaatgcaagaagaaaggaatgcaggaagatctggacagagttcttcggggtggcattgggagtctgaatgtcagaggtcctcatttttaacatttaactcccatcacatctcacctttttcctgtctttatctgtgcttccatacatcctcaggcacatacatgtatcctcacccatagtcactcaaaagtgtaggcccaggcacctcccgtaaaacctggatcccattgtctagacaactctaactgggcagggttcctcagcttccaggttctcttttgttcatctttcttgtccctatctgtgtggctttccaatatttgctggcagaggatgcaggatggggtggtggtgggggcagtggggaccagggcagcctccaggcttgccaggcctctgtgccaatgtggtgcagacctgggactaaggggctgactctcttggctgatggctcttcctcctctgtgaggccacaggaggccacttgggctactacctgtctacttggtacactctgcattccaattcactctcatcctcattgctcactctaattctttgtgtacttttggagtttttctcccttcactttttttttattatacttaaagttctggggtacatgtgcagaacacgcaggtttgttacatagatatagacgtgccatggtggtttgctgaacccatcaactcgtcacctacattaggtatttctcttaatgctatccctcccctagctccccaccccatgacaggccccggtgtgtgatgttcccctccctgtgtccatgtgttctcattgttcaactcccacttatgagtgagaacatgtggtgtttggttttctgttcttctgttagtttgctgagaatgatggtatccagcttcatccatgtctctgcaaaggacatgaactcatccattttatggctgcatagtattccatgatgtatatgggccacattttctttatccatcttatcattgatgggcatttgggttggttccaagtctttgcttttgtgaacagtcccgcagtaaacatatgtgtgcatgtctctttagagtagaatgatttataatcctttgggtatgtacccagtaataagattgatgagtcaaatggtatttttagttctagatgcttgaagaattgccacactgtcttccagagtggttgaactaattgacactcccaccaacagtgtaaaagcattcttatttctccacatcctcttcagcatctgttattttctgactttttaatgatcaccattgtaacgggcatgaaatggtatctcattctggttttgatttgcatttctctaaagcccagtgatgatgagcttttttatatgttcattggctgcataaatgtcttctcttgagaagtctctgctcatatctttcgcccactttttgatggggttgtttttttcttgtaaattggtttaagttctttgtagattctggatattagccctttgtcagatgggtagattgcaaagagtttctcccattctgtaggttgccttttcactctgatgatagtttcttttgctgtacagaagctctttagtttaattatatcccatttgtctattttggcttttgttgccattgcttttggtgttttagtcatgaagtctttgcccacgcctgtattctgaatggtattgcctaggttttcttctaggttttttatggttttaggttttaggtttaagtctttaatccatcttgagttaatttttgtataaagtgtaaggaagggttccagtttcacctttctgcatatggctagccagttttcccagcaccatttattaaatagaaaatccttccccatggcttgttattgccaggttcatcaaatattaggtggctgtagatgtgtggtgttatttctgaggcctccattctgttccattggtttatatatctgttttggtaccagtatcatgctgttttggttactgtagccttgtagtgtagtttgaagttaggcagcgtgatgcttccagctttgttctctttgcttaggattgtcttggctatttgggctcttttttggttccatttgaactttaaagtagtttttttctaattctgtgaagagagtcaggggtagcttgatggggatagcattgaatctataaattaccctgggcagtatggccattttcatgatattgattcttcccatccatgagcatggaatgtccttccatttgtttgtgtcctcttttatttcattgagcagtagtttgtagttatccttaaagaggtccttcacatcccttataagttggattcctagggattttattctctttgtagtaattgtgaatgggagttcactcatgatttggctctgtgtttgtctgttcttggggtataggaatgcttgtgatgtttggacattgattttgtatcctgagactttgctgaagtagcttatcagcctaaggagattttgggctgagacgatggggttttctaaatatacaatcatgttatctgcaaacagagacaatttgacttcctctttttctaattgaataccctttatttctttctcttgcctgattgccctggccagaacttccaatactgtgttgaataggagtggtgagagagggcattcttgtcttgtgccagttttcaaagggagtacttccagttttttcccattcagtatgatattggctgtgggtttgtcatgaatagctcttattgttttgagatacattccatcaatacctagtttattgaaagtttttagcatgaaggctgttgtatttgtcggaggccttttctgcatctattgagataagtgtgtggttttttgtcattagttctgtttatgtgatggattaagtttattgatttgaatatgttgaaccagccttgcatcccagggatgaagccgacttgatcgtggtggataagctttttcaaatgctgcctaaaatcctctttctttgttgtgtctctgtcaggctttggtatcaggatgatgctggcctcataaaagttggggagttagggaggattccctctttttctattgtttggaatagtttcagaaggaatggtaccagctcctctttgtacctctggtagaattcgtctgtgaatccgtctggtcctggactcttttttggtcagtaggctattaattgctccctcaatttcagagcctgttattggtctattcagggattcaacttcttcctggttttgtcttgggagaaggtacatgtccaggaacttatccatttcttcaagattttctagtttatttgcatagaagtatttatagtattctctgatggtagtttgtatttctgtgggatcagtggtgatatcccctttatcattttttatcacatctatttgattcttctctcttttcttctttattaggctggctagaggtctatctattttgttgatcttttcaaaaaacgagctcctggattcattgatttttttgatgggtttttcttgtctctgtattcttcagttctgatttgatcctagttatttcttgccttctgctagattttgaatttgtttgcttctgcttctctatttcttttaaatgtgatattaggttgttgattttagatctctcctgctttctcttgtgggcatttagtgctataagtttccctctccacactgctttaaacgcatccctgagattctggtacgttgtgtctttgttctcattcattcaaggaacatatttatttctgcctttatttcgttatttacgcagtagtcattcagatgcaggctgttcagttttcatgtagctgtgcggttttgagtgagattcttaatcctgagttgtaatttgattgcactgtggtcttagagactgttataatttccgttcttttgcatttgctgaggagtgttttacttccaattatttggtcagttttagaataagtgcaatgtgctgctgagaagaatgtatattttgttgatttggggtggagagttctgtagatgtctattaggttcacttggtccagagctgagttcaagtcctggatatccttgttaattttctttctcgttgatctatctaatattgacagtggggtgttaaagtctcccactgtttttgtgtgggaatgtaagtctctttgtaggtctctaagaacttgctttatgaatctgtgtgctcctgtattgagtgcatatatattgaggatagttagctcttcttgttgcattgatttatttaccattatgtaatgtccttctttgtctcttttgatctttgttcatgtaaactctgttttatcagagactaggattgcaacccctgctttttttggctttccatttgcttggtaagtattcctccatctcttttgttgagcctgtgtgtgtctttgcatgtgggatgggtctcctgaatacagcacaccaatgggtcctaactctttatccaatttgccagtctgtgcttttaattggggcatttagcccatttacatttaaggttaatattgttatgtgtgcatttaatcctgtcgttatgatgctagctggtttttttgcctgttagttgatgcagtttcttcatcatgttgacagtctttacaatttagtatgtttttgcagtggctggtactggttgatccttccatgtttagtgcttccttcaggagctcttgtaaggcaggcctggtggtgacaaaacctctcagcatttgcttgtctgtaaaggattttatttctcctttgcctatgaaacttagtttggctgaatatgaaattctgggttgaagattcttttctttaagaatgttgaatattggcccccactcttttctggcttgtagggtttctcccgagagacctgctgttagtctgattggcttcccttgtaacccaacctttctctctgtctgcccttaatattttttccttcatttcaaccttggtgaatctgacaattatgtgtcttggggttgctcttctcgaggagtatgtttgtggtgttttctgtatttcctgaatttcaatgttggcctgccttgctagattggggaagttctcctggataatatcatgaagagtcttttccaacttggttccattctccctgtcactttcacgtacaccaatcaaatgtagttttggtctttccacatagtcccatatttcttggaggttttgctcatttcttgttactcttttttctctaatcttgtcttcttgctttattttattgagttgatcttcaatctctgatatcctttcttctgcttgatccattcagctattgatacctgtgtatgcttcacgaagttcttgtgctgtgtttttcagctccatcaggtcatttatcttcctctctaaactggttattctagttagcaattcatctaaccttttttcaaggttcttagcttccttgcattgggttagaacatgttcctttagcttggaggagtttgttattactcaccttttcaaggctacttctgttaatttttccaactcattctctgtccagttttgttcctttgctggtgaggagttatgatcctttggaggagaaaaagtgttcggtttttggaattttcaacctttttgtgctggtttctccccatcttcatggatttatctacctttggtctttgaagttggtgaccatcagctgaggtctctgattggatgttctttctgttgatgttgatactattcctttctgtttgttagtttttcttctaacagtctggctcctctgctgcaggtctgctggagttttgctggaggtccactccagaccctgtttgcctgggtatcactagcggaggctgcagaccagcaaagattgctgcctgttctttcctctggaacctttgtcccagagagacacctgccagatgccagccagagctcttctgtatgaggtatctgtcagttcctactgggaggtgtctcccagtcaggatacatgagtgtcagggattcacttgaggaggcagtctgtcccttatcagagctcaaacgctgtggtgggagatctgctgctctattcagaggtaccaggcagggacgtttaaatctgctgaagctgcacccccaactgttccttcccccaggtgctctgtcacaaggaggtgggggttttatctataagtccctgactggaactgctgcctttttttcagagatgccctgtgcagagaggaggggatctggagaggcaggttggccacagtggccttgctgagctgcggtgggctccacccagttcgaactttccagcagctttgtttacactgtaagggtaaaactgcctacttaagcctcagcaatggcatatgccactccccccaccaagctccagggtcccaggtcaagctcagagtggtgtgctagcagcaagaatttcaagccagtagatcttagcttgctgggctccatggggttgggacccgccgagccagaccggttggccccctggcttcagcctcctttccaagggagtgaatggttttgtctggctggacttctgagtgccactgaggcatgaaaaaaaaacaacttttgtggctagcttggtgtctgcccaaacggccacccagttttgtgctagaaacccagggccctggtggcatgggcactggagtgaatctcctggtctgcgggttgtgaagaccatgggaaaagtgcagtgtctgtgctggagtgcatggtatagtccctaatggcttcccttggctaggagagggagttccctgacaccttgcactttcttggtgaggtgacacccctaccctgctttggctgaccctccttgggctgcacccactatccaaccagtcccagtgagatgaacctggtacctcagtttgaaatgcagaaatcacccatcttctgcatcgatctcgctgggagctgcagactggaactgctcctattccaccatcttgccagcttcccacttttttttatcttcactgtctttacttttagtccacttgtggtttggggagggtcgggtgggcacaggcacatcattagggagaacatgcttacttttcctaagaaaattagatggatcctggctgacccctgaagtgcataatcagaatccccctcctctttctgccctccctattgccataggtggctgattacctctttttcttggtgtccggtttctccccatttttcatctctcctcccatttccagagtccttccctcccttggccttatgtactagggacttgatggccccttgaagtgtgctgatgatattcagagggcaagattttgcctgtacctttgttctcttttgctcctgcaaggctacttgtggatcagagcccttgatcccactcagaaaggaccccatcaatgagaagcttttcagtggtgtgtcctttcacccggacgtcactcatatctctttgtcacttgttgtgtatgtcaccacgcagtgatacacccctgaactagatctttcaggacagctttggtgacacgaagctgccacttgttgttgttctttttctcctctttctttcttcttcttcttcctttttcctttcactttcagctctctgcgggacaaatgttctatcgagactgcttcttctgctcattggtgatgggtgtgtccccttgcagcaccaggcctggaaggaggcttcactttcatttttaaagaagcagagatgaaagtcaccagttcagtttctctggtgaacaatgagaacacttggacacagggtggggaacatcacacaccggggcctgtcttgctgtgaggggagggggagggatagcattagagatatacctaatgtgaatgatgagttaatgggtgcagaacaccaacatggcacatgtatacatatgtaacaaacctgcacattgtgcacatgtaccctagaacttaaagtatatatataaaacaccacccaggagttacttttaagtgaaatgtcatcgtgaattcatggatttcccagtacctcttggctcgctgtttgtccccattctttttgtggactctgtaaatgtccaatcctgagccagtgggagccttggcaagttgtgtcctgttgcctttctttccagcccagccatgtgaacacaacagcgatccacatttcagtgtgtacaggcaggctgtctctgccacgtgcccattttcccactctcactcacacaggcagatgcccacagaccacagacacacccacacacgcactcagaagggactccacaccccaaaacataatcacaaacacacaagcagagaaacacacaagaaacttgacacgggcacaagggtgtgggcccaagtgttcccccacacagacatgtacgcacatgcacccccacaggcataacactgcccacaaactctcccatacaggctctgaatcaccacttgcgatgggcatgcttttttgtctccaggcctgggtcatcatgccattgattgggtaacttgggcgttcctttgagaatgaatgcaggaagtctgttatcagataggccccagcagttggtgtgaaactggagctttcttggtcaaactgcttaaaaacttacactcggaaaggatcccatcatcacaaagcttcttggttgtgtgttttttcacggggatgtcactggtgtctctttgccactcccgttcattgtcattgcttcttctcagtctgattcttttgtctttttttttgtttttcattttttattttcactgctttacattatttttaacataattggtatcagtttcagtttttttcttttgtgtttttcaatttgttcttttacttttttatttagtactttcagattgtaattgatttttgcattttctttctatcaatttttctggaccgaaggtagtcattttaggtggtgaatttttcttcttcccagtggtggattcatagtgatatcttatcttcttttaatttcatggtttttgagtctttttttattgagttgtttttgagtggttattgaatggctttattgaatgttatatgaaatattttttctccatttattttactctgtaacttttttttttcgtggcttatcagggcatttaagaaacagttttattaaagttgattatatatcaattagggattattaagtcattattttaagaagatcatttctcttttgcatcatatgttttaattttcttttgcttattgtttaagtgacccaagttatgaaccacatttttttttttttttctgagagggagtctcgctctgttgtctaggctggtgtgcagtggtgtgaccttgactcattgcaacctccacctcccaggttcaaccgattcttctgcctcaggctcctgagcagctaggactacaggtgcatgccaccatgcccagctgattttttggtacttttagtagagatggtgtttcaccatgttggcccggatggcctccatctcttgacctcgtgatctgctcacctcggcctcccaaagtgctgggattacagacctgagccaccatacctggtgaaccacatcttctcttccgctgttcaccttagactcttgatcatattttggggtatttctttttttttttaatttgatcaaatgtgatagtaagaaatgtcatattttatgtgtcattaatagctaatagagaatatatttttggaatatatatttaacctttacttcattctataatgctttttacatttctgtcatatcttatacacaatttttactacactgagaaatttattcttaaagtagtgataaatcaactcattttaatataaattcatgattttatagactatatgacttggcttaaatagatctttctgagaaatcaggaaaatttgaaagccatcaataaattatttactctttgataatgaaaatattttaataaaaatgctaaaaacacttaattttaaaccaaaatacagtatagtatctggtaaagagatttaaacctatgttgcaaagatgattaaaatgattcatacgcaatgaccctttatagagattcatttaaattaaaatttatttttctacatcaaaatgaggagatcatcatgactaagaaattttggattactaaattcttaaaaaattgtccacttttaaaattctattaaggtacaataaatcaaacatatactatgttttctttatcatttatagaaatttaaagtatgataacaggtatttcttgttgaggtgattagcttgtctctcatacattggtgtttggagaattgtttactgaaacatttgaaatggtaatccacaaattgtttaacttttttattataccatctgagaatatgtttgcatatttgtgaaaacaattggaaactgtctcagttatgttcattttgagaattactatgttttggtggacacatttgctggaattttgtgcagatatttttaaaatatttaagtttatgtggttactatgagatattattaaataaataaaacatgttcggagtaatgtgtataatacaaactcattttttgtaacaacaaacagaaagagttacatgttggtaagtatatgtgtctttgattggttatggaaaaaattattaggcatttattccatacttttaacatcttttaacctccacagatttagaattgtttttctggaagaaattgttaatcttctcttttatacatttcatgttgttttcctcattttaatgccttcgtattatatttctaaatataattttcttttataaaacatgcaaattttatacgaagaaaaacagcataagtaaacttaaagactatttatatacaatgtggttccatttaaaagatagataatggatgccattaattcatagaatatataatacatttctttatgttaatacagaaacaaagcctgatagaaatatagtcaaagaacaggcaattcataggagacaaaaatatatggccaataataataataaatatagttgactttaatattaggtcatcatatttgccacaatcaaaaaagtctccagaattctcagttttagaaaggatttggttaaatatctactgtctataaaattgtacgtttctaaagtattttatctctatcgtaattttaatgtttgtaagttttgacttgtgttttatttgtagaatatatggaaataattctacatatcaataaattggcttgcttgtagtaaaaatgttgcaagcatattaaatatctttcaacagaatttgaacatctttcaacagttaaaattatactgtaacacgatgcaatattttgaagccattgaaatattgagactgatctatttttatattaaaaattattaagacatttataagtgaataaaaacaaattgccgaagtgtatgctaggatgatctaatttatattataaactccaaatctaaattattatattattataaatactatatatgtgtacatttaaatagaaataaaaaggtctagacagaattgataactatgttttcttctgtaaataggagaaagactgaggaatggtaaaagtttagcagtaagaagaattatgtctatgttgtttgaattatatacagttagattgtattcatgtatttattcatgtattatttgtgtaaataaataaataaatataaaatttccaaggaatataggagtttgtcaaggggctatgagggaacaatgaggctgattgattagttttggaagcctaataaaacaagagtaatagcggtagacatccctgtactttttgggggagaaatatgcctaagataatagaaacatctggtccacctaacagataaattattttgcattcaaatacattagataccaaaaagatgcaggttattgacattgtatgcctttgatttaatatttattaagcactcatctaataattttgcattctctttaacttgcttaatagggaaattggggtgttttctgctcaacagacatatctgacctgtatgataatggaatttctcattataagtcaataaacttttgttctttctgtatctttcagtcttatgatgtaatcagcgcgatttcacttcctgaatttcgatgaattctaagacatgggcaagatcgggttgtaagacctctgagatttaaggccatgccctggatcatggtgaacttaccaaagcaaac
